United States Patent 10,233,495 (METHODS AND COMPOSITIONS FOR SCREENING AND TREATING DEVELOPMENTAL DISORDERS) - sequence listing, part 17

SEQ ID NO: 61 - DNA, 697100 bp, Homo sapiens
acgtaaccttttatggcttctaattgaaactattttcatccacagactcttcaaacttgattctctcctataaccaacattctttatatccattcttgtaagcatctcttttgttttgaatccttgtgtggccatttcaatttgatgcttggcacagttttccaggctataatctaggctctgattttctgtcctacacttaactcatgcctcctcagggcaacagtcttagccctagtggcctcttgcccagtgaacttccctgtggctcctccttgagcaggacataaggacagtcagcggcaagtatcctaatttctaatttggggcactttttactctgctgtccatctaactctaacttcacttagcttctttaacaaccctataaataaaaatacagctctctttaacagcattaaatttaaatattaaacttcttaccagcatttttgagtgggataaagctgttcgtggaggaggaaaagcatgatctgctacttccaaatctgggtgtaaaatctaaagcaaaaaagttttgttatgtaaaatatcataatatcaatgaaatctattattgagacattaagatgaaaatgtcagcatatgaattataatatattccctccatgaatacaattcaattagctggggtagttctatatgtactattgtagaaagatctccaagacaaaatattcagttgaaacatgttcggccgggcgcggtggctcacgcctgtaatcccagcactttgggaggctgaggcaggcagatcacgaggtcaggagatcgagaccatcctggctaacacggtgaaaccccatctctactaaaaatacaaaaaaattagccgggcgtggtggtgggcgcctgtagtcccagctacttgggaggctgaggcaggagaatggcgtgaacccgggaggcggagcttgcagtgagccgagattgcgccactgcactccagcctgggcgacagagcgagactccatctcaaaaaaaaaaaaagaaaagaaaacatgttctagaaaaatacacatagtatggcctaatttatttgaaaataaaacaaaataaaccctaaatctatatatgtacatatatatatatatatgaaaatgaaaagttctgaaaaaaatacactaaactataaaatagtagtcatttctggtaagggaataatctaggccagagctatttgtctatatagttgaatttttaaaaacagctgcttgtttttatgtttctaagtgtaattaaaaattactgaggagaggccaggtgcagtggctcacgcctgtaatcccaacactttgggagggcaacgtgggtggatcacttcaggtcaggaatttgaaaccagcctggccaacatggtaaaaccctgtctctactcaaaatacaaaaattagccaggcatggtggcacatgcctgtagtcccagctacttgggagtctgaggcaggagaatagcttgaccctgggaggcagaggttgcagtgagctgagatcgcaccactgcactccagcctgggcgacagttataacaagactctgtctcaaaaaaaaaaaaataaaaattactgaggagacagaaaataagattttgaactttgcagtctagacaggtgaaagtataaaactatgtcacagaagtgcaaaaatatataaagtgcaatacatgaaatgtgtaattaattcaacttagggaagactaaacaaaaaacaaagtaacatttgagttaggctttgaaggaaagcaggttggggagcatctgggaaagaaggacctgtgaaggacttgcacagagaagatgaaattatatcagtatgtagcaaattttcttcttgcagaatcattttcaactactaagatttttgatgctatgctgagaatagaccaaaagactcaaagcaacacttaaaggcaacactaaaatattggcagttcaagtcactgaatcactaccacagtacaaaatatcttagtgtctacaaaataatccatattacacagtttaagtacagtgttgccatttgattataattatttacgaatgaaacaaagcttatatacttgtgtgtcaatgctcccaatcatccatgaaatttagtctctttttggtctagtttgacaatacattatgctcctatttctttttttcttttctttttttttttttattttgagacagagttttgctgttgttgtccaggctggagtgcaacggcgtgatctcggctcactgcgacctccgcctcctgggttcaagtgagcctcctgtctcacctcctgagtagctgggattacaggtgtgcaccaccacacccggctaattttttgtcttttttttttttttggtagagacggggtttcaccatgttggtcaggctggtctcgaactcctgacctcagatgatccgcccgcctcagtcttccaaagtgttgggattacacgcatgagccaccgcacccggccgtatgctcctatttcttattcacagtacattaagtagtatctaatccaccactgtgcttagtaactataacaatacgtatactcagttttaccaaaaaggaattttacacattgatcaaatttggtggcacgggtgttgcaggtttaggtatacgagtatgcagcagaacccttaccaggagccattggcttaagaagtacaatcttaatctttgttaattttgctacttaacccctaaataactattcatatcactagtaagtaaccacacataagatttaatcactgtaggaattctagaaacattaaactttcttcagtcattcaaatactaccttctcagcttttgctatatccatataccatctatgcaattatgtagttaatatttttctttaaattgtctttaaatcaactcaccttctttttttgtttattttgttttttgagatggagtcgagctctgtcacccaggctggagtgcagtggcgcagtcttggctcactgcaacctccgcctcccaggttcatgctattctcctgcctcagcctcctgagtagctgggattacaggcgtgcgccaccacgcccagctaatttttgtatttttagtagagatgggggtttcaccatgttggacaggctggtctcgaactcctgacctcgtgatctgcctgcctcggcctcccaaagtgctgggattacaggcgtgagccaccgcaccctgccaaactcgccttcttaaacccagtattttcttagatgatagttgagcaatgacaggttctatatgctattttaagtacacattataataaaaacataattattaaaataaaaaaggttgaccacatattaccccaaatcatcaccatgcttcattttggcaaacaatcacctagtcatctctgtaaaaacattcaacctacaggtaaagaccaggagacagcctagagataaaaatgtgattctcaataataccaagtggcagaacacagactggaattcaggtatcctgtatcccacactagtgtcttttgcactctatcacatcttgcatttcagattacaaattatataaggaaaagtcagtcttctctaactgttcccatttcatagataccaccatgataacaaaaagactaacacaaatttgaaagttttctgagaataaaatccctcctggtaatcctaggcttctaagtttctatttaagaggggaaaaaatgttttaaatagcccagaataaaatattcttaaagtagactattaaggccttagttctagtgatatcttgaaaagcaatgcagaatttctacagttcaattttctgatcataagcacctaaaaggctatcagtaaaacaaaatactgttttcaaaatttggctaaggtaaaataactgcaaaaaaatttaaatttgtttcaatgagaaaaacccaagccacaagattttttaaagctttatttggcttgaatgtagcatatacttcttctttggtatttctattcatatggcattaagaatggaatgttgggccgggcgcggtggctcacgcctgtaatcccagcactttgggaggccaaagcgggcagatcacgagatcaggagatcgagaccatcctgactaacacagtgaaaccctgtctctactaaaaatacaaaaaattagccgggcgtggtggcgggcgcctgcagtcccagctactcgggaggctgaggcaggagaatggtgtgaacccgggaggcggagcttgcagtgagcccagatcgtgccactgcactccagcctgggcgacagagcaagactccgtctcaaaaaaaaagaatgaattttggacactttatgtatcaatatgacacatctttctgtaataacctgaaagtattggcaagacaatattacagtgttttgtaggtaccaaagaggaatgagatgccaatagggaggttagagaagagaagccaacatctaatgggggatcttaggggaatcagggatttcaaggcagagccttgttttcaaaggtgaatttccaatacctaggacagtactaggtcctgtatgctgaatgaaggaaggaatgtagaacaaatattcagttaggatccaaaatatatgctttagataactacctagtaaatgaagaattctaaatactgtatgagattatgttcatgtttcaaatatatagctctctttaaattaaagtaacaaactgcattgacaaacatttttaattttagctatcttagcttcagatttaaataaagagaaagttactattacaaaaatatgtcataccaaagaaagagctgattgagtctgatgtagaagtggttctgggagggaagagaggtgaatacattcgggaattttaatagtgcctccatccaaatctgctatgattacatctaactgaaagagataaaaaaattaacctataattaccaaaatacatttgttgttaagcaaattatttttcccttgactaattcaaaacgagaagaatcagatgtggaagagactcttgtttgtccatagtagtagaattctgggctaacaagttcccacctaccctgtatttcccaggttcctttgaaattaagtgtggcatgtggctaagattctgccaataaaacatgagaagtgacatgtgttttcctgtccttcaagacaggggatatgtaaagctctcctatgctgtctttccttttcccttagactgaaattattaactggcagcaaaccagccttcagcatacacatgatgacaatgcctgggaggattctgttggagaaacaagaaggaaggaaacttggatcttgagtgacttcatagagcaaactggtctggcataatggaacatctctatggactgctgcatgaatgttcgataacactttattttgtttgagccattgcattttgttctgattttactatatatgctgctgcagcaagcacagaggattgcatttgagacactttattcaagtagtttagtaatattctaaaaaaattagtatttattataagaattaacaattagtatacatcaaaagggtgctgtttagccacttagaaaaagctgatctttagcattttacaaaagtctatttaaaaataacttacataaaagtgtaagagaaaacaaccaagatgagtgaagttgttatattgacaatattatacttcattctaatttattcattacgattttaagaaatttgcatttggcaacacttggtttgtcctacctccagcgactgtttttatttatttggcaacacttggttggtcctacctccagtgactgtatgtatgtatgtatgtatgtatgtatgtatgtatgtatgtatgtatgtatttatttttgagacagagtcttactctcgcccaggctggagtatagtggtgcaatcttgactcactgcaacctccacctcccaggttcaagtgattctcctgcctcaccctcctgagtagctgggattacaggcatgcaccaccacacccagctaattttttgtagttttagtagagacagggtttctccatgttggccagggtggtctcaaactcctgacctcaggtgatccgcctgccttggcctcccgaagtgctaggattacaggtgtgggccaccgtgcctggcctccagtgactgtttatatttagcagaaataaaattatgtacaaaccaggtggatatgcttctaactagtattaattaggttttattaaatgtttattgatttacacatatttttatacagtgataccaaaattaaataggaactaagtatcaacatataaagttagaaagaatgatgactatacgaatgaaagtcctgcttataattataatgttaaataatattttgttagtttaaatgacacctctgatttggttacaactataattacttctttgctggcatttaaaactaaaacagaagaagaattacaaaatcttagggatctgtggatcatagatgctatgcagcctaactttacagtgaagaatttttctcaggctctctgaaaagtgtcacataatcttttccttacactctacttacagtgcttgagagtacactcctcatctcacataaggaaatccattccataaccaggcagttctaattgttggaaacacttttactgggcagaaatctgtttctatagccacttcatccactgattttatttcagccttttagagttacaaaaaatgaatctcaacccttcttctatgacagtaacttaaatacttacttttacctatcaaatagtatcagattattacctgagaaaatttccttaggcccttacagaacatagtttctaaatacttgataatcctggatgtccttttctgatgtgctttattttgttacagtccctcataaagtgtgatacacagaactaaatgaattattccagaactggcttgaatatagagtatacttttgcttcttctattcatatggcattaagaatacaaaaatttcgtggaagctcataccaaacttctgttccactaaaactcttcactcttttgcatatgctttctgctttgttagttatcaggaatttggtatcaagacacgtctcacttcaaaatataaaacaattatgcactaatatcaaaagtataaatagaattttatcttttgtcatatgtaagatgaataataaagataaacaatgtaccaaaagagggatatttaaaaatattaataaattcctttataaaacctcctatacttgctatatggcaaaattaatatacagacttttcaatgatatttttcttctatccaatcttttctactggaaatgctacagatctgaaaatagtgatgagttgaaatgttataggacccaaagaaatatgataaacttctggactcaataactggaaactttaaagatgaatacttacaagttcatggacatcagttttaaagacagaatgtactccaataatgaaaggcgttggggaacttagaacttccagtagctgagccgggagaatagggatataaggataactggaaataataaaaatatgcgtcaaatatatttttctttaacataaacatatcttctttcatctttatgctgtgttaagttttatattacctatgtttagaaattatcaataatgttttcatgctttttaatactaaaattttggaaaaaatgatttaaaaatcttcatgtgaaagatacaatcagatataagacataaaataaatggaatccaagcctgcttccttaacctttgtttcttctaggcaagcagtctctttaggtcttctagtactgtttgaaagcatttttccttacatagaaacccgacattagacagtaacactgactctctgatagggcctcccctctcagtatgaggcaatgatttatctatacaaaacaagcattcaaattccactttctatacttgatttttgcattcaataagaatggcaaaaaaaaggggggggccaataattaccttatctaaaaagttaagaaaagcacctaaattaaaaataaattttttttttttttgagatggagtctcacgctgtcgcccaggctggagtgtagtggtgcgatctcggctcactgcaagctccgcctccagggttcacaccattctcctgccttagcctccccagtagctgggactacaggcgcctgccaccatgcccggctagctttttctatttttttagtacagacggggtttcaccgtgttagccaggatggtatggatctcttgacctcgtgatccacccgcctcggcctaccaaagtgctgggattacaggtgtgagccactgcgcctggccaaaaaaatttttttaaagaaattctggagtctaaaattttatctagtttatatgaactaatttcccagatgttatgattatcaattgattaaacagtatattagaggtataatattctagttacagcactattagtcatcactgtttagattttattttgttttttagtttttattaggaaaaaaattttaacatatcccataaaaaaaacagaggaaaaaattacaacgaagccctgcagtaattgtcaactttgagaattaccagtgcacggctacatatatatttctacccactttttttctctctactgtattattctcaagcaaataccagatgtcatattgtttacccatataatacacttcagtgggtatctaagagagataagagctttttattaatagaatctctatcattataacttctaaaaattaataattctttaatatcaaatagcattgactagacatttatgccaattgtgttaaaagttgctgacaatactattcaaattaaatatttttacactaatcaacattcagtaatggacaacttggaaagtctcaaattctagactagattttatcagaactatgactcatataacagcataactttgtaaaatatccctatgtggttcaaaaccattgtgccataacattatgacttatcaacgataagtgatatgtagtttaggaataaataaaattaacaaatgaaaacctcacctatatttaagaggaaacattaaagattccagggctctacaagcatcactaagtctctggaaacttgcagaatggaagagaaccttattttctgtgaggactgcacaaaagaggctgaggacattttgaattcctgaaaacataagagcaaggacttacaaatgcatttaattttatatgtgttgtcaacaatcatagacagtatacacggaaagaaaaagccagtaattttggactctctgaaggaaaatacttggttaaactgtaaattccatataatctatgagtatttgttttcccaaactttcagttttgcctttattcttcaaatcaggtaacactcattgaacatattagttgtttggaaacactattaccttcttttcaatttcatctctaaggcctgtatttaggttcctgttttagaatgctagcattgttctaaaaactaacccctgcagagtctgtttgtctgacgttaataataccacaccagctttgttgttgaaatttgcctactatatcttttctcatcttttaatttcaacctttctctacttcttgtaaacagcatacacaaatgctccgcaatttaatgatagggttacgtcctaataaacccattgtaaagttgaaaaatcttaaattgaacataaatcagagactgtaactgaaatatttttaatccagtctgacaacttttgtcttttaactatttcatttaatccatctatacttattgtaattattgagatatacactatatatagagataaatgtggtatcttattttatgctttttctttttcttttttctttttttttttttgagacggagccttgctctgtcatcgaggttggagtgcagtggcacgatctcagctcactgcaagctctgcctcccgggttcatgacattctcctgcctcagcctcctgagtagctgggattacaggcgcccgccaccatgcccagctaattttttctatttttagtagagacggggtttcaccgtgttaagcaggatggtcttgctctcctgacttggtgatacacctgcctcggcctcccaaagtgctgggattacaggtgtgagccaccgcgcctggcctggtttttattttttctatcttctcttttttccttcttttcaatttctcctgtctcttctttcatcccctctgttagtatggtatttataaactctttttctatttttttagtggcaactctagaaaatacgatatacatacttatgaaattgaagttatatatatcatttcttattttctcctgtttattactgaaccaaattatctttctttatatcacttcaactttaatcatacacacccggtaaagcaagagtccccatttgttttctcaaggtaaaatactatattttccctttatcatagcttatttcttcatgtgacatgcaaatttccttagtctattattaattgctattccctcttatcacttccaacttatcccatgtgatacatcagaatttttagttcagattttaatcttcattcattttcactaatgtaatagtttcgtaagtgattttcctaatccagtccttattcccttcaaatctaccctccagatagtttctagaataatggaaaaaaactaaataatgattaaagaaatctaaatacaattttcaagtggtttttaaaattcatattaaatccacaagaataaatgctacaaattttgcaaaaaatattcttttggctttaacatgaattttaaaaacccactaaggttttggtacacttaaacaacagtggaaatgaatgagctagtattgtatgtattatcatgactaactctcccaagtataatattgagtgagggtagtaaggtgcacaatgattatatagctgtgaaaagaaaataaatctcaggacccccaaaccaccaagccaaagggaagtcaagctaggaactgcaccaggaaaaccaacctccattttattcctaagtaagatagctacaaaaattaaaaaaaaaaaaaaaaaaaaacaaactacatacctcccatacctccctcacaacctgcccacaaggaaattccttgtggacaaaggacagacaaaactcaaagtcatccctgtactcctgtgagacaaatgcatatctgatttcttcctctgccctattgtttcactaagccagactaaagcttaagtgactattcctctatcttcctctcacatgtaaattgtgtattcagtaaaaggctaatcagagactcaaaagaatgcaaccttttgtctcttatatacctatgacctggaagccccctcccctgctttgagctgtcccgtctttccagacccaaccaatgtacatcttatgcatattgactgatgtctcactgttacagcaggtagctagccagacatgagcagggaaggagaggatcccccacccccatgccaccaccaggaatgtcaggcaaccatcaggtgatggtcaggtgattattaaactgtctctctaaaataataattggtcatagctgatgccacagaaaggcagtcttccaacagacagaaacatcagaaactggtgatcagcagcttcctgataaaatctcaggagttggcgagcgggctcatgcctgtgtagttaagaggcaaaatggcagagtttaactggtatatgaccctctaggaacatttggactggtaaaggaagaaagcctccagtgagcatgcgtacaattccagtaaacacactgcacatgtgccccctaccaaatgctgacaggcctttgtgcatgcggagtgcccaccccaagggaagaatctggggaggagagatgcaagaccccggacacatgacaacatataaaatcccgagtcaaagctcaaacagtgcacttgatctctcaagttgtctgcttggccctcttccaagtgtactttacttcctttcattcctgctctaatactttaaaataaactttcactcctgctctaaaatttgccttggtctctcactctgccttatgctccttggttgaattctttcttctgaagaagcaagaattgagattgctgcagacctctatggatttgctgtcggtaacatactttggtgctgtgatttggatacattccctaatgttaacatactttggtgccacgtgactcaaatatgcttcctcagtggtaagacatctctatgcctcaacttctttggctggaggtgtttaacccctgtacacagtttcgtttgctcttttcattcttctgcttactaaccaacccccagaacaattcttctcggccacagtggctctgttcctcaagctcatctctcagctcctgctgatgtacggtagctcacaggggtaggaaggaccttggagtccttcccaggtaagatcattgacctgagacacaatggctctcctagacaagaggttcatgagagtggtagggctaaagcctaaaaccatgcaatgtctggggtttcctctgctttttcaactcaaattggctcttttccaaaaacccacaccacctattctcctgttttctctgtatgtattctgaaatggccttgtacaccctccggaccgtccacctcgaggcaagtcagcctcttttgctttcactttgcatgccatgtaactgttatttgtacaccctcagctcttgctgaatttgtgcagcagcaaaaacatgggctcccttgtggctatctagagacttaacactagtttttaccttaccagctcagatgacctctaatcctgcctctgtctgttggtacattgccaggacagacactaattggatccccagtcagctccttatgacttaccatatgctttttgttcctgttacggtccagggctgagttttccggtggcttttgaagtagttttccacccacatagggcctcattctagccctttaaggaccccacttacttgctttttttgagttagcaccccttcgggaggaggggaaattcttcctttcccatttgtgagttcctacatcaagccctaagtcctccagaggttaccactttatgttaagaagacaaataaatgttaccctctcaaatccaagggatgctgtttttggaagcataagaaggctttccatgattattcctctggcttcctcccacttcctcctggagcttccatttctctaatcacttccatgcccttctcaatattgatcaaaatcttcaaggtcatatttgaagggagggaagttcagcccccttgcagcagttagctgaaaatcaagcttcttgtctagttagagaacaaaggaaatgggaatctgagaaaagggataatcattttgttgcaagaatgctccaagttgagagtcactggaaggtcatggaggcaagaatataggatggcccaaggccgtcggcacaagagacccatacgacagacatgaaggctggtctcgggttaacagattatcattataacagagatgaaggcaaggttaagggtacgtggtaagaccagttcattctggaaccgcacggatgaacaggagagggctctctgttctctctggtatctcctctgtgaaaagggcgtaccgaagttaagggtacatggtaagatcagctcattccagaaccctaaggacaaataggggatgccctattcaggataataggaagagaagacgctttcttttttctttttttctcatctattctctcttcacagatgggtaactgcatcttcataccacagaacacgcccctcagatgcattctcaagaactgggaaaagtttgactccaaaaccctaaaaagggaaaggctaatatttttctgtaacacagactgaattgaatacaagctccacgaccaggaatcttggacagaaaaccaaaattttaatatgatctatcaactagatttactttgccgccagcagggaatatggatagaaatcccctatgtacaggccttcatagccctatgaaacaaccctgacctttgttgggcttgtaaaatggatctagtgatgatagctgccatagtcaggcagccccctctggctggttcgggacactccttattgggtttaccctggtttcaagccccagaggagcaaaagatgacggctcaaaccccactgccccttctacctcattatattcaagtctcccaggcccggagcccctccatatccagggctatcctctggacaccaccctcttaggtcacgcccccttcaagaggtcagtagccccagtggacccactagaaaccagactccattcactatgtaaggcctgagccaaattacaacagaactatgggactttatggaggaccctgacaaatacatcaaagggttctgtaaactgggattaacatttgaactcacttggagggatttctcagtcatactagggcaaattctgtctaagggagaaagtgattccattatggaggtggcccaacaatttgcaaatccaatgcatatgactgacccgggtggctaccctgtaggagccatcacagttcctccggttgactccaattgggattacaatacccagggaggtatatggggaagaaaccgcatgttcctctggtagaagggataaaagctagcagaacaaaggctgtgaactataatacaatggccttaatagatcaaggccctcttgaaaaccccatcactttcacagagaggctacaagaggccctagtgaaacatactaacctagacccagagacatcagaagggcaactggtcctacaggaccgtttcctaactcaggcagccccagatattcagaggaaactccaaaagctagcactgggccccaatacccctatgcctgatgttctcaaaacagttgccttggtcttttacatcaaggaccagaaggaagaagaaagggctcaggaaaaggagaggcaaacggaaaagtggcagctccaactattggctgtcttacaagtccaccagctccctccaatttgccctaggaatatcttcccaaataattgcattggtatgagaagccaggccactggaaggccaactgcatcaatgggacagatgggaaaaagccttgcatggcttgccccctccaccacaagcttggcaactggaaataggactgccctgagggctggagggctcctgggagagaatcctttgtcttgagctgaggggggcctacagtccagctggctcccagatcaaacatcactattgaagggacagagccaaggaatgctttgcatgtggcaggtaggactataagttttcttttggacactggagcagccttctcaatgcttacctcttttcctgggcaattatcctccaaatcctgccagataatggggataaatgcggtgcacataaccaggaggtttactcctcctttgtgctgcctatctgggggaactgtcttttctcactcatttttagtgttgctagaatgtcccatagcccttttgggtagagatattttatttagactagaggctccagggcagacatcccctttttgaactgcgatcttatgcctcaaggaaaccacacacaagggtgaactgcccatggactgtctcattaatccagaggtctggatatgttcctattgtcatatataacatttaaatatgttacaacggcaaaacagttaaacttattgctttctatatatttttatttattatactttaagttctgggatacatgtgcagaacgtgaaggtttgccaaataggtatacctgtgccatggtggtttgctgcacccatcaacctgtcatctacattaggtatttctcctaatgctgtcccttccctaccctccccaccccctgacaggccctggtgtgtgatgttcccctccctgtgtccatgtgttctcattgttcaactcccacttatgagtgagaacatgcggtgtttggttttctgttcctgtattagtttgctgagaatgatggtttccagcttcatccatgtctctgcaaaggacatgaactcatccttttttatagctgcatagtattccatggtgtatatgtgccacattttctttatccagtctatcattgatggacatttgggtgggttccaagtctttgctattgtgaacagtgctgcaataaacatacgtgtgcatgtgtctttacagaatgatttataatcctttggctatatacccagtaatgggattgctgggtcaaatggtatttctggttctagatactggaggatcatcacactgtcttccacaatggttgaactaatttacactcccaacaagagtgtaaaagaattcctatttttccacatcctctccagcatctgttgtttcctttttaatgactgccattgtagctggcatgacatggtatctcattgtggttttgatttgcgtttctctgatgatcagtgatgatgagctttttttcatgtttcttggacacataaatgccttcctttgagaagtgtctgttcatatctttcacccactttttgatgaggttgtttttttcttgtaaatttgagttccttgtagattctggatattagccctttgtcagatggatagattggaaatattttctcgcattctgtaggttgcctgtcactctgctgatagtttcttttgctgtgaagaagctctttagtttaattagatcccatttgtctattttggtttttgttgccattgcttttggtgttttagacatgaagtctttgcccatgcctatgtattggtattgcctagatcttcttctagggttttaatggttttaagtcttacatttaagtttttaaggcatcttgagttaatttttttaaaaggtttaagaaaggggttgagtttcagttttttgcatatggctagccagttttcccaacaccatttattaaatagggaatccttcctccattgcttgtttttgtcaggtttgtcaaagatcagatggttgtagatgtatggtgttatttctgaggcctctgttctgtcccattggtctatgtatctgttttggtaccagtaccatgctgttttggttactgtagtcttgtagtatagtttgaggtcaggtagcatgatgtctccagctttgttctttttgcttaggactgtcttggctatacaggctcttctttggtttcatttgaaatttaaagtagttttttctaattttctgaaaaaagtcaatggtagcttgatggggatagcattgaatctataaattactttgggcagtatggccattttcacgatattgattcttcctatccattagcatggaatgtttttccatttgtttttgtcctctcctatgtccttgagcagtggtttgtagttctccttgaagaggtccttcacatcccttgtaagttgtattcctaggtattttattctctttgtaacaattgtgaatgggagttcactcatgatttggctgtttgtctattagtggtgtataggaatgcttgagattcctttatgcttttttaaaaactaagagaagaaataaaaaaatacacatatagtctatttacccacagatttcccatttctagtgttgtttgttcgtgtgaaatcgaattattaactagtctctttttcctgcagtcttaaggatttccttttgtttttattttttattgtttttttgagacatagtctcactccatcacccaggctggagtatagtggtgcgatcttggctcactgcaacctctgcctcccaggtttaaatgatccttccaccttagcctctcaagtagctgggaccataggtgtacaccaccacatctggataatttttgtatttctctgtaaacatggggtttcgccatgttggttgtgaactcctgggctcaagtgatccacccacctcagcctcccaaagtgttaggatttcaggcgtgagccaccacgcctggccttccttttgtatttcttatagagcaggtctactagcgataaatctgtttttgtttacttggaaatgtcttcattttatctttgtttctgaaagacagttttgccagtgacagaattcttgtttggtatttttttctttcagtgcttttaatatgtcacatcaatgccttctggctcccgttctttctgttgagagacccgctgcaataatattatagttctattgattcatatagatgaattattttctcttgctgttctcaagggtttgcctttcaccagtttcacaatcatgctgtgtctacatggggatttttttactgttaacttgggcttcattgtgcttcttgggtctacaggttaatgatttcaacaaattttgctaagtttttgagcattatttcttcaaatacgtttttctaatcacccccatatgcatccaatggagatgctctgtacctaaaaggtattattgtctcaaaggtctctgagaatctgttatttttatttcaatctttttctctatgttttttatattggatcatttctattggtctttcaccaaattttattgatttttatttctgacatctcaaatgtgctgttaagctcagctagtgaattttttgtttcagttatttattttgagaaagggtcttactctgttgctcaggctgtagtgcagtggcataatcacagctcactgcagccccagccttctgggctcaagcgatcctcctacctcagcttcctgcatagctgggactaaggggtgcaccatcacacctggctagttttttattttgtagagatgagttctcactatgtttctcaggccggtcctgaacttctgggcttaagagctcctcctgcctcagcctcccaaagtactgggattacaggtatgagccacgatgcctggcctgtttcagttatcatactgttcaatctataatatctatttggctctttttcagtttttacttcactactgaaattgcctaggtttttgaccactgtcattatattttgtcttaattctttcaatatggctaccattaattcttttagcatatttataacagctgatttaaagtccttatctgctaaatccagtatgtgcgctcaaagtcagttaatactatttttttttcccctgagtatgggttacacttcactgtttgaatgcctcttgctttttggtaaaaattggacattataaataatatactgcactaaatttgaattatatttttttcctgaaagcttttttttttctttgagagggtgctcactgctttaagctgcaaaatctgcttgtaatgttaggctgctgatgtctggtttaaaattttttatttttatggtttagcttggcttcctaggggttatccctgtgtttgcatggttcacttggtcagtccataatttgggcagaggttgtactcaaataccttgagccaataaagcttctacgtactgctgaccaattttgcatgggttggagcacgttcatagtttagccagattttaagtatgctttcagtttcagacatgtgcatagtttcccaggcagccaggcatgtatagagacattgtctagttcttctaagactttctcctcttcacaatttctctgttaaatttctggctgatgtgccactagccccaactatgactgtaattcagacaggcatctgacgtttttctcctttcatctcctactggtttcaatacttttaccgataatgatgccatgggttttagccctccatcccaaataaattccactccatctggtagcaaagctggttttctacccagccctactctgccactaccagtctcactgacaaagctgggatgtaggggagagggggcaaccaccagataagaatgctgcagactcctgctgtttttacacaaagttctagcatgaataaatgtttccaaatttgtcatttgcttttggtcaatttccagagccctgaaattgttgtattcaacaactttgtctagtttatactggttctttgggggaaaggatttgctaaactctttgtactgtctttggtgatgttaattttgtctcctaaattttgtccaatgctgtccaatttctccaatgaatacttattatttttcctgcaactaaaaagcaatctgtatcaagacactttaagaccacgtaaatatctcatctctcaccaaaatgcctggctagatttagcatctactgataatttctgcctgaatagatctttactataatgattataattttccaaatgcagcactcactctgtatttcccagtcagcacttggcattctacatagcagagtcctccttttcctctacttacttgctcattcattcattcattcattatcagtgtggactcataaatatctactttttcctaacagtctgtaagtcactactgtccttaatttttctggtgctaaacatgtcctagatttatgcagtaggagccctttaacttagttcctgtgtccttgagacagagctcttttatttttccaggctcatattgtacttaccctgtcctagccctagtccaaccatttctcctaagagtcctggttctctttggtgagaaatggtatcaaagaccaaaattttaggtgttagggcatgtgttagatcatttctactggggtgactttgcttctaggccacttttgcctatagatggagctaggaaatatatgcatgtacatatatacatacacatacatacatgagaacatatacatgcatatgtatttgagaaatcctgagtctatgccattacttttaattccattccatccccacagggtatccctcactatcccaattcatatttgtatgttccttcttccactgagaatgctggaacctaataacatcaacatacttattcatttgctaaatcctgtattacacataaaagagcttcagaattgtttcagccatttcaactaaaaaaaaaaaaaaaaaaaaaaacgaaaatggagttcactatttgtttgcaattctcttcccaaaactgtccaaagctgagtttgtacagtcaaatactcataagttactaaagtaacttagttttttttccctcttcagtgtggttacattatttgaatgacagtagagtttgtttacatatgcttttaattttaaggtaatattttctttcctttcttcttatcctaattgaattttttaatatatgtaagacacaaatatgctaccagaagtcaaaataatacaagaagatacacttagggaagtgtcattccctccctcaattaatagtactgtaccaggcctggtgcagtggctcatgcctgtaatcccagcactttgggaggctgaggtaggtagatcgcttgagcccaggagtttgagaccagcctgggtaacacagtgaaatcccgtctttactaaaaaatacaaaaattagccaggcatggtggtgtgtgcccatagtttcagctacttgggtggacgctgacgtaggaggactgcctgagcccaggaggtcgaggctacagtgagctgagtttgcaccactgcactccagcctgggcaacaaagcaagacgcaccctgtctcaataataataataataaaataataatactgtatcaatgtcagttcctggtatccataatgtactatgattatgtaaaatattgttataggaaggtgggtactgcatacatagggactccggatgaatttagttatttcttgtgagtcaaactatttaaaataaagagtgatactttttaaagtctgtggatgtattagttttctatggttgctataacaaagtaccacaaatttggtggcttaaaacaagacaaatttattattttactgttgtggaagtcctgtgatcaaattttccagcttctggtgacttctcacgttccttgtcttgtggtttccttctatcttcaaagttgactatgagcagtcatactatattactctgaaggtaaatcttttgccaccctattaatgactcctgaggttatcgtggtccacctggggtgggagcttcctaaagggactgacccttgaggtagattttgacagagatgcattagttaaggagaaaagaaaagcatagcattcaaagctgacagaagagtgaggaagcaaatggcattaacagacctacaagtaatttggccaaagacaaatttatgaagaatctgtatgtcatgtcaagtctagtctttttaaatgaagactctggggaaaaacttgtccctctttgcttttttttttgagacggagtctcactctgtcaccaggctgtagtgcaatggcacgatttcggctcactgcaacctctgcctcccgggttcagcaattctcctgcctcaggtgccccccatcactccagctaatttttgtatttttagtagagatggggtcccaccttgttgtccaggctggtcttgaactcctgatctcaggtgatcgacccgcctcggcctcccaaagtgctgagattacaggcatgagccaccatgcctggcccccaccttgctcttatctgaacactctgccctatcccacaaaaaaaggataaccgatttacaagtagttcatcagaaaataatattcataatcagtatcatttagtatcagataaattgtgaagaagggaggcctgcagttgtaaggaactttacgttactcatattagtaaaaacaatcagttgatattgtcaagggaggcaatgctatactatatttactgagaggatatatgtctcataatgtagaaatgagataggaacaatattctagtgcttaaagggtaagtttttcattatccagaaaattaatagtataatacaaaacaatttacccaagcctaattgaaatactacttaaattctttattcttaaatgtcacatgctttcttaagttttacattattattattattattattgtttttgagatggagtctcgctctgtcgcccagtctggagtgtagtggtgcgatctcagctcactgcaagctccgcctcttgggttcacgccattctcctgcctcagcctcccgagtagctgggactgcagacacgggccaccatgcccggctaattttttgtatttttagtagagatgggatttcaccgtgttagccaggatggtctcgatctcctgacctcgtgagctgcccgcctcggcctcccaaagtgctgagattacaggcgtgagccaccgtgcctggcaagttttacataattaataatctcaaatattttaaattacattaatgatttttattcctatgtagcagtgtttgttgctgtgttcacagttacatagctattgagaaatccagtttcttttaattttgtaagtcaaaatcagttttctatataactgaattgtctcaccttctgtagcccaacatccattcaaagctgcacaataacacgggagaagaaaatatgaaaaacagacatgccagtgataattactagcgatttcactacaatgatacatatacatcctgttgattattcaaagagtaaaacattctgaaagatggcttcctgatctcaattttcttgaaaggttagagttctaaaattcattgcaccacatgttaacaaatgtatttgtttcttttttggggaaagaaaaaaagaactttctccagactcctgcattctctgaataataatgatatgttacacaaatagaagactatgtctcagctttcaaatggataaacagtggaactgaagaccatgtttcaaaacagaatatagttcaaaaagccctgcacaatttattatagttctttctggccaacccacaacggggaaaacagtatagttctggtcacagcttaatgtaagtcatgaaaaaggaggtttctcattcactgaaccagtatttattgtgtactatactccagacactagaatatagcagtgaataaagacaatatccttaacttcatggattaactaaaactttatataaagtttcaaatttatcactgagaggtaatgtttactatctgttacaaatttagcattatttccacatatgatagatatggcaagtattctaagtaaaaaagtaaaaagtgtggtaaattgggcatctgaaaggaggtgtagtttagtccttatgaacacagactcaaccccctgagtatgacatgaattaaatatattttacacacacaaatagagcttagcaatgtgggagactaaatataagaagtcaattaccaaacacatatgactaaaaataattcaaatacataaaaggccaattcaaccaaaactgtgtaaaaaggtgcagcatctttacttccttcttgaacattctaattgtttttctagctctgaggtaataacatcagatttttccaaccttcaatgacccaaattcctagactatgtctgttctgcttgacttggtttttatctacttttaattctaaatttaagaattaggaagcaaaaggagccttgtgagtagagcagcaagcagtggggaagaagaacagagaataactggagaattatgcaaggaacaaataagagggaactgtcctggcagaaacaactcttttaattcaaacttcctcctttcttttcccctttcttcccttctgccactattacattattactgaactactgagatatatcatcaatcataaaattctagggatggatataaagaaatatgagacaggctcttaggagctcacagttcagtgaagacgaaagactggtaaataaacggttaaaacataaaataatagagctatgtatcaaatgttacagagcacaggaaaaaaaaaggtacttcatcctgccaccatttggaagctatgtacttaaatgttggagtagccatattttataaaaatattaaccactaaaatgctgaaagagcaaacagaaattttagacaagagaactttgtgacaaggaagaacgatacctaatgactctcttgccttagagcatttacattctttatagataattcaatgcaaagatagagctatttaatattagcatctacgtgccaaaaaaggacaatgggcaggacagttttgaaccaggatccttctgaactttcctcagattatatcatgtagcaactactttcttcacatgtgatttgagcaagcatagtacaccagtcaacaaggactcaattggtcaatgactgtcagtctttgatatttttacaacggtttctttatagaactagcataaatatttaatttttaattttgaaatgaaaagcaatcagtttcttaataacattctgactatttcctaaaaccctgttctcaggcttcaccaaacatcttactattccatgagggcctttcataatttcctataatgctaaatatgcttcttcttctagaatgcccttattttacttttctagcaagtaagagtttgctcttggtatctctattattgtgctaattatattctactatagttttaaaacgatacctgtttttccattaggctaaaagtacatctggggtaagagctgtgatttgttcatctttatatccccagtgactaactcaggagctggcacataataatggctttgtaaacattttgtgaaaaaaaacatacttctaccatcatataagcagaagggcattacgggaactttcttatagactcccatgccatttattagaaagaaattacattggaacagttttcgttagagatccttaggcctctgaaggtaagcacatggtacacgtggtaagcagttccttcagaaaagtgccccagagtgggctagcaaggagatttaatttgcttcaaatccccaaagaacatagctgatattcaactgtcaaaaaataattaatcatagatacagtaaaatagggcacaagatgccattattagtaatagtttaaaatcttgtgtactcaaatttgcaaactatgtttttatgataggagaggaaatatattttctttaaatttttttttaaccctgataagtttgttgttgggacagacccttatgacaaaagacagattaatatgagaaaactaagcaagcttccttcaaggtcaaacattgaaaaaaaaaagacgacttcattttttccccttataagtgagaataagattaaaacaagtaataatgctatatgaataagctgagaaaactaagacagaaacatgatctgaggccctagatgctgatcatttcagtaaaaaggataaaaatcatcctacaattgatgcattaattggatggttcagcaatttaccaatcagtattttcttttaaagaaaacatttttacacatcctaagctttcatttttacctctggcatcttttcatctttatgttttaggaacgtaagttatttttaaggctcctacaaatgttcttattgttatagtagatattcagacagacataagcagagcaggagaacctccttcccctgcccaaccccaaccaggaatgtcaggcgaccatcaggtgatggtcaggtaagttgttaaactctctctctaaaataataattggtcacagtggtgccagggaagggcagtttcccaagatagaaatacctgaaattggtgatcggcagcttcctgataagagctcaggagttgggtgagtgagctcacgcaggtgcagtaagaggcaaaatggcagagtttaactgctatatgaccttcctctaggaacactggattggtaaagaaaaaatgcctaaagtgagcatgtgtacaactccagtaaacacactgcacgtgaagcccctcccaggtgctagcaggccactgtgtatgcagagagcctacctcaagggaagaatcaggggaggagaaatgcaaccacccagaagcatgccaacctataaaatcccaagtcgaaaagccaaactgtgcacttgctctctcaagttgcccgcttggcccaattccaagtgtactttacttccttttgttctagctctaaagctttttaataaactttcactcctgctctaaaacttgccttggtctctcactctgccttaggccccttggctgaattttttcttctgaggaggcaacaatttttgctgcagactcctatgggttcactgccagtaacattatcacttcaaaaataatcacatagtatcacagagagaagtttttccagggaaagacaaaagtgagactaccaaaggttttccattaaagcattttaaaactgaaacaacttgctgaatagcaaggaatggctacagtcaacattttaataacttttatgtacaaagtaagaataatatttgtaagacaaactgaacaaaaacttttttaagaactttaaaaaaaaaccctatatttaatatcagagatcatcgatggagacatactgacccatcaatagctaataaaaaactggccaaagttaaccatggacaagtaaaaagaaagcatgcatagaaaaaggtacaaacacaaatgatacaagattaatgtggtttaactgtggaaacaaagtgttgatagctgatggcccaggatcattttagtcagttttcaaaaatgcctattaaagagtatactgtgaaaactgttggatacattttctaaaactagtacatgttctagtaaaatccaaattacaggtgaacagacatgacaaaagatgtcaagagcattttacaagattatttggggcagggagggacacccaagtttaaacgggtatggattagattaaaatatcacagggtctataaaaaccagttcctgtgaatacaaacttattaacattaaaaatcccagcattgttagtacacttaaaacactaatcctcaggtaaacaaaaatagttcacataggctgccaaaaaaacaaaaaaaacaaaaaaaccaaaaaccaaataaacacaagacagtaaacaagagatgaaggcgatcaagaggaaattgtagggagtgaagcttggaatggcagagtccatataattatttcagaaaaacacagagaccttttaaactgtgaaaaacaaattcattatcataacaattcttagagagaagaacaaaggaaatgctatcattacatttagacctttcacaggaaaactagtcaaggttacaaaaggatcttatagtcttatctgcttcctgtctgtgctttgtaaaatccgctaccaccactacccccaacccagctcgtgaactctgataatggcctaatattggcctttgacaaagtccaaacaaaatgacaggtgataagagaatgcctttatatagaattatcaccaccatgtgctttggaaacaacaactctgcacactgcactgcatctttctttctgctttgcttccttatcttttccccattctttcccagaaaaaagtgaatttagaacatgcaagcaaaagataatgaagctgaaaatactagagtaaaataaaataataaaatttgatcttcaaatgaccaattattatgtattccggcacacttcatcagtacacagaaaaatctacaatatggttaccacttcctcatagctagtgcattctttcatttattcaataaacattgatgccttttgtacctgaggcattatgccagatatagagtacacaagaataataagacatgtaagttttaggaaaaacttcttataaacaaacaggggaaaaaagcataggatagaatttctgtaacgtccctgaagatattccagaatcaatacacatcagccctggactgcctacctgtatgtagactttttgttatgtgagaaggataaaatctgtattttgcttaaatacatatttttaaggttttaaaaatatattagttatgcacataaaggacataaataattttacaagttaaaaaaatctttttattataaaacacagatatagaaaaccacacaaatcaaatgtatggcttaataaattatcttaaaaataccacccacatcaagaaagagaactttcccagcaaaagtaaaagcccctggaagccccttttatgtacccacccccccatcataatctcctctctactgccaagagtaaccatgcttttatttaatatttatccactttcctgatttttttctataggcagtttttatcacccaaaagtacatccgtagacactatagtttagtctcactctattaaaaagttggatgtcttttaaatctctttcaatctcgaggttgaggaacctctagattgttaaagaacctgggacatttgactaagagagtttccaacagcctgcattttggtaattacattctcttggtgcagtttaatgtgttcctctattttctacattttctgtgatcagactcaggtttaatccctttggcaaaacaataagtagtgtttggtaaggttataacggcacataatacttgcttgtttttctttctgtggtaacagctgttgatacttagatcttggttcattgaggattgcaaaatgatactctatttccatcatttctttcatctttattaattagaagactttctaaaaaagataattgccctcaactactattggttatcatttttttctttattgataaattttcaagataaattgttctttatcatattctgaggtaggtgacaatccctttttaatattatgaattcatggatcttaaaatatttgctgggtttcaaccaactgcaattattgtaatttttgaagctcaaattctatcatcttagatcagttgtgagcctcttcaagatggctcctgagttcttttaacaagcctctaacagtaacattttttcttaattctcataccataaattccccattttaaagtatacaattcagtggtttttagtgtagtcacgaggttgtacaagcatcattagtatccaattgcagaagaatttcattcctcaaaagaaaccccacacccactggcagttatttctcacggccctatccctcgagccccttataatcactaatctgttttgcccctatgtgtttgcctattttggacattccacataaacacaatcatataatatacggtttttgtgcctggtttcttttacttagcatgtttccaagattcacccaggttgtagcacgtatcaatacttcattccattttacggctgaataattttccattgtgcggatatatcaaaatttgtttatccattcatcagctgaatgacatttggattgcttccactttctgactcttataaataatgctgctatgaacattcacatacaagttttggtgtgaatatatgtttttctttttttttaagaatctgatacattttgacttatgtacatacttataaaaccatcaccacaatcaagactgtatacacaaatatcatccagaaagtttcctcatgtccctttgtaatctcgctcttcctatccatgaaacaaccagtgacctgtttccatcaccatagattagaccacattttttagaactttagagaaaccgaatcatgccgtatataatttttctgacatttttcattcaaaataattattttcaggttaatctatgttgcgtgtatcagccattcatttttcatttagcttagtagtattacattgtatgaacataccacagatgctttatccatttccataatcaattatcctttaccactggtggacactgagtttgtctccagtttttcactaccataaataaaatggctatgaacattcatatacaaatatttttatgaacatttttaaacttaaaatagtcaaactgtgttccaagatagtggtaccatttcatattcctattagccatgaataagaggtctaattcattcacatttttaccagtactcagggaagcactctgaagtctcaacacaaaatgctcctcccacttctcgccaaggttgataagcctcaagttgtgtgccttcttccaatcacaccaagctgtgcaggtcacagcaagcatctccccaaaccccttctttgttctcagccccccagacatccaaactatgtcagctcctgcttgtgcttccaaagaggcaacacagaaacaagtcccttaggcagcttcctcaacagccagaatttgggatgcaagctccactcttccctcctccctgtacccccaagcctgagagagttgaggaaggggctgatacaggtaacataaaattgctctatttacacatttcaatgctgctattctctgctttgtgcaagtctgaggtactgtaatttcttgactagaatctggaattgtcatgcagggatttttgtcagtaaatctttgttaaatcagtgtttctgtcacggagggagggctggaatttcctattcctctatctgattaatgtcactcccaaattctcagtcttgactatttatttccttcactatttcaaatatagttattttaataactgcatctgataactctatttgctagagcccctgtggttctttcatattgtctatggtttcttttgcatttctttcatatagttttggtcctcacgtttctggttatttttgattgagtacagggcaggtatataaaaattcatagacaaattggaggtctagaatgtagttatcttgtttcagagaggatatacttttacttctatgagatggatagacagtagcatcaagaattaccttaatccaactcaagaaactgaaatgatttcaagctgtattgtaattcccgagggagccagtctacttctgatttacccactcccaggctgtggccttttatggtctcaactcaaattatgagagctttatataaaaaaaaaatccaccttggtaaaacttaaattccaattttccctcttccccataagatatcgatagtactgatcagcttctcagccatttcttccaaaatcaacaagggcccttaggaaaaaatggtcccaaatgtctggctcacttcattttctcctggatcatggcttggcaattatttactggctctgatgccttcaagcagatgttatttttattttatttgtttattttgggacagggtttcactctgtcgcccaggctggagtgaagtggcatgatcttggctcactgcaacctcctcctcccgggttcaagcgattctcatgcctcagcctcctgagtagctggcactacaggcacctgccaccatgctccgctactgttttctatttttagtagagatggggtgtcagcgtgttggccaggctggtctcgaacacctgccctaaagtgatccacctgccttggcctcctaaagtgctgggattacaggcatgagccactgtgcctggtctagcggatgttctttatatttgtgtatcttttcaagttgtcattgttaagaggattattctgaattacacaggccaccattactggaagagagctttgggttttagaaatttatactttatctacagtagttttttttttttttccagtgggaatgctaattgtattgggggtaaaaatgcttctggcacctaaacatcacacaaactgcaggatgtttaatatccctggtccttgacgctaaatgctggttacaacctcctcctctcctcccccctcacaactcatggtaaaactaagaccacagaggtttataaggtactcattaagttcacatttggaaatgtgaaataatttcatttgtgtcatatccttctataccttttcatagtaaacctctgctctgattgaccctttagaggtatacaaccttttttaaagtaaaaaaggtcaggtgaatggttcttggctaaaatcaattaagtcaatggttagtagggaccacagacaagctgcaggtagtccatgaatctactaaatttacttccaggctgcatgcagtggctcatgcctataatcccagctctttgggaggccaaagcaggaggactgcttgagcccaggagtctgagaacagcctgggcaacatggcgagaccctgtctctataaaacaaaaaaattaaaaaaattaactgggtatgattgcatgtgcctatcatcccagctactcaagaggctaaggagggaagactgcttgagcccagggtgttgggggctgtagtaagctgtgttcatgccactgcattccagccttggtgatgactaagatcctgtctccaaaaaaattttttttgttaatttccaaaagtttatggagggagaatgtaatcaacaagatgttctttggagacatgccaccaggaagggattatgtacgtcatattagatagatatgcattaaatatctatttaatatgaaattaaagaaaatagctttaaatattttaaggcttaactatgctcagtgagtaaaaacttgcactagaagagaagggagatgtaattttttaattgacaaaaactatatatttacagtgtacaacacgatgttttgaaatatgtacacattgcagataggctaaattgaactaattaatacatgcattacttcacatactttttttttgtggtaagaacacttaaaatccattctcttaatgatgttcaagtatacaatacattgttattaactgtagtcaccatgttgcatagtagatatcttgaacttatttctcctaattgaaattttgtatcttttgaccaaagggagatattattttagagttggcatgagaagaggcaaatgtagctggaaagaattactttgaaattgatatcaccactcattttaattcagatattagaagactctatttatatttatactaatctcctctaaggctttctaactttcactgattgaagttaaagcagaagtatatggatagggacactgatgaaaagggtggtaagatacagagcaaaactacaagcaaaattcaacaagagacaggagggaagcaagagggtagaatttctgtgcaagaaattaagaattccatgaagaggcagggtatggaccttagggaagggaagatttcagcataactaggaaaagacaaacacagatggagagcaatgagagtgggacactcataggcaggatatataaaggacaagtcagaggtaacgtaaatgggaatctttgggcagccctggtttgaaatatcctcatttttaagttatatatttcttaaataatgtaaaagctgtccaaggtacagtggacactttctagaatcctcccaatctttcatcctaaccattgccgaaaaattggagataaagtcctcagatagatggtgggatgagaagaatgagactcagagtcccatctgacaaggcttccacaaaagcagttcatctatggaaatgcaaaatatatcatctattcatcttttagcataaagaaaatatgtccactttccttctatgttagagtacagtggcaccatcatagctcattgcagtcttgaatttttgggctcaagtgatacatctacctcagcctccctagtagctgagatttcaggtgtgcaccaacatgcccagctaatgttttaaaattttttctgtagatatggggtctcactatgttgtccaggttgatctcaaattcctgggctcaaacaatcctcctgcctcggcctcccaaagtactgtgattacaggcatgagctaccacacccgtcccatccactttctaaaagtctaactgacctaaggaaaaaaggggcctgagttaaaatttttaaaaagaatgaacagtaggtaagatcaggacccacaaaattatatatctcctatatataaaatatttaatggtttaaaaaacattttcttgattcatgtgaggtgatgtcgacttaaaataaatcctttaatcataggcttctacaagatgacattgaaaatgggagaaaagacatacccaattgctggaacaggagagccacactagtgcccgtgataggaagactatcatgtaaaggagtctggatcaactgtctatctcctgcacccaaagaaaacagcttctgcagaatgggagaaacacaaacacacacacacacgatttcagccattttttaaaaaataaaaataccttcgatgttcatttttagagcaaacgaccatgtaagatccaattaacagatacaaaaggcaacaatgtatatcccaaaacatttaagttctttgtatacttaagtggcataagaaaattcagtggctgaaagttgaaaatctagtagagataagacacaaaaatcattgataatcataactggctaaaaaataatgaaatgttaaagtcaacaactttaataaaggctcataaagcaattcaagtttagacccatctgtgaccaaactcacatttaatattctgccctttgagcagaggtagaagaatgaaggaggagagagcaagagagacagagaaaaaaggaggataaaaatttaagacaaaagacaatgagaaagatagaagagaagtaaaaaggcgaagggcaagaaaaagaaatgccaatcccactataagcaggatctttgtcagactgaagacaatgtgatttttagaaggctgtcctctttcccaatattatataagaataagcaaaataaattatcacctattcatttttaaggtttaaggaaaaaatctatccttttaaaagtatggttgaccaagaaacaataaataaatcatagcagcagagattcttatttttctactttagagacaaatatgaaaatctcaagacatacagaataaatgaatctattaataagtagttacaatgtaacaaagaactgtgttgagagttttcttaatgtcatcttctaatttttatcactccaacatgtttcaatttaggttaataaaaatgagatgtaactatatacaggagtgagaaaggtaaaagagaacatttaaaagttcaacttaatatatttccaagaaaatacaaactgcagttcaagttacacaaaatatgacttctaattatgctatgtgaaagatgaaccctgtgttaaaattaacctcatgacctaagaaaagaatggaatcttgagtgtctagaaagcagaccatggggacaatgcttaactaaagtaggatcttccttaaaacaaaaatatttaaagaattatttctttccctttctccataaattaaattaactggaggagaggggaagaggaacaatccttctccacctctctttctattctatttacctgagaccctccagccgctgggacaaggcaggcacaaaggtttgcaattagactttccaaggagacattcaggctgtccacatacacggtatagatcaaacccaggcaagcctgcaaaaagataaatacatgtaattatttcatggaaaaagcattaaaaataaattgttatgacatctgctctaggacgatttctctttgaacccagtaaagtatattatacagtgaacatggaatacattttaaacagcaaaaattaagtttattaaattttccttagaaccagaacccccaaatgagcttctgagatgagtttatagaaagcagaaatccataatttgtaaaacagatgtttgtgctctgataactactctagcaaatctgtagggctaatactgtttttgcctcaacttaagtctgttaaactctaaatctcaagacaaaaacttagaaattttatcttgtttggtggttcttataaatccggaatgcttattctacagaaaaatttaacatgtgaattgtaagaaaggattgcaaaacagagacaagattgtaagattaacactgagttcagaaggaggtaggtggtaaaacagacataatgcaatctttatgaatctttcagtatagcaaaatttgtgactctgaaaacttagtatttgcttggagttacgcattgtcattgaaatcttgacactaatttaattcttttataacacaaataatctcaatttctagaaaagttttacagaaattgtatcttagcacaaatatttacaaatgaataaaaatttcctcttatgtttgaaaattctgtgtttctaaaacaagaaaatacctggaagcaatattttaagactattttgacagaagtatgatcagaattgtttgaaatctcaaacacccaccctatttacttgaacctgattcctcacaaggtgaatatacatacacgaatttgttaaatcactcatgcatttacatttactacaggtaatcaaattatttctttaggatgtatacattctggattcaataaatgtgggacctattttaaaacaaacactacatccttagaagttttagtagtcacattaacttattcaggtatttatttcacccaacatgaaaatatttcttctgttcatgctaactgtatttcatagatgaattcctaaatcaatctaacaatattttcaatccaaagaacttgtaccatggttcattcaagagactcacacaataatacaaattaataatgataactatgtgttctttaccctaaaaatttctggataatataatctggataccaacaccaggcttttgggagcaaacacttctgcaggctgaattaaaccagacacttttgcttcaccttcaatctcttccttctttgttccctagaaaaagagacactgaaatcaacaaacagaagggatttcctaggttcataattcacaaaagatgaatatcaccttaaatataacttatgcaaattcaaaattaattataatataattttaaaaatcaaactacaaataaagaatagactttaagagcattctaaaagtaaagtagacaaattatgaagccgggaatacttatttcatttttgaaaagctccttaagctccagacatataacacaactttatttgagcatttcctttctgagtgaatcaagggcaaataagacatgctcaaattattttaaatagtgacccaattaaaaattatactcacttagatgaaaagttaaaaaatgatatttaaatgaagtcagttttcaaaagaagatgttttgcaaatatgacactaattttcatgttggtttttctacttgtctcaatgtctcaaacaaggattctaaggcttgcagaatgcttggtgctcaatgctcttggcagtaaagcacaatcggctctaaattgcttttgttcataagcaacaatgctgatattttgagaaaagagaactctgtttccgtttttgaaacaaggtcttgctctgttgcccaggctggagggcagtggcacaatcacagtgcactgcagcctcaactttctgggcgttagggatcctcccacctcagcctcccaagtggttggaatcataggcacactccaccacgccaggttaattttttgttttttgtagaggcagggtctccctatgttgcccagctggtttcaaactactgagctcaagtgatgctcctgccttatgcttccaaagtgctggattataggtgtgagccatcatgcttggctgagagaacatttttacatacaaaactgaatttcagaaagtacttaatgccactgaactgaatacttaaaaatggctaaatggcaaatcttatacatatatattttaccacaataaaaaacgcttaaaacaatacataagtttcaataactaaacactggttaataaacttgacaaaatatgattctcccgcttaacaaacccaaaatcgtgattcccctctttttaataacctatatcccactgtcaacaaaccctgatttcttacctcctctattgctaccataacgctgtgagctactataatctcttgtgtggattactctaacagcctcccttcatctcctttattcttctttagccccactttgcttccttgctgctctttaaacacactgggcatgctcccatccactgctctatgcgcttctgtgttattcctttgcctaaatactctttccacagatattctaatgacttagttcctcatcacttttaagttttcattcaagcatcttctgctctaataagcttttgctgacaatgttatttaaaactgcaatgccctaacactctctacccactttctctgctttatttttctccatggcatttgttactatccaacatatttatctatttcacttatcttgttttttagtttgtctgtcaactgcactagcacatgctcccataaaggccaggatttctgttttgttcaacggtgatttcccagttcctaaaataagggctaggcccatagctgatacttaatatttattcattgcatacatgcatgaatacattttcttggcatagttttttgagcattttatcaagggaagtcttttcccccctattcatagaggccaataattatattttctacttcctttagagctcatttagtttctagtacaatgcaatataaccaagtattagatgtctgtggaatgtgcacatccaaagggaactatctgtttagtttttgtatgtatgatagagtccatatgctcttgaaagattttcatttattacaaagcaaaaacaaaaattaggttggttggtttctggaatccttagaaataataaaaatgtgatgaatatgaattcaccaaagatttccacacttaatgaatcatattcttcatggattactaactaattcaaaatgacaaaagaatgactaaaattcttggaagagataaagctatccacattttatgagattgtgataaatgccctagagtaccattagaagccagctagagtaagtagataaccatttcaaatatatgaccatttactaactttgaccaaaacacaaaatagaatgcattggtcatttcttaaagctgctcttcaattaaacactcaccaaaaggaatagttattaacgagaaagaaaaaggtccaatagagtgaaaatcagtattaagtaaaaaataattttaatttatatcactttttattacgatgttgacttttcctttgtaaatgtgctacaaatcctaaaatattcttagttcttaatttcaatatctctcctataagaatgcaatgtcctaagtttagagaaaaaattcttatttctgcttttaaagcaaaatgtactgctgtgattaaacacacacacacacacacacacacacaacaaataaaccccaaatttattaggtaaaataaagtttgttctagaatggtaatgtgacatttttgataaaatttttctagaaataatttatcatgtcagaggaatactccctcttctatatagctgctagatgtattctatgtaataattataaaatgacactagttttatttggtgtgtgttttacaatgacagattttcacccattggaaagatgtgaaaaacttaaaaataagcaggaaattcaaaacatagtctatgaatatgagatattctaataatgctaaatttaatattttatactacaaaagtttcacatattttatccagctgaacaatattttaaaggctttgccaacttaagattatttcttctcattaaattggccacttaaagattattccttgcttttagtaggtctcattaaagatacaaatttatcttaaacactgtttactaaatatctcacattgacttacaaggtcaatacatataataatcacatgccacaacttgcccatttgtagatatctttgcctaccaattactactatggattacatctgctagtgattcccagcttctgtgtaacttatgtgtagttcatcatctctgtgcttcaataatatgggataaattagtactcaccatatcaatctggcctaaaagtgctactgctcttaaaacatatcctgagacaaaaagtactagattgctgattgcacgcaataacttgatgtagcagatcagcacaagctttaaggaagtttatcctaccattcaggttgaacacttcagcctcatctttgttgtatcttgatgcttaattttaatatcaaaataactgtcaagtcctgacccttttatccttaaagaactgttgcatccaacatcttctctgtgctatgttcatttttaacaatactgtatcacactaaaaatcttcccgcagcatttcttaaataatcagttataaaaggaggataaaattaattccacaagtaaaaaattttcagtcctaaatttcctttctgaaatgtaatatatagcaagtataccattatatagaattgtctcagtaaagcaatttaagaacttaaaaattttccagaattggaaataatggagcctaagtagttgcaaaattctgtaagttctaaaattcctcctgaacccttcatttcttgccaaataatcttttaatcaagttgacatgtctacatgatcaaaccaggtttgccctttcattggtctgggaaataatgaatgcataagaaatacacattttaggataacaagccttcaaacaaactaggcctctagtcttcagttcagaatctccgctcgctgcaagctccacctcctgggttcatgccattctcctgcctcagcctcctgagaggctgggactagaggcacccgccaccacgcctggctaattttttctttttttttgtatttttagtagagatggggtttcaccgtgttagccaggatagtctcgatctcctgacctcgtgatctgcccacctcggcctcccaaagtgctgggattacaggtatgagccaccacgcccagcctaaagtcttaaacgtaagacctaaaaccataaaaaccctagaagaaaacctagccaataccattcaagacataagcatgggcaaagacttcacgtctaaaacaccaaaagcaatggcaacaaaagccaaaattgacaaatgggatctaattaaactaaagagcttctgcacagcaaaagaaactatcagcagagtgaacaggcaacctacagaatgggagaaaaattttgcaatctacccatctgacaaagggctaatatccagaatctacaaaggacttaaacaaatttaaaagaaaaaaacaaacaaccccatcaacaagtgggcacaggatatgaacagacacttctcaaaagaagacatttatgcagccaaaagacatgaaaaaaatgctcatcatcactggtcatcagagaaatgcaaatcaaaatcacaatgagataccatctcacaccagttagaatggtgatcattaaaaagtcaggaaacaacagatgctggagaggatgtggagaaacaggaatgcttttacactgttgggagtgaaaactagttcaaccattgtggtagacagtgtggcgattccttgaggatctagaactagaaatgccatttcacccagccaccacattactgggtgtatacccaaaggattataaatcattctactataaagacacatgcacacgtatgcttattgtgacactattcacaataggaaagacttagaatgaacccatatgtccaccaataatagatcggattaagcaaatgtggcacatatacaccatggaatactatgcagccataaaaaaggatgagttcatgtcctttgtagggacatggatgaagctggaaaccataattctcggcaaactaacacaagaacagaaaaccaaacaccgcatgttctcactcataagtgggagttgaacaatgagaacacatggacacagggcggggaacatcacacactggggcctgtcagtgggtagtggggttaggggagcgatagcattaggagaaatatttaatgtagatgacaggttgatgggtgcagcaaaccaccatggcacatgtatacctatgtaacaaaactgcatgttctgcacatgtaccccagaacttaaagtatacttaaaaaaaataaaagtatactttattcagaagatgacttgcaatagtattctgcgggacataatttaaagtatatctgctatgaacaatattaaaatatatctttaaaatcagatatagttaacatgacagaataagaaaaataatacagtagtggaagatatttaaaatctatgctacctacttcattttataaatcagtaatcacatgcccagagggatgaaatgacttgccaaggtcatacagatcattaaaggcataagtgggattaacaagccaagtcttctcttaagctacttctctttccagtatcctatactcttatatgtaacctttataagaaataacatattagttaaaataagctgtttaggaaagataacatctgagacgccaaactgtcaatttgaaaagatgttcaggtttgttttcctttaattatatttgaatgtagtaatttttgttttaaaatgaaatagtaacaatacacagttctcactgcagcccttcctagcctgaaatagttgtcaaaatttaagaaaaggtatttgatgttgaaggattctggaaacttaatcccaaaagtttctcctgttgttttaaagtcttatatcattttaagcatgttgcaccaattaatcatagttaatccagtgacagtttttccctacaaaatacatctgtgagggacatcaaggggactgttaagattcagcattctgtccatttgccaattctcattttcaaaaggggaggagaagacagattctttggtaaaagacataatcttcagcatcgatactctaaggagaatcccatgtggatacttgcaaagttgtaaattatcaaactatagaataaactcagaatacacaagtctcccaattttttctctgtgtgaattatgttacgcatgctagttttcaccagactctaacaaagtctagtcttgttgaataagacctaagaattagtctctagaatgctaccaagtgtaaagttgattacaatatcagcaagcccaattcccaaatactgctatttcgaatttttagttcaaagagttggattacctgggactaaacccttcttgaaggaactaaggtttttccaatgagatattcatcacagttattcataatattgacaaaacaggaaatacatgtccatcaggggattaattaaacctacctatatggtcaactagtgtacagcaacttttgttaaaaaaaaaaaatccttattattggaagaaaatatgtcaaaccatctttttctgttctctcaaattttttcctgcatgttctctctatgtcttctacaatgagcatagtttactatgataaagagcgggatggtgggggtgggggagtaccaaaaatgattgggttgtagtacttcagctaaatctatacactgttttgtgtgtggttttctccactgttttataccatctagagacgaatttataaattcctttttattactccattttccaggtaattacttaactgcttggaattaattatatgatactatgtttaaatttttttcttttctcaaatagctcatcaactgtttaaataatatttgttgaaatacacacattccattgatttataaagcttctattgttggacactgatctcctatacacaatagggtctgcttctggagtattggttttgttcccataattgtttttacccttgacacttaattcttgaacctatagcacactgatacaatttttgcagctttgtagtatatgtggttattatttggtccttggagacagaatcaatcaagcactttaacttggtactgaatgtccctaagtaagcctcatctgtaaaatggaaatgttaaaacctatcaaatggtgttttgtgagaataaactatatgtgagttaaataaaatagaatgaaataaagtgttgtaaaacttttagcacagtacccagaacataagactttaatttatcataagcactacaatcttttttcctttgcacaagctttttgtttgaattgtcctttttctttcccttactctaggtgttagctcttattaaaatgtccactgagtcttttaaactctgtatgatttattccagttgcctagtctgcaattattatctgtttcactgaatgatacttagcatatgatactttggaatggttttgtacttaagttttggttctgcttcccaagctagatttgaagcccactgtgatggagaaacgtatcttatgtcttctatgtctctccctcttttttcctcctcttatctctcgaaattacaaaattcattccctctctctttctttgatgacaatttgatgacacaccaaatgttctcactgagaactgcataattaccactgattcagagacaagtatataaacatatgaaataactttaaaaagatatagaactaaatttaaattttagatatttaaaattttatacttttaacatattttaagataatcaaatgattatttagataagtaataaaagtcaatgtaaatctatcatattttgctgattacttaaaaaaatttaggatcacattacctagttgagtaattttgggaacatattatcaaaagtttaatgccaagttttgcttatgattactgacagtgttactgtatcttggaaagataacagagctaacatttttaaagttgcacaatcacattctggatggtgtatgtccctaagttccccctctttaggcttccaaataatgtgtcatagtatatttggtatgaagtaattcacaccaaaaaagaattaaaagatctattttgaactgatgatatgatccaaaaagaaaagaaaaacacatttttaaagggacataaacagttcatgccaaaaatgaaaacaactttactgatgacaagaaagaaacatcttctgggttctatttttttttcaaattctgcttcattgtttatccctcttttccaccaagcccaaaagacattaacttatgtttccagaaaagtggtcttacaattctggctagtacctaagtacaattatatagaatccggaattctcacaacctatccgcattttcaaaatcttggaaaaactgatatgaagcagactgtaaccttttgtaaggtgatcgtaacaaataaattatgatttctgggcccacttaaaatggcaagtaggaaaatatctaagctaaaaagagaaataacttcttgacatatggattcaaactatacaagaacccagatcttagcttctaatattattccctattcaaaggagtcagactccttgaagaaatggctgatttcaaggcagaggcagggaaggaataaaatgatcctagatcaacttgttatgatgaaaagttaaaaagtactttttctaaaaggagatctgtgaaaagaacacaggaatctgtctgagtggtgcacgctggtcaaatatgggataatttgtgcattaaaataataaaaaccattaatgatttacatattattgacaaaaaaaaaacctgaatccatgtatctgtagctcaaacagacaggaagagagagttcctgcttatagtaaaaggtcgactgctgactgctaaaaatagagggagtatggagttagaaaataatcattttttgttatcagaatcaaaattgctataggcaagaatcattagtaaatgctgaaatctaggggaacatgattgatgaacagtaggatatttgcatagtgttagagtgtcttctagtagactgattattaattgcaaacataaaaatcgccactatgaagtggagaaatctgacaatcatctgaccaagttaccaaaattaacatcatcagtgagggacagacaggcattgtggacttccggatgtgtactcttagaaggatgcccttagaaggaacacaggtaatattccaactgttgacacagcctgaaactaacaatgagagatactggaaaacagaaaataagaaacattgtattaaaaatggggggtgagaagttacattatttaaaaatgtcaacattatagacaaaggcagcacaagtattccagatgaaaagagacgaaagagaaataaaaactaaatgcaatatatgtagtatgtactagatcctgtactggaagaaaaaagggatgggggggtgctataaaggacactattagatcaaatgacaaaactggaatatggatagtaggttttattatattgatgttaaatttcctgaggttgataactgtactgtttacgtactgttcatgtacctctgaagcatatactaaagaatttaggtgtgtgtgtgtatgggggagatggggagaggagagaggggaagagggaagaagggataaagagaggaaagaagggtagggaagaaagacctcaaataaaacgatggggcaaaatattaacaacaggtgaatatgggtaaaggctatatacatgtttgcattattcttgcaacttttctgtaagtttaaaattatttccaaattaaaagtttgaaaaatacccaagaattcctagaacctatttataaacatctgccattaatataatgtcaatatattgcctttctgtcagtttgtctagaagaagaggggtgaatagtgaagagggagaatctaaataattatagttagtttcattagataattccaaagagttgtgaagcgataccctcaagaatatggaaataacagaatatactgaattctcagcattaacttaaatgctaaagatcaacagagaaacgaaaggccaataaaagagacagagtggttcttgggctagagaacactctctaacttattcagattgaactgataaaaatgagaatttgattagctatttgttggcaacatatatccaaacattatccaggggagaggagacttaaagtcacagactgaaagttttctgtccccattgataacatacagtaatctctaacttcaaatagaagcaacaggctatgttagtctgatagtctttaagtatttaacatcaaatatcggtttgattccataatcaaaactccggactttgatatggctttctactaagatctggtgacaggaagacaatgtgctgataatgcatgttttgttctatatgcattttcagcacttttcacatttcctataaattagtagtctagcatgttagttttaacacatcagtctaatgaacttgaataatgagtctgcatcatgaaaggtaatttgtctcttcttgtactcaaaaatcagatttctgcatccagaaaattcagatcttagagtttaataaacataatcaaaactaccaaatactcctttgttaagccatttcagaaagcaggccaatcttttcccccaagtgatgatactctatacgtagcagaaactacagtagattatgcaaactggcttactcaatatcttcgaagtcccctttatggtttccttcttgtattatagagcctggaaagaaaaaccaccaccaccagcaccaacaaaaaaaaccctacactttttggggcaaaatgggctctgtatacaatcttaacttccaccaaagaaacaactcatgtaaaacttaaaagcagaagtcagcagtatgagactaaagcagaagtcagcagtgtgaatatctgcaggagaatggatattctagcacaactatggtgaaggttataatgtctgatatatacccagcattgtaagtgccaagtggtaaaaggtggaaggaatatggtttctatgagaatagcaccaagctgggctgttcctagtacccagaattggttccctgcttgtccctcacccctaaaatttcacaagttgccaaatactttgttatgactcctttctgcttagagaaagtagagccagtaatgtgaaactaagaacctcaaccaatagtctgaaagagcaattattttatatgtcttcatagttctagcttatgaatttctgcctgatcatgttgataataccacccctaagaagaatgagttaacatttgggtgcttaaacaataatgtcaagcattgtaataatgatttgcaaacattgtgagtaaatgttccacattctatgaaagacctcccaggagaagggctggcagggaaaatcacaggttcaccaagagaagaaattaatattcttaataaaccaattcaaggatgcactatttttagaaatattcagattatgatcaatgttttgaaaaaggacaattaaatctggaaagtaattttaacatgttgctctcctctccaaccttaaacataaaaatttcttcatgcttcttatgctagcccataaaactcaaacttgcagttgtaacaaaaatatggcatataaaaaacattcctaaatgttgtaccttcgactgtactttagctagtaaaggtttttgtacctgaagattgatctctgcctcatagaaggttaggcatgagcagtaatgtcgatctgagtcaatgtctgtcaggacaaccacaaagaacgttggctgcttcctctctctggacagctgccacccgccaggctgacaaaactaaatgaaatagaaaaaaaaatgtaacatttaaaaacaataaaagttaattattaatctctgagaaattttaaatgtttgcccattttaacaaattcctacctgatgtggtatgagtctaaagccaacatttaaaaaaaagttaatgtacagattcataatggtgaaaactttcaccaatgtgcatatatatttcatgaagatagcctcgatttcccacagttgccactctgggtgccatttctgagacccaggtaggcctatgtaggaataccgcatcaaaattaaagacatcccccaactatgagaacaaatcatggaatacattagaaatcaagggcaaaatatgtatcattgagggaaaatagaattatttttaaatttccatatgaatctgagagtcttcaattcattacaaaaaaagagatatcttgttcagcaagacagaccacattcttgtccataaaacatacttcaacaaatttaaaaaagaggaatcatagaatgtctgctgttagaccatgacagaattaaactagaaatcaataacaggcagatagctggaaaatccagaaatacttgcaggttaaacaacactttcttttttttttgagatagggtcttgtttcatcacccaggctgcagtgcagtggcatgatcacagctcactttaaccccaaccccctgggctcaggcgattctcccatctcagcctcctgagtagctgggactacaggtgcctaccagtatatctggctaatattttttattttgtagagaaagggtctttccatgttgtccaggctggtctcgaactcctgggctcaagcaattctcctgtgtcagtctcccaaagtgccaggattataggcataagctactgcacccagccaaacaatactttttaaataacatgagtcaaagatgaaatctcaagagaaatttaaaaaatattttgagctaactgaaaatgaaaataaaacatcaaaatttgtgtgatgtgatgaaagcagtgcttatagaaaaatttctatcattgaatgcacatattagaaaagaagaaagatctaaagtcagtaaactaagctttgacctttggaaactagaaaagaagagcaaattacatccagagtaagcaaataaagaaaataaaagttagaattgaaatcaatgatactgaaaacagaaaatcagtagagaaaaatcaataaaataaaaggctgcttctttgaaaagctcaataagcctctagccaggctaattaagaaaaaaaaaaaaaggcacaaattactaacaaatgaaatgaaagacgggatatcagtacagattgttctgggcgggagacccgcaagaggagaagaaaaggcacacacacaatacctttaaaggtaaacaagctttatcccatgtaaatggcaatgtagatataataagcaaattatataataagcaaagtaataaaataagcaaatgatataataagcaaattgcaacgcaaaggggagaagggaaaagagataaatgtctctacactcaccagactatggaggattcaccaccagactgggaagcaacagtctgggctccagagttggacactgcactcaccagactatggaggattcaccatgccagaggtggtgaattcctcttcaaagggtttaattgtgtaatgtccttggttcaaaggccccaccttcttgtactttctcatttttagcctgcaagcagccctcctgctcttgctgtgccctaacttgcccagacatgtccagacacgtcttgtgccatagcagaagaaccacttctacccgctcccttgcgaattgtgcatctaccctatttgttcagtgtgctcttgtgatcgtggctgatgcagggagcacccttctgcagaagtaaattgccttgctgagaacgctttttgcctgagtgctggtttcactttgcagcaccaagcacttgtttctaacaaccactagactgggaagcaacagcctgggctctatagtcagccacttgtctgtgcacagacaaagagaggtctcatgaagcttcagcacagtgtgggaccctagctgtttttgtaacgagttgtttggcaggaggtccagtcatgaaggcccttcgtgactggactcaaggaacacaaaaaggtcaacttgtttttgtgactatctattgcttttctttttttttttttttgagatgagtcctgctctgtcgcccaggctggagtgcagtggcacgatcttggctcactgcaacctccgcctcctgggttcaagtgattctcctgcttcagcctcctgagtagctgggattacaggtgcccgccatcatgcccaggtaattcatgtattttagtagcgatggggttttgcaatgttggccaggctggtcttgaactcctgacttcaagtgatccacccgccttggcctcccaaagtggtgggattacaggcatgagccactgcacccggcctattgcttttcaaaaaccaaggtataggaatagattgaaatagagatttctctgaaacagtgctggacgaacgcctgaaggggctcacacaacctgtgccaggacttggtgaccattgtttgtgtccacgttcaattgagttcaaatttaatatttaacttttcctccacacaaaagttcccatgaacttttaaaggataatcaatgaatattatgcacaagtctatgcccacagctttgacaatgtagagaaatgtaccaatttcttgaaagacacaatctaccaaaactcacacaagaaatggacaatcagcatagtcctatattgttaaagaaactgaatcaataattaataactttccaaaacagaaagcaccaggcccagatggattgactggtggattcttttaaacatttaaggaagaagttacagtcagccctctgtatctgtgggttctacatctgtggattcaaccaaccacggatcaaaaatatttgaaaaaaaaagaaaaataacaatacaactataaaaatagcatatataaaaatccaggatagtagctatttacataacatttacattgtcttaggtataagtaatctagagatgatttacaatatacaggaggatatgcatgggttatatgcacataccacaccatttaacataaaacatttgaacatcctcggattttggtatgtgtgggggattcttggaaccaatcccctgcagattccaaaggacaactgtataccaattatctgcaacctctttcagaaaacagaagcaaagggaataccttcttcattctatgaggccagcactatactaataccaaaaccagataaagacatttacagaaataaaaattattgaccaatattgctcataaacataaaagcaaaaatattagcaagttgaattcaacaatgaataaaaataatatcatgaccaagtggaattcatcccaggcatgcaaggctggttaaccattcaaaaatcaattaaagcattatatcgtatcaacaggctaaagaataataatcatgtgatcataccaatagatgcagaaaatgcatttgacaaaatccaatacctattgatgataaacagcctcagtacactagaagtagagggaaacttcctcaacttgataaagaatatcttttaaaaaaaaaaaactcctatggctagtaccatacttaatgctgaaaaactcaaagctttccaagaatgatcaggggaataaagtaaggatgcccctttcaccactgcttctcaatattatcctacaagtcctagttaacgcaataaaatgaaaaaaataaaaagtatatatattgggaggaaagaaacaaaactgcttttgttcacagatgacatgattgtgtaaacagataatctgaaaggacaaaaaaaaaaaaaaaacccatccctggaactaataagcaattaaaaacaagttctaagatacaaagttaatatacaaaaatcaaccacttttcctttatgtcagaagtaagtggaatttgaggcaaaaatataataccatttacattagcactccactaaaccaaataattaggtataaatctaacaagatacgcaaaagatctatataaggaaaactataacactctgatgaaagaaatcaaagaactaaataaatgaagagagattctatgttcatggataggaagactcaatactgacaaaatgtcagtttgtcccactttgacccaaggattcaacataattccaacaaaaatcccagcaagttattttatggatattaacaaaatgatcctaaagtttataaagagaggcaaaagatccaggatagccaatacaatattggagaaaaacagctggaggactgacactaccaaactttgagacctaccaggaagctatagtagacaagacagtgtgatactggcaaaagaataggcaaagagatcaacaaaacagaatagagagcccgaagtagactacacaaataccttcaactgatcttatatacacatgcaaagtgctcagagaagcccctggcatataatccagtggacgtaaatgttaggtattatgaccattaccccctttgatccaacccatgtttctatccccatctctttgacattttcctcttttgtacagacgttttccaaaactagctcctcctttcactgtctcattgcctaccttgtatgagtctagagatatcagaaaagtaagatcgacatgatttcctacatttggagagggatgttaatcatgttcacagtttctctagagaaaggcttaactgtaccttaattagcaaatcagtaaaaacatttctattacatatttagtttaaaatagcaatttattcaaaatattattgataacttaagaatcatttattctatgaagtcttctttgaaacttcctagcttctctcgccctctccaaaccaaagaatcaggccacgctgttcctctactatactccaaaaccatctttattatgaataacaacaacaataataacctatcctcctctatatttccctagaactttttatctattaatactaatctggtaaagaaaagccgacatcattatctttatgtgtcccttggtatctgtggaggattggttccaggtcccctcactaatatcaaaatctgcagataatcaagtcccacagtcagccctcaggaagctgcagatatgaaaaactggcccttgatatccacatatttttctctcaacaacccatctatactaaattccataaccctatatctcaggcttatttgtgactgcaataagcctttttattctagaatagcagctatcaaaagagtccccaatgtcaaaattattttcataataaacctaagatattggttgtttctttactgtgagtaaaactgcttgtgtcttaataggaatcaaagcagtggcaccaaactatactagtaattgctgtattctttatagctgcacatttgcaataaaaaagtcagttttaattgaaaaggcccttgatgaggcaataaacattttaatttcattataactggcattatatatgccaaacatattttggcagacatgtatttggcagacattttctcaacataaatcaactgggcctgtcacttcaagataaagatctaagacaatttgttatcaatgataaaatatgagctttcaagcacctgagagttttgtaatattttaagacttctatgacaaatattatcatactattagttaatttatattttaagtattatatagtgacatgtgtcaatatttggaagctgtatataactcactaaacccatatttgtcaaatgaccagtgcatgatattataaaatcatgcatgtgaaagatccattcaaagtgcccagtagaccaacagattttaatgtaaccataagaaaagttcacagatgtggttacaaattccacactgtaactaacctttaagaaactactattcattggatattggagcagtatataaagaaaagtatccgtaattatctgaaaaagctactaaatactccttcctcttccaatgacatatttttgagatttgattttcttcatatacttcaaccaaaaaaatcaaatcacaagagcttgaatgcaaaagcaggtatgagaatccagctgcttctatgaagccaaatatcaaagacatttacaaaaatgtaacacagtatcactcttttctgtatttttttgttttggaaaagatggttatttttcataaaaacatggtatttttgttaacatggaatgggattttgttatttaaaagtgggtaaatttaaaaaaaaattttattttagttgtggctgggtgcgatggctcacgcctgtaaccccagcactttgggaggctgaagtgagtggatcacttgaggtcagaagtttgagaccagcctggccaacatggtgaaaccccacttctactgaaaatataaaaattagctgggtgtggtggcacatatctgcaatgtcagctacttgggaggctgagacagaagaatcgcttgaacctgggaggcggatgttgcagtgagcaaagatcgcgctattgcactccagcctgggcaacaagagagagactccatcttaaaaaaaaaaattagttgtaatttctaatatataaatgaattgataaaaccacataaaactcttttagaattctcaataatttgtgacagtataaagggtactgagactaaaagtatgggaactgctattttaatgagaatgggtgttaacatgtaactatccttggcttaaactacttgggtagcagaacggtataatccttggtagaactggaaagttttatcaggctacaataaaagccaaaaatatctttcaaaatccttttactttctctcaacaaacttctttcgtgaataaggtacatcattttctaaaatgagcctcagaatcaggaaggaagtatgtgagcttaggttataacataatgtaacgatacagcctgcatcatcagttctaccaccaccacaaactgcccctctgataaaaagtgaatcagttctgtgaattaacagcaaataatcccattctcatagaagtctgtcattcatatcattagctaatcactaggcttggtaaatggtactaaaaaacatacactagagaatgatgactgcatattttcacatctttaaagaaactacaggttttcaataaggacaaacaaaatcccttcattttagttctaattctaccaaatatatttgacttctcaaattgaagttacctaacagaaataacaatgcaactttttataaccatatacatataggcatataagtcccctcttatccatggaggatatgttcaagatcccacagtggttacctaaaactgtggataataccgaaccctgtatgtactatgtatgtatgtatatggaaccctatatgtactatgttttttcctatacatacataacaatgatgtttagtttataagttatacatagtaagagatgaacaataactaataataaaatataacaattatgatattagactataataaaagttatatgaatggggtctctctcaaaatgtattattgtattatacttgcccttcttatgataatgtgagatgatttaatgcctctgtgatgagatgaaaggtgaatgacataaacattgtgacatagctataggctactattgaccttctgatggtaaatcagataagatggctactaagtgactaatgggtgcatagtgtatacagtgtggataagctggacaaagggatgatgcatatcccaggtgggatggtgtgagatttcatcatactactcagatggtgcataatttaaaaccaatgaattgtttctggaattttccatttaatatttttggacctcagttgaccatgggtaaataaaaccacagaaagcaaaaccatgggtaagggggaaactacagcagatctattaaatgagcagtcagatattttgctgcctgaaactagaaaaaataactattaatgtgcccatttttctcaaatgctttgcacatatagacaatataagagaaatataccagaataacaaaaatgtccatagcactgtgattaaattgaatgatctcttgaaggtgaaatattataggtttcaatatttcccaagaccttcatctgcatccataaatgtttagctattgagccatgttttaatgtataacatttaaattaaatgtgtctctttttaaaaagcctgtaagaaaattccttctcctaatagaaaataataaacatataacatcgagaaaaagaatgtgagagtttagatagtaagaccaccttagttacttaaatagcctcataaatatgttagtttacactataagaataattctgtgattaaaaaagtattacccttaaaacttttgggaaattccaaggatcaattttcaaatccaatagacttcttcaaaactcagcttaatgtgaccacagctcaaatagtatagtaattaatggttggcctggtcagattttttttactaaatttttcacaaagaggttgttaagatagttaactagacactggttacgtatgagatcctctatttcacacgtaaatgacattaaatatattgtgcatttaaaaataccattagaatcatagtttataggaaattttgaattctatattctcaaataaaatacagtaacatagacatagtctatgttacacagtttacaaaaattctttctcaaaggatgaaaagaaatgaccctaacctgcagttaaatgagtctttttcaaattcactgtatcataagattaagcaataatagatttgggagtatcagaatacaaactcacaatttaatgagaagtactcctcatagaatttggatttcaaatataacaatgctagctggtttagtcttttccattcttaactaaaaatgtgttagagaaataaacaatgaggatgtggacattacaattcttgaacctgggtttaagtcacacttctgacaggaatgtgaggaaaatgtttagacagctggagagtagtcactaaaagatagtaagcaggatgataagcattatacaaacaggataaaaatcaggatttttctctccccagtgtctttataggcaaacaggaaaaaaaaaaagctatcacaggtgcaaaacccaaaatgtttagaatcgactgtcataacagactgacctaacactgtgccctccttttttcaagtcactgagaaaacacatatatttgtaatggcaaaacataccacataatctcacaataccgttttgatacctgcatgagtgtatgagcaacgacttgtttttgacaactcccttctaccttgacttcaccatttcacacataccatgcccataaaaatgttaacaacgtatctgggaacaggcaatgtgggaatccttttcaggatgttcttctgtctttgtttatctctagttttctttaagaacttagtataacctataagcaaattatacttcaagtttgcaaggctggaattgttagacattgctaaactctatatgttaatgcattacaaacacccgctttgtttacttgcttgtttgtttaattgcccaaatgtatgaagtagataacttgcaaataggccatccatctgcaaataaaaggtacgtgctaatataataatctctcaggtttgtaagatattttatatataaccatatctcacaagactcattctacaaacaatgaaaccaagactgttagacattaaggtcataaagagtttgtggcactggcaggactagaatccaagtctctgcatttctataaaccgtgttctttcacttctaaattaccttcataaatcaccttatgcatattgttttatgctaatataaatacatggcagaaaaacttaagaaataaaatgaaagtgaaataaattttgtaacatgtaacatttcctagcaaccatttatctctgaaggtatgcatgtatgtatgtatgtgtgtgtgtgtatttatccaaaggagggcatattgtatatatagttatgaatcctgtttttctccccttcctataacatgtattttcccatgtatttatatatttttaacataattatttttaataactgaatattataccatcatgtagatatagataaaatatcataaccaattccctattgttggttaagatgtttataattttttataattaatgctgaaataagcatagtactatataaatatttccagatatgtctttttattttctcagggaaatagaactggttttctagagcatgcacaagttgagcacaaaaatgtttaattatccttgaattcctttttaaaggttaagcaaccccaaaattgttttgtttttcctgatacatttctaaagaggacagaaaagaagtgataacaaagaactgttattataaactatattctgaccaaagaagaactgatttgtgaataaagtaacagaagctttaggagactgaagtctgtgccaagccaggccagggcagtgtcagatgtgtgctctgaacattatatagatattcttcaaaagtttgaaaaaagacccagcctggtggctcatgcctgtaatcccagcaatttgggaggctgaggccagaggaccacttgagcctaggcataagaggctgcaatgagctgagatcgcaccaccacacttcagccttggtgaagagtgagaccttgtctcggaaaaaaaaaaaaaaattaaccaagagtagtggcatgcacctgtagtaccaactactcagaaggctggggtaggaggattgcttgagcctgggaggttgagggtgcagagagctgtgatcatgacactgcacttgagcctgggtgacagagtgagattctgttcttccaccaaaaaaaaaaaaagttcagagaaaatatagtgggcagaagactttggaagagaagtcaatttaagagtttgtgacatctcaaacattttgtttttacagaataatgcatgtcacatataggcccaattttaataagcagcttttgataaagtatatacttaaaagggactatccaaaattatttgcttaaaatggaaacttaactgaaatgggtcacctatattgcttttggtaaaaatttacatccagatattttattactactatacaacatttgcattgtcctcaccacaataaaactttcattacgtgtaagataatatgattgtctgcctagagaatacatacaaactgactaaacactgtttcaactagtaagagtttacttaggtaggcagatatacaaacatacacaaatcaaaagttttctttgacatcagcaataagcaattagaaaaaagatcctatttgtaatcttaatatgttctcaaagacaaaggataagctaacctaacttctaagttttgaatattttggtatatcagtctcatgaacagattaaggctttacatttaaaaatttcatgactaaggccccgaaagtaaatgcaacaaaaacaaaaataaatgaagcagacctaattgaactaaaaaagcttctgcaaaacaaaagaaataatcaacggagtgaacagacaacttatagaatgggaggaaaatattgttaaactatggatctgacaaggactaatatccaaaatctataagaaacttaaatcagcaagaagaaaacaaataatcgtattaaaaagtggacaaatgacatgaacagatatttcttaaaagaagatatacaaacggccaggaaacatgaaaaaatgctcaacatcactaatcattaggaaaatgcaaactaaaaccacaacgagataccaccatgagaatgcccattatttttatttgtttgcatgttttttttttgtttttttgtttgttgtttgttttgagacagtcttgccctgtcacccaagctggagtgcggtggcaagatctcggctcactgcaacctccacctcccaggttcaagcaattatcttgcctcagtctcctggaactataggcgtgcaccaccatgcctggttaattttcgtatttttagtaaagacggggttttaccatgctggccaggctggtctggaactcctgacctcaggtgatccacccacctcagcctccccaagtgctgagattacaggtgtgagccaccaagcccggtcagaatggctattattaaaaagtcaaaaaaacaaaagatgttggcatggatgtggtaaaaagggaacacttatatgctgctgctgggaatgtaaattagaattgcctctagagtaaacagtaaagaaatttctctaagaactaaaagtagatctaccatttgatccagcaatcccactactgggtgtcttaccaaaaggaaaagaattcagtatatgaaaaagacacctgcatgaattatgtttatcacagcacaattcacaattgcaaagataaagaatcaacttaagtgcccaccaacagatgagtaaataaagaaaatgatacacacacacacacacacacacacacacacacacacacacacacacaccatggaatactactaactcataaaaaagaacaaaataatgttttttgcagcaacttggattaaactggagggttattacctaagaaaaacaactcaggaatggaaaaccaaataccacattttttacttttaagtaagagctaagctatgattatgcaagggcatacagtggtataacggacaatagagtcccagaagtggggaaatggggaaggtagatggggtaagaaatgaaaaactacctattgggtacatagtacactatcttggtaatgggtatactaaaatcccagactttaccatgatataatctttccatgtaaccaaaaaccacttataccccactaaagttattgaaataaaaaaatttaaaatgaagtaaatataaaaatttcaagaagaaaattaaagagaaaaataaacacttggaatagttttgaacattcaagttttgaaaaaacaaaacagaaaaaataccctgcaaactaattataagtttaaaataattccaagatgaagaccacagaagaaaagtttttgtaccaatgccatgctgttttggtcactgtagccttgcactatagtttgaagtcaggtaacatgatttttccagctttgctctttttgctgaggtttgccttggctattcaagttcctttttggttccatataaattttaaaataattttttctagtcctgtgaagaatgtcgttggtagtttgttaggaatagcattgaatctgtacattgctttgggcagtgtagccattttaatgatactgattcttcctatatatgagcatgggatgtctttccattcatttgtgtcttctctgatttctttgagcagtgatttgtaattctcattgtagagatctttcaccttcctggttagctgtattcctaggtaattatttttgtgtgtcacagttgtgaatggggttgcctttctgatttggctctcagtttggttgttgttggtgtataggaatcctagtgattttcgtatattgattttgtatcctgcaactttgctgaagatgtttattagctgaagaagcagttctaacaaaaagtggccacactgctgctttacatgagtgggtaatcctgttcctcatcactgagcaggacctcccaaccagggcctccagccaccctcgcctgaggtttccagccaacagagaactgaatttcccctgggatggtgctccagagggaggggctggccaccatctttgctgtttgggtgacttaaccgttctagtctttgggctttggagtgtctgaggcaactgggggctgaaatggaccccagcacagcacaactgctctattaaaatgtggccagactgtttttttaagcagttccaatcccgttcctcctcactgggtgggacctcccaaaaagggtctccagcaacttcctacaggtgcctttgggccagcaacaggtctgtacctccctgggacaaagctcccagagggagaaacacgctcccatctttgctgtttcacagccttcactggtgacacttctaggttctggaaaatctgaggtgactagagactgcagcgggccccaagcatactgtagcagccctatggaaaagtggccagactgttacatgggtgcctgttcccatatctcctcactgtgcaggtcctccaggcctgagcctccagccaccccctgccagaactatcaagccagtaccaactcagcaacaccctggacacagcctctctgccactacctctgcaatgtaactgcccttgtcacccttggactaacaaaggagcaaagaccctaagtaccttatccacacctccaacaagtggcagctgacccaaggagaggaggccagtctttctcccatgggtcccacaaaccccccatatcttgtcatcagacagggaacccctggcttgggcccacagcgcaaactctctatcctgggatgattgcactgagtgattgctgacctgcatctctctggggtggagcctccaggagtcaagcaaatgacccttggccacaaccactactaagatttcttcctctgctgcctctaagctgaggaaggaacataaacacagagattgccccaaagttgcagtgggcagcccaggagtaccaagtcatgaactacagccagtactcaagtgggagaggagcccatactttcaaagcactgagagggaacatggctacaactgtgaggaaacatagggaagccacacaaccaagcaagaatcaaccaactgaccaataagcctaagtgtcacctgctggatcacaccccaaagccttaacaccaaaaatacctcactaacatatccccctctaaaaccagagacaagaagtcagcttcaaataaagaccctacacaaagtcctggcctgatgaaaacatccagaaaagaagtctattgagtgtactcaatctacactgcaattaaagaaacacccacacacagagatgagaaagaacagtgcgagaactctgttaactccaatggtccagagagtctgtcatatgtcctccaaatgactgcaccagttctccaacaagagttcttaactaggccaaactggatggattgacgaatagaattcagaatatggataggaacaaagatcagtaagattcaggaggatggcaaaacccaatccaaggaaaataagaatcacaataaagtgatatgggagccaaaggacaaaatagctagtatgaaaaagaacctaacaggtctgatagagctgaaaaacacaatataagaatttgacaatgcaatcacaagtattaagagtagaataaatcaaactgaggaaagaatctcagaacttgaagactggttctctcaaaaaagatggtcagacaaaaataaggaaaaaagaataaaaaggaatgaacaaaactttcaagaagtatgagattatgtaaacagaaatctatgaatcactggcatctctgaaatggagggggagaaagcaaacaacgtggaacatatatttcaggatgttgtccatgaaaacttccccaaccttgttagagaggccaatcagtcaaattaaggaaatacagagaactcctgcaacattctacacaagaagatcatccccaagacacataatcatcagattttcaaaatgaaagaaagaatgtgaaaggcaactagagagaaagggcaggtcacctacaaagggaactccatcaggctgacagtagaccattcagttgaaatcctacaagccagaagagattgggggcctatattcaacattaataaagaaaaaaaccttcaaccaagaatttcatatccagccaaactaagcttcctatatgatggagaaatacgatccttttcagataagcaaatactgagggacttcattaccatcagacctgccttacaagagatcttgaaaggaacattaaatatagaaaggaaagacttctaccagctaatacaaaaacacacttaaacacacagaccagtgtcactgtaaagcaaccacacaaacatgacaacataataaccagctaacagtacaatgacaggatcaaatccacacataacaatattaacctcaaatataaacaggctaaatgacccacttaaaaggcacaaagtagcaagctggataaagctggataaaaacaagactcaatgatatgttgtcttcaagagacccatctcatgtgtaatgacattcataggctcaaaataaaagcatagagaaagatctaccaagccaataaaaaagcaggggttgcaatactaatttgagatagaaaaagtttcaaaccaacaaagataaaaaaaagacaagaaatagcaatacataatgataaagggttcaattcaacaagaagacctaactatcctaaattaaacaagaaaattaaccaaaatattcaggacctaaactcagcattggaccaaatggatctcatagacctttacagaagtttccacccaaaaacaacagaatatacattcttctcatcaccatatggcacatactctaaaattgaccacataattggacataaaacaatcctcaacaaatgtaaaagaaccgacatcataccaaacacactcttggaccacagtgcaataaaaatagaagtcaacacaatgaaaattgctcaaaaccatacaattatttggaaaataaacaacatgctcctgagtgattttggggtaaataatgaaattgaggcagaaataaagaagttctttaaaattaatgacaacaataatacaacataccagaatctctgggacacagctaaagcagtgttaagagaagaatacatagcactaaatgtccacatcaaaaagttaggaatatctcaaattaacaacctaacttcacaaagcaaaagaattagagaagcaagaacaaatcaaccccaaagctagcagaagacgagaaataacaaaaatcagagctaaactgaaggacactgagacacaaaaagtcattcagaggatcaataatccaggaattggctttttgaaaacaattaataaaacaggccaatagctagactaattacgaagaaaagagagaaaacccaaataaacagaattagaaatggcaaaggggatgttactactgaacccacagaaacaaaaataaccatcagaaactactatgaacacccctccgcacacaaaaactagaaaaccttgaagagattaataaattcctggacacatataccctcccaagactaagccaggaagaaactgaatctctgaacagactactaacaagctccgaaactgaatcagtaataaatagcctaccaaccaaagaaaagcccaggaactgacggattcacagctgaattctaccaggtgtacaaagaagagctagtaatattcctatagaaactattcccaaaaattgaggaggaaggacttcttcttaactcattctaggaggccagcatcatcctgatacctaaacttggcagagacacaacagagaaagaaaacctcaggccaatacccttgatgaacatcaatgcaaaaatcctcaacaaaatacttgcaaactgagtccagcagcacatcaaaaagctaacccaccatgaccaagtaggcttcatccctgggatgcaaagttggttcaacatataaaaatctgtaaacgtggccaggtgcggtggctcatgcctgtaatcccagcactttgggaggccgaggcaggaggatcacgaggttaggcgatcgagaccatcctggctaacacggttaaaccctgtctctactaaaaatacaaaaaattagccaggcgtggtagtgggcacctgtagtcccagctactccggaggctgaggcaggagaatagtgtgaacctggaaggtggagcttgcagtaggctgagatcgtgccactacattccagcctgagcaacagagcgagactccatctcaaaaaaaaataaataaataaacaaataaatctgtaaatgtgattcataatataaacagaactaaagacaaaaaccacataattatatcactagatgcagaaagggcctttgataaaattaaatatcccttcacgttaagaactcttaacaaactacatattgaaggaacatacctcaaaataataagagccatctatgacaaactcacagcccacattatacagaatggtcaaaatctggaagcactccccttgaaaactggcacaagacaaggatgccctctctcaccacttaatattggaattcccagccagagcaatcaggcaagagaaagaaataaaggacatccaaataggaagagaggaagtcaaactatatctgtttgcagatgacatgattctatatctagaaaaccccaggctcagcccaaaagctccttcagctgataaacaacttcagcaaagttgcaggatacaaaatcaatatacgaaaatcactagcattcctatacaccaacaacaacgaaaccgagagccaaatcagaaaggcaacccattcacaattcccacacataaaataataaaatacacaggaatacagttaaccaggaaggtgaaagatctctacaatgagaattacaaaacactgctcgaagaaatcagagtagacacaaacaaatggaaaaacatcccatgctcatgtataggaagaatcaatatcattaaaatggctaccttgcccaaagccatttacagactcaatgctattcctatcaaactaccaatgacattcttcacaggactagaaaaaactattttaaaatttatatggaaccaaaaaagagtctgtatagccaaggcaaatctcagcaaaaagagcaaagctggaggaatcatgttacctgacttcaaactatagtgcaaggctacagtaaccaaaaatagcatggtactggtacaagcacagacacacagaccaatggaagagaccaatagagagcccagaaataaggccacacatctatggccatctgatctttgacaacgctgacaaaaactagcaatggagaaaagactccctaaatggtactgggataactggctagccatatgcagaatactgaagctggaccccttcctcacaccatatacaaaaatcaactcatgatgaattaaagacttaaatgtaaaacccaaaactataaataccctggaagacaacctaggtaataccctcatggatctaggaataggcaaagatttcatgacgaagtcaccaaaaccaattgtaacagaaccaaaaattgacaaatggggtctaatttaacttaggaacttccgcacagcaaaagaaactatcaacagagtaaagagaagcctacagactgggagaaaatttatgcaaactatgcatctgacaaaggtccaatatccagaatctataaggaacttaaacaaatttataagagaagaacaaacaacctcattaaaaagtgggcaaaggacatgaacagaccattttaaaaaaagacatacatgtggccaataagcatatggaaacaagctcaatatcactgatcattagagaaatgcaaatcaaaaccacaatgagataccatttcacaccagtcagaacggctatattaaaaattcaaaaaataacagatgctggcaaggttgtggagaaaagagaacccttatacactgttggtgggagtgtaaattagttcaaccattttggaaagcagtacggtgattcctcaaagagctaaaagcagaactaccatttgactcagcaatctcgttactgagtatatacccaaaggaatataaagcattctaccataaagacccagacacgtgaatgttcactgcagcactgttcacaacagcaaagacatggaatcaacctaaatgctcatcaatgacagacaggataaagaaaatgtggtacatatacacatggaatatcatgcagccataaaaaagaaagagatcatgtcttttgccggaccatggatggagctacaggctatcatccttagcaaactaatgcaggaacagaaaggcaaataccgcatgttctcacttataagaacatatgaacacaaagaaggaaataacagacactggggtctacttgacaggggagggtggaagaagggagaagaacagaaaagataactattgggtacttggcttaataacttggtaatgtaataatatgtacaacaaacccccgacacatgtttatctatgtaacaaaccttcacatgtaccctctaacctaaagtaaaaaaaatatatatatatatatatttttttaatttttttattttatttttttttgagacagagtcttgctctgtcgcccaggctggagtgcagtggcgtgatctcggctcactgcaagccctgcctcctaggttcacgccattctcctgcctcagcctcccgagtagctgggactacagatgccctgcaccacgcccagctatttctttgtattttttagtagagacgggtttcatcatgttagccaggatggtctcgatctcctgacctcatgatctgcctgagtcggcctcccaaagtgctgggattacagacgtgagccaccgcgcctggccaaaaattttttaaaagttagaaattataatataaaaaaactcaaactactgaagacaaaaaccataatgtctgagataaaagacaaatcaaatgatattcacaacagattagatgctatggaagaaaagactagtaaacttaagtttacaccaataaaaattatctaaaataaaacacacacacacacacacacacacacacagagagagagagagagagagagaaaacgaaaagagaatcagtgagctgtaagagaacttcaagtggcctaaaatataagtaacaggaattaaggcgtcggggggagcaaaaatattttaagaaataatggcaaaactaataccagatgcaaatatgactgcataaaacaatgaagaataccagatggagtaactacatgggtaaatgcataagattttttttattatttaaatatcttttaaagatgattgactatataaataaaaataacactgcagcatggggtttatagcatatataaaactacaatatatgtcaacaatagcacaaaatttgggaagggagaaatgaaagagtactcttgctgtatagttcttatactataggaaaagtgatacagtatcacttgaaagtagaatatacaaattaaagattgcataagttaaacaaggattgtttaagcccaaaagtaaccactaaaatgaaaatacagtgagttgtaactaataagccaacaaaggacttaacctaaaagaaggctgaaaaataaagggtaaaaaggaccaatggaatgaacagaaaacagtaaaataatagattccagcctaaccatattagtcatcacattaaatagattttaagaccacgtaaaaaagcaagacccaactacatactgtgtacaagaaacattttaaatacaaagactcgaaaaggttaaaagaaaaaggaggggaaacagatatattatgctaccattaaataaataaagctaaagtggctacattaatatcaacgtagatttcagaaattttttttaaacaggaagaagacattttataatgatatatgggccaattaatcaagagaacataaaatcctaaacatttttgtacataataaagatctttgaactatgtgaaacaaatctgatagaacagcaagagggaagaggcaaatatcctctatttcagtcaaagatttcaaaaccccctctcaataacagatagaacgaatagaaaaatagtgaggatatagacgatctgaacaatctgtcaatcaacttgacctatttgatgtttatagaacactccacacagcagcagcagaatatgcattcttctcaagtacatctgaattagttgccaaaccagaccatatactgggccactaagtaagccacaataaaattaaaatgatttaaacaatataaaatatgttctcatgtcaaagggaattaaattagaaatgaaaaacagaaatatctcttgaaaaatcataaatttaaaaactaaatgcatacctaaataactcataaaccaaagaagaagtcaaaagaaaaaatggaaattattcagaactaaatgaaaatgaaaacaacctataaaaatttgtaggatgctactaaagtagtatgtaaggggaaatttatagcactaaacacttaaaatgttatagaaagcttcaatcgatgaactcagtttccaccttaagaaatcagatgaagagaaagttaaatcaaagtaaataaacaagaaaagataatagggataaaaacagaaatcaataaaataaaaagtagacacagtaataaaaaatcaactaaagcaaaagtttgttctttgagataaaaaaaactttagccacactgatcacacacagagaaaaaaatgttaatatttggaataagatgatatcactagaatttctatagctattaaaaggatcataagggaatattatgaaaaacatcctataaataaacttgacaacttagacgaaataaagaaattctctaaaagacacaaactactggccaggcacagtgacgcacgcctgtaatcccagcactttgggaggccaaggcaggtggatcacttgaggtcaggagttcgagaccagcttaacatggtgaaaccccgtctctactaaaaatacaaaaactagccaggtgtgacggtgcatgtctgtaatcccagctactcaggaggctgaggcaggagaatccttgaacccagggggtggaagttgcagtgagccaagatcgcgccattgcactccagcctgggcaagaagaacaaaactccttctcaaacaacaaacaaacaaacaaacaaaaaaccagacaaactaccaaacctcactcatgaagacataacctgaataaccctatatccattgaagaaaataaaactatagttaaaaaactttccacaaaaacaaaaacaaaaaaccctacagttccagatggcttcactggtaaattctactaaacattaaaggttttttccttaaaaaaataacagcaattctacccaaactcttctaaaaaaacggaaaaatatagaatactttccaacccattttataaggccgacattaccaataccaaaacttgataaagacattacaagaaaactacagttcaatatccctcatgaacacagttgtaaaaatactaaatatctatatatctatatatctatatctatatatatatatcttttattttagcaaattgaatccaaccatgtaataaaaggctaacatatcatgaccaagcggggtttaacacaggaatacagggttgatttacatttgaaaagcaatcaacagaattcattttaacatgtttacataaaaaagaaacaaactaagaaaaatgatatgatcatttcaatacaaacagaaaacgcatttgacaaaagtgagcaaacacttctgttaaaaactctgagtacactaggagaaaaaccagatttccttaacctaataaagagcattgatgtgaaatccacagctaacatcatacttaatgttgaaaaaccgaatgcttttccactaagatcagaaacaagataggcacgtcttctatcaccacttgtattcaactttgtgctccaggttctagcctgggcaatcaagcaaaaaaaaggaaggaacccgattgctgaaaatctacagagaaaaatctacaaagagtggactctacaaagagtgtctagaacaaataagtttagcaaggtagtagaacacatgatcaatatataaaaatcaattacatttcttcctattagcaatgagcaaaccagaaatttaaattaaaatgtcatttataaaagcatcaagaatatgaactaggctaggtatggtggctcacacctgtaatcccagcattttgggagtgtgaaatgggaagactgcttgaggccaggagattgagaccagcctgggcaacacagtgggaccctgactctgttttttttaaaatgaattacttagggatacatatgtcaaaagatgtgaaagagctggacaatgaaaattacaaaacactgctgaggaaaactaaataagacccaaacaaataggaagatgtatattgttgaagggctggccaacttgatattgtcaagatgtcaattcttctacaagtcaatctatgtttgaataaatctacagatttgatgcaatcccagtccaagtgtcaccaggttttttggttgtgtgtttgtttttttgagggggagggggaaagtgaggacagtagaagttgtaaaactgagtttgaaattccagtgaaaatgtaaaggacctagaatgccaaaacaactctgaaacagactaaattggagaagtaacactacctgattccaagaattgtggtaaagcaacattaaccaaaaaaacaaaaacaaaaacaaaaacaaaacaaaaaaatgcccagcatagtactagagtaaagaaatggaaataaggtctggtgtggtgactcacacctataatctcagcaccatgggaggccaaggcagaaggattgcttgagtccagtagtttgagaccaacctgggcaacatagggagaccctgtctctataaaaaataacgacaaccaaaaaacaaaaacttagctgtctgtgcatccagctcgagaggctgaggtgggaggatcaattgagcccaaaaggttgaagctgcagtaagctattatcatgccactgaactccagcctggcaacaaaatgatacccctcccccgaataaaaaaaagaaatgcaaacagacaaataaaacaaaacacagaaacccacacatagaaggacaactgatccctttccattaataagaaactttaacacttgctcaagaaaagtgtaactattgttaggtgttcttaaagcaggggataatgaaatcatgaaatgaagcaatgtgttaatggagaaggtccctctgctgcaggcagcagaaattctccctgcaaattggattacctgatctattgctgcttgcaaactgccagctgcaaacctagcatagcacccacatggttaaattttactttacatgtatttatacagtattaagtgcttccttaagtgattttttaaaataaatcataggcaattgagttctgattacaactcaccctttcctgaatcctcattttggtcagtttgagaaacaaggtgcttttctgtttgaatccaaggtctagccctctggctaagggtcctacataccactgacctgaccattttaaccactttcagagctgtgactttagaaatactgttttcctatttcttacccattctcattattcagactctagcactgtgtttaagacttgggattctagaataaaagacatattcaaatttcagacttgctatttacttagctgtgtgggctctccacaatcctttaattaataaaatcttaatgaaaatactgtgatataccttacgtagcttttataaaaaactattttatgcacctaaaatgtttaacatagtacctagcaaagagtaaatatttaataaatagtagctattgtattatcattattactaatattattaccgactcagcccccgtcacccctttcaaaataatgtcaacttgattcttctctacctcaaaacttgaatcaattcacagcattgttgccctcaaggagctgatgaatgaaaatacatactgattattttgaattctttaaacaattaaaatatgaatatatttttattgccgaaagcccaaacaatacagaaatttgtagagaaatcattcaaattcttgctgcccaaccaaatgatgtggggcactctacccctcacttccagccatattaatcattattaattgctttatgtgtttccttccaaatatttttgtatgcatttacctacatatgtatgtgtgcatataaatattcaggcataatttgaatagtacaatgaaacccatttacccttatttagatacactaattgtcaataattcaccacataaaaataactaattttgatttttttatattctactttaagttctagggtacatgtgcacaacgtgcaggtttgttacataggtatacatgtgccatgttggtttgctgcacccatcaactcatcatttatattaggtatttctcctaatgctatcctcccctccccccaccccccaacaggccccagggtgtgatgttccccaccctattccaagtgttctcattgttcaattcccacctatgagtgagaacatgtggtgtttggttttctgtctttgttacagtttgctaagaacgatggtttctaacttcatccatgtacctgcaaaggacatgaactcatccttttttatggctgcatagtattctatggtgtatatgtgccacattttctttatccagtctatcattgatgggcatttgggttggctccaagactttgctgctgtgaacagtgctgcaataaacatacatgtgcatgtgtctttatattagaatgattgataatcctttgggtatatacccagtaatgggattgctgggtcaaatggtatttctagttctagatccttgaggaatcaccaaactgtcttccacaatggctgaactaatttatactcccaccaacagtgtaaaagcattcctatttctccacatcctctccagcatctgttgtttcctgactttttaatgatcgccattctaactggtgtgagatggtatctcattgtggttttgatttgcatttctctgatgaccaatgatgatgagcattttttcatgtgtctgttggctgcataaatgtcttcttttgagaagtgtctgttcatatcctttgcccacttgttgatggggttgtttttttcttgtaaatttgtttaagttctttgtagattctggatattagccctttgtcagatgggtagactgcaaaatttttctcccattctgtaggttgcctgttcactctgatggtagtttcttttgctgggcagaagctctttagtttaattagatcccatttgtcaattttggcttttgttgccattgcttttggtgttttagccatgaagtcctcgcccatgcctatgtcgtaaatggtactgcctaggtttttcttctagggtttttatggttttatgtctaacatttaagtctttaatccatcttgaattaatttttgttataagatgtaaggaagggatccagtttcagttttctacatatggctagccagttttcccaacaccatttattaaatagggaatcctttccccacttcttgtttttgccaggtttgtcacagatcagatggttgtaggtgtgtggtgttatttctgaaggctttgttctgttccattggtgtatatatgtggtttggtaccagcaccatgctgttttggttactatagccttgtagtatagtttgaagtcaggtagcatgatgcctccagctttgttcattttgcttagaattgtcttggcaatgtgggctcttttttggttccatatgaactttaaaatagtttttttccaattctgtgaagaaagtcattggtagcttgatggggatggaattgaatctatagattactttgggccatatggccattttcacggtattgattcttcctatccatgagcatggaatgtttttccatttgtttgtgtcctcttttatttcgttgagcagtggtttgtagttctccctgaagaagtccttcacatcccttgtaaactggattcccaggtattttattctctttgtagcaattgtgaatgggggttcactcatggtttggctctctgtttgtctgttattggtgtataggaatgcttgtgatttttgcacactgattttgtttcctgagacactgctgaagctgcctatcagcttaaggaggttttgggctgagacgatggtgttttctaaatatacaatattgtaatccacaaacagagacaatttgacttcctctcttccaaattgaataccctttatttctttctcttgcctgattgccctggctggaacctccaacactaagttgaatagaagtggtgagagagggcatccttgtcttgtgccggttttctctttttttctctctctctctttttttttttttttttttgagagggagtctcactctgtcacccaggctggagtgtggtggcgtgatctgagctcacggcaagctctgcctcccaggttcacaccattctcctgcttcagcctccagagtacctgggactacaagcgcccgcaaccacgcctggctaattttttgtatttttcatagagatggggtttcaccatgttagccaggatggtcttgatttcccaacctcgtgatccacctgcctcggcctcccaaagtgctgggattacaggtgtgagccgccgtgcccggccattgtgccagttttcaaagggaatgcttccagtttttgcccattcagtatgatattggctgtgggtttgtcataaacagctcttattattttgagatacattccatcaatatctagtttattgagagtttttagcatgaagggctgttgaattttgctgaaggccttttttgcatctattgagataatcatgtggtttttctcactgggtctgtttatgttatggattacgtttattgatttgcatatgttgaaccagccttgcatctcagggatgaagctgacttgatcatggtggataagctttttgatgtgctgctggatttggtttgccagtattttattgaggattttcgcatcaatacagaaatttgtagggaaatcattcaagtttttgccgcccaacccaatgatgtggggcactccacccttcacctccagccatattaatcattattaattgctttatgtgtttccttccaaatattttttgtatgcatttacatacacatgtatgtgtgcatataaatattcaggcataatttgaatagtacaatgaaacccatttacccttacctagattcactaattgccaaataagtcaccacataaaaatacctaattttgacttttaaccaaaatatcttttatatcttatatagcctttaaggtagatattaagactatagttcctaaagccaaaacttcacaaacggtttctaagaaaacatgactcatatcaaggatttgtatattttaagggaaatttaagattctagtcagcacaaagtgttgacatttcaaaatctctcaggcccaacaacctactcacttcttgaagctcactaccttttaagagtcagaaatcttatgtataatgactcaggaaacagttgaagatatacttctattttttttttcaattaaaattgacaaatagtaataattctttgatttttaagaataaatgtaaaagtacttaaatagaggaaataaggtgagttccatttcaattccttttcctttcttgtaaattataaacgttggaattttactaatttcctggacaacaaatagaaggaatgctatcatttggggcttttccactaatggctgcattactatgttctcaaaaaacaaaaaaatccagtggaatcttttttttttttcttttttttttttttggagacagggtctcattctgttgcccaggctggagtgcagtggcaccatctcagatcactgctgcctcgccctcccagggtcaagcaatcatgatcctgtcaagtagctaggactacagatgcatgacaccacatatggctaattattattattattattattatcatcatcatcatcatcattatttttggtaaagacaggtttcacttttttgcccagtctggttttgaacccccgggctcaagcaatccgcctgccttggcatcccaaagtgctgggattccaggtgtgagtcatcgcacccagtggttatcttgctttcaattgactccttcaaaaggccaatatataatgtgatctgagtaatgggatgtattgcaatatgggatctacagggttgctgtgaatatgaagtgcttagaattctgcctagcaggtaagtaatcaataaaggcttatctgaagagaaataaagtaagcttttacttacaatgagttatagttatgtgtttcctatatcccttgtaaagttgaagtaaaaattattaaaattattttcattttaaaattattaaaattttcaaattccttattaaattgaaattaaggaagagcaatttccttaacaaattatatggaagaaaatcaaagaagaaactatagattaagaaagatttaagtggcccagcacagtggcttgcacctgtaatctcagcactttggaagggccaggcgggcagatcacttgaggtcaggagtttgagaccagcctggcctacatggcgaaacactgtctgtctctactaataatacaaaaactagctgggtgtggtggcatgcacctgtagtcccagctactcaggaggctgaggcatgagaattgcctgaaactgggaggcagaggttgcagtgagccaagattgtgagatcgcactactgcactctagcctgggagacagagtgcggctccaactcaaaaaaacaaaaaaaaagatttaggagacctatcaaccaaatgcatatgtagaccttgtttggatgtgaattcaaacaaaccaactgtgaaaagatagtaaatgagcaatatacacacttacatactacaagtggggaaatataaagactgcagatggttggtgatattattacttatgttttaggtatgataaatgacactgtggttgtgttaagaaaaaagaggtcttttagaagtactctaatatttatgaacaaagtgatatgaagttgaatcaaatgtaattatcattttataggtgaaaataaatggatgtagacaatttcgtatgattcaattaatacaatatttgtagtttgcttcacaataatccaattagaagggtttgaggccagtaggtagacaggtataatagagcgggaaagaaagagtgacccagagttaacgattgctgtagttgtatgatgagtacatgggagttcattgttctctatttttatcttttaatttttctatgtttttaacaagaaaaccaagagaaccctaccttatacaactgtgccttgcctaatgcttattagcactatatttgataaataataaataccaaaaacatagatgttgaacatgtttgaatcaatattctcagaaaggtccatttataagaaatgatgaattcacaaaaactcagccagcaaaggaagatcaaatggaaagacaaaaattagaaacaaaatgttcttcgaattttataaaactctcacatgtgactgactgacttttcattctgcagattttattatctctcaaagttatctctcaaagtctgtgatagctatatattcatcttttgcttattttaagtgttttatattattttacttaggctgattaaaaaatatttgcactgaactccattacctatctctgtttattaagtttagatgtagttatagactagggagaacagagaaaattgaaaatgtgtacattagattccccagagtaattttgtttttggtttttacatcagacacacacaattttaaatacaagtttatccatctgaaaagagatttcttgcttatagccaggtcaattttgtttacacatatattaaatacaatttgctaaatatagccaatgttaataagaatagattcattttaccctctgtatgtctggaatggttaagatataatagtttaaaagttacagaaaaatatattaatgtttccttaatattagggagaacgtgttaacatttaaagctgtcaaacaatggaataaactatgtcctagagaatgagaaccccttacttcacaaattaaaccagaagttggatggcaatttatcagatatactgaaaaagagattcacagagaaggctaaaacttgataatctcatggcctgtgccaccagacagacaagaatcttgatctgactcttaacttaggttataattttggtaaattacctaatttctctaaacctcagttttccttgaacacaaaatacatcattactgtcaagattaagtgatatcatgcatgtaaactggttagcattctgcctcagacattgtaagtgattaataaacactgttatagaattatgaccagtcacacaatcagtactcaagtaatgagtaacatcttcactactactgctattgctatgtaagagaataataggtagttgatatggtttggttctgtgtccccacccaaatcttatgttgaatcgtgatcccaagtgttgaaggtggggcctggtgaaaggtgattggatcatcggggcagatttcccccttgctgttcttatgatagtgaatgagttctcatgaaatctggtagtttaaaagtgtatagcactttccccttcatttgctgtctctcctgccaccatgtgaaaacatgcttgcttcctctttgcccttctgccatgattgtaagtttcctgaggcctctctgccatgcctcctgtacagccagactgtggaactgtgagtcaattaaacctcttttctttataaattaccggtcttgggtagttctttatagcagtgtgagaacagactaacacagtaattgatgaatgcaacagaggacacctctagcctgagacataaaggatgggatcgtagaggaaacagaaaaccatttctggtagtttttttttttttctgcgagttggcaaattagaggctttgttaccatagctcacccactcagaaatagcaaaatagcatgtacagattcacatggtgaactttcatccaagaagaaacatgagagctaaatataaaagcaaaagaataattgaatactttgaaaaatacagtgggcattaggctacgctgtggatctgtggtggaaaactgtgagtgaatcaccagtgtatgacgggggagagagtatcttacaatacatatttctactaaggaacgaggcaatccaggccactggggagctccgtgaccctactgagagctagatcttaagttggagaacagggagactgtaagaaggaatggcagtagaaagtgctccatatgcactcccgtctccaactactgacagaaggccattcttgatccaactaagggggctgcacgaaaaccagccagccagcacaggtggcagacactggtttggagaatcttcagatcaggacttgcaatccagtctctagtgggacaggagcccctatggccagaactgagaggtgagaatatgtgggctccagctttgggtacaggagttgggcactacccgtttgcagcatgggaccaggaggggtgtggcctgggagccatgtttttgtctcagggagggagctttgagacctggggcgatgttacaatctgaagaaagactgcttataacttggctggctgtattagcataccactggcagcaggccatgggagggagccctgccaggctgaaagcatggacttcaggcaggtcccactactgcctgctaggctgtggaaccaaaactacccttctgtccctgtattggctctttgacacagcaccagttgctctgctcctccctcgagcattgccccaggggcctgagaactgctttctgatcctccttggggacagcacttgtgcttggtgttggggatgccggagcatgggactgtccagcctagccccatttggccttgcctccatcaacctgcatctgaggaagagcttgggaacagggcccctgggagttccacagcctagtccatcacctaagacatcagagtacctctggttaacaaaggtcaagcatattgccaccacctcagctggatctcgcatgctagcgccacctactggctgcaaggccaacctgcagagcttattacattatctgttgataaaattgcatggggtttgaccactgctcaaggaaataaaagaggacacaaacaaatggaagaacattccatgctcatggataggaagaaccaatatcgtgaaaatggccatacggctcaaagtaatttatagattcaatgccatccccatcaagctaccaatgactttcttcacagaattggaaaaaactactttaaagttcatatggaccccaaaaagggcccatattgccaatacaatcctaagcaaaaagaacaaagctggaggcatcatgctacctgacttcaaactatactacaaggctacagtaaccaaaataatatggtactggtaccaaaccacatctatacaccaatggaataacaaacaccacacatctacaaccatctcatctttgacaagcctgacaaaaacaagcaatggggaaaggattccctatttaataaacggtgttgggaaaactggcaagccatatgcagaaagctgaaactggatcccttccttaaaccttatacaaaaattaactcaagatggattaaagacttaaatgttagacataaaaccattaaaaatcctagaagaaaacgtaggcaataccatgtagcacataggcatgggcaaagacttcatgactaaaacaccaaaagcaatggcaacaaagccaaaatagacaaatgggatctaattaaactaaagagcttctgcacagcaaaagaaactatcagcagagtgaacaggcaacctacaggataggagaaaatttctgcaaactatccatctgacaaagggctaatatccagaatctacaaagaacttaaacaaatttacaagaaaaaaacaaacaacctcatcaacaagtgggcaaaggatatgaacagacacttctcaaaagaagacatttatgcagccaacaaacttatgaaaaaatgctcatcatcactggtcattagagaaatgcaaatcaaaaccacaatgagataccatctcatgccatttagaatggcgatcattaaaaattcaggaaacaaaagatgctggagaggatatggagaaatagaaacgcttttacactagtgtaaactagttcaaccattgtggaagacagtgtggtgactcctcaaggatctagagctagtaataccatttgatccagtgatcccattactgggtatatacccaaaggattatcaatcattctaatataaagacacatgaacacatatgtttactgtagcactgttcacaatagcaaagacttggaaccaacccaaatgcccatcaatgatagagtggataaagaaaatgtggcacatatacaccatggaatactatgcagccataaaaaaggatgagttcatgtcctttgtagggacatggatgaaactggaaaccatcattctcagcaaagtaacacaaggacagaaaaccaaacaccacatgttctcattcataagtgggagttgaacaatgagaacacatggacacagggaggggaatatcacacatcagggcctatcgggggtttgggggctgggggagggatagcattaggagaaatacctaatgtaaatgacgagttgatgggtgcagcaaaccaacatggcacacgtatacctacgtaacaaacctgcaggttgtgcacatgtaccccagaacttaaagtataataataaaaaacaaatttaaaaaaattgcatgaggtttgaagaacagacaagctctgtgtgacctctactaccaacaccacaccctggctactcaggaggacttgaacccatttgctcaaccttacattatgactgcaactagcatttaagaaatccaccaaactgaggctatttataaccaagaaaatcatacatagtctatgccaccaaatgcacccataagcaaagccagagaaccctactcaacatacaccacagatgcatcctgaagaagaaaaaaagttacctttcagtaaaagtgaattcaaaaataagaagaagcgactgttaccccatatgcaaatgtatcagtgcaataatactggaaatatttaaaaaaacacaagatgctatgacatctcaaagaaacgccgtaattctatagcgatggagcctaacaaaaaagaaatctcacaacaatgtacaagagaaaccagaaaactaatgcaaagaaattagaaaataaattcaggatataattgagaaatctgcaaagatacatacaactacatcagtatctacatttacaggatatgactgagaaattcaccaaagatatctacatccccctatttatctataaagccaaaccaaacttttggaaatgaaaaatttattgaagaaattccataatacagttgaaagttctgacaacagactagaccaaatggaagaaagaatctcagaaactgaagacaggtctttcaaattaatccagttagacaaaagttttttaaaaaaggatttaataaacaaacaaagcatttgagaagtatggaactataaaaacaagactgaacctacaaatcataggtactcctgagaaataaaaaagtttggacacctgatttgaggaaataattatggaaaactaccttattctagcagaagatccagatattcaaatacaagaggctccatgaactccggaaattacattgcaagaaagaactcaccatgacatagtcatcagaatgcctatggttaacattaagaggggaaaaaaaattctaaaatcagcaagagtaaagcatctagtgacctatcaaggaaatcccaagagactaacagtagacttctcagcagaaaccttacaagccagagagattgagattctattttcaaagtgcttaaagaaaaaaaaatgtgggacaggcacgatggctcatgcctgtaatccctgcactttaggaggctgagcagggtggatcacctgaggtcaggagtttgagaccagcctggccaacatggtgaaaccctgtctctactaaaaacacaaaaattagccaggcctggtagtgtgtgcctgtagtctcagctacttggaaggctgaggcaggagaattgcttgaacccgggaggcagaggttgcagtgagccgaggtcacaccactgcactccagcctggaaaataagagcgaaactctgtctcaaaaaaaaaaaaaaaaaaaaaagtaaaccccaaattttatatcctgctagaataagtaaaggagtaataaagtctttcctagacaaggaaatgctgatggaattcatcaccactagaccggtcctatcaaaaaaactcaaagaagtttttaacatggaaacaaaaggttgacactctccatcctaacaaaacacaaaagtataaaactcacaggtcttataaaacaattacacttatgagaaagacacataaatcatatggcaatgtgacaaaaccctactaaacctaaaaagacagagaaaaaaaaaagaatcccaaaggcaagtagatagaaacattatgatagaaacaaaaaccttacatatcaatattactctttaacataaattgattaaatgctctacttaaaagatacagattcgtggaatgaatttaaaaacagatccaactatattctgcttatgagaaatttgccttactcataaagacatgtacagactgaaggtaaaggggtaaaaaaacatattccatgcaaacaaaaatcaaacgcaagcagaaatagctatacttatatcagacaaaacagactttacatcaacagtagtaaaaaaaaggaagtctttatgtaataataaagcaatcaattcaccaagaaaatataacaatcctaaatatatatggacccaacactgcagcacccagattcataaaacaagtattactaaacctaagagaaaaatatagatagcaatacaatactagtgggggatgtcagcacaccactgacagcactacgcagagtatcatgacagaaaattaaagtggactttagaccaagtggacctatagacatttacagaacattctatacaaggaatatatcaacagatggaacattctccaagacagtaactatattaggtcacaaaaaaagtctcaataaattttaaaaaaatctcaaaatcataccaagtatcttcttggaccacagtggaataaaaccagaaatcaattccaagaggaactttcaaaaccatacaaacacatagaaattaaagaatatgctcctgaatgatctatgggtcaacaatgaaattaaggcagaaatttacaacaaaaattgaaaagaatgaaaatggagacacaacatatcaaaaacctctgggatacagcaaaagcagtgctaagagggaaatttataacattaaatacctccatttaaagaaatggctgggcacggtagctcacacctgtaatcccagcactttgggaggctgagacggatagatcgtctgaggtcaggagatcgagaccatcctggctaacatggtgaaaccccatctctactaaaattacaaaaaattagccaggcgtggtgacacgcgcctgtagtcctagctactcgggaggctgaggcaggaggatcgcttgaacctggaaggcagaggttacagtgagctgagattgcgccactgcactccagcctgacccacagagcaagactccacctcaaaaaaaaaaaaaaagaaaaagaaatattgcacattagcaacctgacattgtatctcaaggaactagaaaaccaagaacaaaccaaactcaaagctagaagaacaaaagaaataacaaagattcaagcaaatagaaagaaattgagaccaaaaaaataaaacataaaggatcaacaaaaaattaaaaagttgatacttagaaaatataaacaaaattgatagaacacttgactaaccacgaaaaggagagaagattcaaataaacacaatcagaaaagaaaaaggagacattgcaactgataccacagaaatgcaaaagagcatcagagactactatgagcagctctacattcacaaactagaaaaccaaaaggaaatggataagttcctggaaacacacaacctcccaagactgaaccagaaggaaatagaaattatgaattgactaataattagtgagattgaactagtaataaaaattcacccatcaacaaaaaagtccaggaccagagaattcacagccaaattctaccagatatacaaagaatagctggtaccagtcctactaaaactgttcaaaaaattaatgtggacggaaacttccctaactcattctatgatgccagtattaccctgatatcaaagcacagtaaatacacaacaatgacgacaaaaaagaaaactacatatcaatatccctcttgaacacagacacaaaaatccttgacggaatactagaaaactgaattcaacagcacgtcaaaaggataatgcaccatgatcaagtaggttttattcccgggatgcaaaaatggctcaatatatgcaaatcaataaatgtgattcactagataaacacaattaaaaacaaaaaccatatgatcatctcaacagatgcaaaaaatcatttgataaaattcagcatccctttataataaaaaccttcaacaaaataggtacagaaggaacatatctcaatgtaataaaagccatataaaacaaacccacagtcaacatcatactgaagggggaaaaagatgaaaatatttcccctaagagctgggacaagataaggatgctcgctatcaccactcctattcaacacagtactggaaatcccagccagagcaaccaggcaagagaaagaaataaaaggcgtccaaattggaaaagaattcaaatgatctctgccaacaatatgatcttatacctagaaaaccctaaagactcctccaaaagactcctgtatttgataaatgaattcattaaagtttcagcatacaaatcaacatacaaaaatcagtaccatttctatacaccaataactaccaaactgagaaccaaatcaagaagtcaatcctatttacaatagctaccaaaaccaaaacaacacagctctaggaatacagttaacgaaggaggtgaaagatctctacaaggacaactataagatactgatgaaaaaaactgtagatgacacaaacaaatgtaagaacatcccacaccatgaatttgaagaatcaatatcattaaaacaatgatgctgacaaaagcagtctacagattcaatgcaatccctatccaaatacgaacatcattttttcacagaattagaaaaaataatcctaaaattcacatggaatcaagggagagctgaaatagccaaagaaatcctgagcaaaaagaacaaagttggaggccccatagtacctggcttcaaattacacaaggctataataaccaaaacagcattgtactaatataaaaatagatacagatcaatggaacataccagagaactaaataaagccacatgcctacagacaattgatttctgatagagtcaacaaaaacatacaatggggaaaggacaccttattcaataaatggtgctagggaaattggagtgccatatggagaagaataaaatagaacccatatctctcaccatatgcaaaaattaattcaagatggattaaagacttaaatataagacctgaaactataaaaaaataccagaagaaaacgtaggaaaaactcttctggacattgacctaaggaaatgattcattactaaaacctcaaaagcaaatgcaacaaaagcaaaaatggatggccatggtggctgacacctggaatcccagcatctctggaagtcatgcttgaggccacgagttcaagactagcccaggcaacacagggagaccacatctctataaaacatacacaaataaacaaatgtgaattaattaaaccaaaaagcttatgcacagcaaaagaaataatcaacagagtgaacaaacagtctgcaaaatggcagaaaatgtttgcaaagtatctatccaacaagggactaatactcagaatctatgaggaattcaaactaagaacaaaacaaaacaaaaaattaaccttattaaaaagtgtagaaagatgtttgcctacataacaaacctgcacatcctgcacatgtatcctggaacttttggaaaaaaaaaagtgtgcaaaagacatgaacaggcattattcagaagaagacatacaaatgaccaaaaagcataggaaaaaatgctcaagttcagtaataatcagagaaatacaagataaaaccacaatgaggcatcatcttataccagtcagaatggctattattaaaaagtcaaaaaataacagatgttggtgaggatacaaagaaaagagaatgcttatacactgttgggtgggaatgtaaattagcacaacctctgtagaaaacagtatgaagatatctcaaagaactaaaaatggaactagcattatatccagcaatcccactactgggtatctactgaaaggaaaataagttatgacataaaaaagatgcctgcacttatgtatgtttattgtagcactattcacaatggcaaagatatgaaaccaaactaagtgtccatcaacggatgactggataaagaaaatgtggtaggtatatacaatggaatactattcagcataaaaaagaatgtaatcatgtattttacagcaacatggatggaactggaggctgttatcttaagtgaaataactcagaaacagagtcaaatgccacatgttctcacttacaagtgggtgctaaaaatgtgttcacatggatgagagagtggaattatatatatagtggagactcagacaggtgaggagctatggcgggggtagcatggtaaaaaatttgttaatgggtgcaatatatattagttgggtgatggataccctaaaagccctgacatgacttcataatctatgtatataataaaatcgcacatgcattccacaaatttgtacaaaacaaaacagaaaagactaggatgctgaggtagagacaaatctatgggaaattcccagattaagaaacaatttgaaaatactgttttttcaggctgacttcaaatgtccagtttcttgattcatttttcttttgttctcaaaaccttttagcaattattgtttcttcactgtttcttttaatccctttctctcaaactcgtattacatgaatattacagcctttcaatctaccttatatgtcttttagctgtggtaaattaaattgtttttttctgaccccgtattgagtttctggtaaatgtatcaggactatccggaattttctcttcaactctatctagagaagattttatttcatgtactaatttatgtttatttcaatgactgtatttttattttcaagtttctaattggattctcttcatacatacatttctctcctgcttttgtttttatcattttctgttcatttttatttgatgtttcatctgcatttgtctttttgaacattcggtatgaacatatttttaaagtttttgttatttatttctgtaaaattaatttcatattgagcaaattcaggttctgacttttcttctggctgtaatttttagcagcagatttctccatatgattttgaatactgttttaatggctcgttttgagtggaagatgtttttctgcggttgttttctctcacttccttctccctgctcatacctgtctgtctttgtctttcatcttgaccctcctgtccccagccaaaaataatttttcttctatcaccagttatactgtacacatggaagactctttcacagacatatgtgatactttggttccgtttctaacagattaatagtatgtcagctgtccttccccccaccccccaccccaggtatcctcaggcaagcagtttgtcaaaagatataagtggaggctggcacacacgtgcatgtgtgcatgcacgtgtgtgtgttctaacctgccttcttagagacaagtgctggtgtgctctgtcatttctggttaagttctatcatcaacaggctaagtttcctttttcttctttatacaatttctgtttaattattggcaattgaggtgtttatcttgcttttgaactcggccctgccttttttatcttttcatatgttttatatgtcctggccatgtttttggtgtgcaatcagtgattgatggttcactatcatgccatcctgatttgaagacaagtttctaagttagcagattttcaaatatacctgacataactcttactgattctaagtggacaaggaaaggcaaggaaaagttaggattataaatctaatgtaattcacttgctggtcctctgcagtagataatatataagtggcttgcttattgataacttgcaattgcttggcttcattctgaattctgtaagttctccaaaaattcctgtccccaagttttctaagcactatagtacaatcagaggagaattattagcccagaagtctaatgtcctggagcctaggtgggtgaatctgggcacttttgtatttcaatttcctcctttataaaacaggtataataatgtctacgttcaccttcatatggagttgttgaggacactgcagagataacagagtgaaattcaacaaagttttacttagcttctgtttggagacagatatattgctaggtctagggaaataaaaattgaagcatagccctttggttatttataatactgtggtccagatcgcctgttttattatgagttgtgacaatccaatgtggactgtggtaaacactaaactaggtataaacagtgaattaagaccaccctccaaaaggagcaattcgcacttgaggaaatgagtgaaaacttcacttagtaacccatctttgatctaaagtcctgtgaaaatgccaagatgctatgtaaatgtaagatgtgctattattttattttatataccaaagttttctcatgagtgaatctgactggagaccacttagccattttgtctttttttttgtttgttgtgtaggtcggaccttgcacttaaatcttccatcttctgggtcctggtgcttgtcagtcaatcattctctcatctgtgatggctaattttgatgtgtatttttgaaaatcttctcctccaggctgcttttcaatctgaagttccaaggaaacacccattttgctattatccagatacaatttagactgagccgttgcagtagaacattgtgttctatttgccataattttttttcaagagacaaagataaacagcttaaacagataaccatctctggttgctgattttaacaataatatttagcagccagtgaatattctgcaagtgcctttctcagaaaggctgcattaagtaaacaagcagtaaatattccaaatgactgagataatagaagttaaatttagttagctaactgcccatatctggctaaaacattgtttttctgttatggtaaataatactcatcttgtttagacaggttttatcaaaaacagtgttagtatttcataccaaacatatttttatgaagctcatgaagcttatgagggctaaaactaacaaattttgagctgcttcagtcatatttcattagttttctttagatgtatattttgatttatttccaaatcacaagttatactgtatcctgtgttttgaagaacaatagtgactggagtattccaattagtcagcattttcagtaaaacctgggttgtttctgccattgaaatatcagccatgaattgaattggtattttgaaacattttcatttgattcctggctgccaaagaatgattttgttgcaggtgttttttgagatttatgtacttaatatgtggtaggttctgtatcacatatcgttgtaatttgaagtgtcaaagtgtcatttcctttgcaaactttaatttttttttttttttccagacaaggtctcactctgttgcccaggctggagtgcagtggcgtgatctcagctcactgcagccttgacttcctgggcttaggtgatcctcccacctcagcctcctgagtagctgagactataggtgcacaccaccacggccggctaattttttgtatttttagtaaagacaaggttttgccatgttgcccaggctggtctcaaactcctggactcaagcaatccgcctacctcagcctcccaaaatgctgggattacagtcatgtgccaccatgcccagccctctgcaaactttacagcaagagtagtctaagagatgtggccattccacagaaaagagagttactatacactatatccacagtgtcttcatctgtttattattgctataaaggaacacctgagggtaggcaatttataaagaaaagaggcttattcagctcatggttctgcaggctggattgttcaagattagccatctggtgagggcctcaggctgcttctacccaaggtaggggaagggaagccaacatgtgcagagactacatgatgagagagaaagcaaaaaactgaaggggaggtgtctggctctttataacaaccagctcttgctggaacttaaagagtgagaactcacctccccatcccctgcagaaaggtattaatctatttttgagggggtgtacccccacgatccaaacactttccattagggcctcaccttcaacattgggatcaaatttcagcatgaggcttgggtgggacaaacatccaaactatggcaatcagaataatgagaaacaccaaaaagtaaacttccgcagggcaaggattttatctttctcattgtatttttggatcctaaaacaggcctctttgcatatagtggttgttcaataaattaactgaaataattatcatcggccccaagatcatcatcagtatttccattgcttatgaaaatactgacacatagaacctgggtcctgccctcctccaaaagacggtcttaaaaaaaatgtataaacttagtgggtacaagtgcagttttgatacatgaatacactgcatagtggcgaagtctgtacttttaatgcaacacacatcacccaagtagtgtacactgaacccattcagtaatttctcatcctttaaacccctcccacctttaagtctccaatgtctatgagtccacactgtatgtccatatatacaccttgaggtacagtaaaaatgtgacattaatcttatgaaactaccatcatatatgcagcccgtcattgactggaaaatcattatgcagagcatgactgtacttctttagcctaaacaacctacatgccaataaaagtttcactgtttcttgattctgtatctttcaaaatgtttctttcttcttgaatgcctccctcattttccaactattcatcaaaatagtataaattgttcaagtgatgggtcaatctttttctctattccctgacttaccttaattaaaataactctattacatccacggatacccagagtactttatttagtacctcttgtaaacaaatattgtatgtatacagggtagttacataccaaaaaaacttggaaatgaaataaataaaggtgttctccaagataaaattttaaacattaacatatatttcaataaagtgtcatcttttcaaaaatttctggtccacaagcctggtccacaagccaaaccaacacaaaactaacggcatttacttaaaaatatattctcaaaagaattatattaagtagaaaggaggtggggagaaatgagaaatattcaaatactcaacaataaaaactcagtgagtataccaatagtcacagcagtattgttcataatagccaaaaggtggaaacaaccaaaatgtccatcaatagatgaatggataaacaaaatgtgatataagcacacaatgaaatttatttagtcttaagatggccggaaattctgatacatgccacaacctgaatgagcttggaagacattatgctaagtgaaataagccagacacaaaacaatacatattggatgattccacttatacaaggtacttagaatggtcaaattcctagagacagaaaatagaatggtgattatgagaggatgaatgatgagggaaatggggttattgtttaacgggtacagcatctgtatgggctgattaaaagttctggggatggatagcagtgctgattgcataacaatgagaatatacttaatgccactgaaccatacactttaaaatggttaaaaaggtatattttatgttatatatattttaacacagttatataaacttagtgaaggaagagttgacaggtctcacccaaacactgacacaggtacagatgacccatgtccatcttatagatataactttaccgtgaaaaataagcacataaaactattagacgctgggcgcagtggctcatgcctgtaattccagcactttgggaggctgaggcgggcaaatcacttgaggtcaggagtttgagactagcctggccaacatggtgaaacctcatctctaccaaaaatacaaaaattagccgggtgtggtcacacacgcctgtagtcccagctactcaggaggctgaggcaggagaatcacttgaatctgggaggcggaggctgcagtgagccgagattgtgccacagcactctagcctgggagtcagagcaagattccatctcaaaaaaaaaaaaaaaaaaaaagctattagaacctagtacaactaaacaatcaaaacagtaattcccctcttcctaagttccaagcatgaggccagaatgctaaataaaatgcaattccttttttcttcttcaatttccagctccaggggctatgaacaaggagtttctactataaaacgtaacttataatattgcaattctcacacaccaaaatccaagaaaatggtatctgagaaataatttttgaaaactcaacagcacaccttctagggattgatacagctactaagtatcacagaatacctactatactcaagatactatgctaacaaattaagtccaatgaagtataatactatcctcactctctgggaatacaatgcagtttgggactaggtaggtaagcattaaaaactatatacaatatgaagcaacatatacaaggttcaaaatgagtggcacaaacaacagattttaaaggagctaagacaagaaagaaacctccagaacagacatgatacaaactttcctataaacttgcctatagatttcaagaaacatcagttctctacttgattactgtccttctccacagaagtcttccctaattattctagcctctgtatgtcatttgctgtactctacactataacctatattcaattttcttatacaccagcttgtcaccataacaactgagctaacaaagtacattattaagtataattctgtacataaagaaagtgctccataaagacccaatgaactgaaatgaatgcttccgttataagctctcaggaatgttgcctgcatacataataaagcaaacaattactagttaatgtctgtaatacagataattttgggggtagggaggctgcatagaggaggaactgtatctcatcatttattccactccaaaaagtattggcattatggatatggcaggtattcaaccattacttgctgcctttattttgagacaattctatactttctaggtgacccagtacataattttgtggtttcctgcacaaggagataaagaaagcacgaactgatctaaaaccaagacaactgtcggttatgatgaaatgttagttcttggtagatttctaggagtttttgagttttgcttccctgatttctcttacttggaagaggcccagaagttatcagtacaatttggattagtcaagtaatagtttagctgaatttatttgtactgtaaaatgtaacaactgtaatctgatttttaagaactttaaaataattaaacatttcaagactaccaaagataaactcacctacaaaggaaaaataaagcaaaatatgatctgaagacaatatttagagaaaataactcttccaatcacttataaaagtagagaaaaagcaaagttagtaattttgagaaacagaaattaaaacaagtcccaagggaacagtaagggtctcaggccctagaaagatccatcatttggcaatcaaaatgattactaatatgctaatttttttcttggagataacatatacatgattttaatttttctagaaaatgggtaatttttattgttatatttagttttaaaacattttaccctaaaaagaaggactctgtaaatataaggccgaagttgtaatttttgcagcttatgtatggctgtgattagctgatgaatgaaatgagaagtgaaaaactttgacttgcctaagacagaatctgattttcccatacgattatcagaaaggagtatatcattaatcatttgtgctaccatgcaatcatataactccactaagccatttatcacagatctgttttcgctaacattctagaactagaaattaattctggcagatctaagtcaatttgctatctgtacagaagccgtaatttctattggtgaaaggaatgaaagagggtacgatttagaggaagagaacatccattaatgctaaaataaagggatgacacatacacacgcatttaaattcaagagttaactaatggagcttgaccaacaccaaagtgagagagaaagaacatcatgaatgcagtgtaggcaattttacttgatattcctctcagtaagattataccctagaacgagcataagattcaaaacaaaaacatgctatccacagtttacctcaatttaggaatgccttttaggaaaaaaaaaatagaatacatttacactgtgtatgattcaagtattgaagtcacaattcctcattttcttttccttctttctttttttttttgtttgagacagggtcttgctgttacccaggctggagggcagtggcatgaaccctgatcactgcaacttcttcctcctgggttcaagcgattctcctgccttagcctcccaagcagctgagactgcaggtgcatcccaccatgcctagctaatttttgtattttcattagagacagttttgccatgttgaccaagctggtctcaaactcctggcctcaagtgatccaccagcctcagcctcccaaagtgctgggattataggtttgagccactgtgcccagcctacaattcataattttagatcaatataaactccaaatatactaacagcttcatccagtggtcagctggaaaaaaaaaaaaaacaaaaaaaaatttcttccaatcttgaaagaataagctgctttagatgtaagatttaattttatattacctctgtaattatacagataatttatcaatttcttaagacatccttggtaataccagattttttccttatgtgttaactttagaacccagttatcacatacgatgtacatatatgtactaaaaaactatacatgataattaacatatgctaaatatctatctagttttatttcttaaagcaataaataatagatatgtgacttctagtctcccactaaactgtgattgtttcaaaaataataacttttaaagtacattctcttttgctaaatacagaaaggttagcctgaaatacctttgtgtacagtaaataccaacttgggatattctgtagtggagcgaaatcttgaaaaactgtaggaagataggtaaataataccaacattcttgtcacaaataaatcacaaactacatacagtagttaaatagacacaataaagtttagacaatcccattcagtaatggtaaggtggcataaacattaaaaagcattaaaaaatacaaacaaggatatttggtaaagcataaaatttggaaagtacttctcagagtttcctaaaagttcctataaatatattaacttttggccgggtgcggtggctcacgcctataatcccagcactttgggaggccaaggcaggtggatcacctaaggtcaggagtttgagaccagcctgaccaacatggtgaaactctgtctctactaaaaatacaaaattagtggtggcgcatgcctgtaatcccagctactcggcaggctgaagcaggagaatcacttgaacccaggaggcagaggtggcagtgagctgagatggtgccattgcactccagcctgggcaacaagaacgaaactccatctcaaaaaatatatgtatatatatattaactttttattcaaaataaggcctgtaatttcccacttccatttagaatcattttcaacatatagacatttatttttaacaattaaacctgactgcctataaaggttgtgcatatgagtctgtgggtatgtgactacatacagtcaaaaaaattattttccctactacaaatacacacagattttttttttttttttttgagacagagtttcactcttggtcttggctcactgcaatctctgcctccgaggttcaagtgattctcctgcctcagcctcccgagtagctgggattacaggtgcccgccacgacgcctggctaattttgtatttttttagtagagacggggtttcaccatgttggccaggctggtcttcaactcccgacctcaggtgatccacccgcctcggcctccttaaagtgctgggattataggcatgagccaccgtccctggcccaaatacatacagattatatctgtattaatatcatatgatttttgggtggtggtaacggggagtgggtatcactgacaagccttcttagactcatgaagcataaaaaaaaataaaaaggaatcccacacaatcacatttttaaacagcataggttatggccagctgagaaaaaaaagaaaaaaggaaccatcgaagccataaaatatataaaatatataaaatatatcctaccttggctttctgagtagctgggactatacaggtatgcaccaccatgccgagctaaatttttttttttgtacagacaaggtcttgctatgttgcccaggctagtctgaagctcctggcttcaagcaatcctcacatcttagcctcccaaaaagctgggattagagacataagccacagtgtcctgcctatatttggtttttaaggagtacaataatatcaccttcaagttattgtaaacatttaaatagtaagaaaatattatcaacaatgaagtaataggatttagtctgtatcagcactaaaatgacaactcctgatgtaagaccagagggctaaacatgtgcagagaatgcaagatatcacttgcacacaaacttaagatacataacatagaaatactttaatgaaaacagatttaaacccacaatttagtactttcaacagccaactatgacagtcttatacatttcttccccaaataaaaaggaatatcactgaactccacaagcttttttaaaaaaaatcaactgctgctaggtgtaataatatggcatagagtaagaaaatcaaagcacatggtatatttgatgagtcatgttccaaagaaaatagtccattttttaaaaaggtttaaaagaaagttccatgaggataagaagaggattcaagtttttgtctcagagaacaaacggattttaatcacacatactgattttaatcacacgtactgcttttaatcacacgtactgattttaatcacatattacctgtttctagacttaatgaaccttgtattacacagttgagcaaaatgtcccaaataaaacagccatatagagtctcagagcgggggaaaaaaagaagtatgctaacatcagaagaacatacctaaataaataaatgttatttttatttcaacctgccattgcttagttactttaactaagtgactattcaaaagtaaactgaaccaggagccacaaccagtgaactatttcaaaagtaaactgaaccaggagccataaaatgccctaacatctaataaatacaaataaaccatgccacactgactcaacacaaaggagaccttcataaacaaatctctccatactttaaaaatatttggctaaatagatgctagaggtttcctaaaacaagataattgtatttttctacatgtcagctagtttatcatcaagttttaggtatagtttacaaacaaagatttaaaatcaaaactacctacacattaataaacaatacaggtgaatcaagattttgctttgattgatatataagatttagtatataacaaaataaaatattttccctagaaatatgtatttttaactactcaatttgattagccttataagtcaaagttctgtaaaaaaaaaaaaaaaaaagtaatgaaatgagccaaaaggtcttacttatctctattactttatcaggaatcagctatttaaatctaaattccttgctgtccattacacaaggcattaacaatattgttatcataacaatactttaaaaaagccttacgagacttagaataaagtaattatgcaagtacaaaataacagaactgctcaaggtctggaataaatattcacaaaatctcatacaagcggtgtcttttaaaaatattacttttctgataatgtcaaaaggcacctcaatagtacatttgtgacaataataatgcacttttttatcaccttgcaatgagtcattactttttctcataaaacttaagggaaaatattctcttataaagtacaaaacaatttgctttccaaattatagtgctaatcattcattttttttctgacaccactacaggcagcaacaatagaaattaagagaaaattggacatgtatataaaggatgaataaagaaataaatgcaacacatttacactattcagtcactatgactttctctagaacctactattctcattgctatggtctaaaaggcccctaaaattcatgtgttaaaattttatcaacaatgtgatagtattcagaggtgaggccttcagtagatgattaagtcatgagaatacaaccctgatgaatggaattagcaaccttaaaatggagcttgaggaaatgagttcaccctgtccgtcactttcgccatttgagaacacagcattctctcctccagaggatgtagcaacaagcacttgacaacagagaacaagccatcaccagacaacaaactttctgcaacctttaagcgtggatttcccggccttgagaactgtgaagaaataaatatctattctttataaattactgtctgtagtattttgttataaaagcacaaacgggctgacacattgacacaatttggttctagattaaacaggtaaaaacgaggcagtgaaacagtattactttccaggcaagtgcctgtctattcaggcagagaccacgaaacaaaattaacaaaatttaaaatattccaaaacacattctttaaaaaaagcttattagaaaggaaatcctcaaaaatttggcatcaagatgtagaaataggaaatttcagccatcgtcttcctgcagaaacaatattgtcaaccacccacagatgacagtagctttgtgggagcccaaaagtccagcagatatggccaacaccccagtagaaaaaaagcttaaataaatagatgcattgaaaagggtaagaacaatttcactttagctatttcttcatccctcccctaaagccgcacagcccagtgccaagagagatccaatcagccttggatctgtctcacaaaggaaagtaaaagcatagtgagttcctgtcttctacagctctgagagtcactgcctaagaggcctacttctttctcaccccaccgacaacacacagaagactcggaggagaagctagaaacaggagaaaagggtggggactcaaaacaactagggcacagaacgcaacaaagcaccatggtttctgctaaatgcctcccacactccaccaagaggtattcccaagaacatctcacctatggtcccatctgccaactaggctatatgttcccctaacataccatgcacccctctctcctgtacatggcaccctatatgtgcccctgcagacaatacatacaagcatccacagacttggtttgattctgaacatttcaggacactaccgtagagaaaattaaaggaggctctcaacaatggacctacctttgcaggattgagagaaggaatgtaaacctaagatttcttccctgaaaaagggaagaagtagagtagttatatccacagaaaaggtctgaaggacctccagaatccccacctcagctgactggtgaagtcttttctcctgaagccagtcactacagagcaaagaagataacatcttctttgaatgtgaagatggcaaggcaaggcttcaaggaaaattaaaaaaaaaaaaacaaagaaatatgataccaccaaagaaacaaagtaaatttctagtaactaacaccaaagaaatggagatctatgaattgcctgacaaagaactcataataattgtttaacaagctacaagaggtcacagacaactcgatgcaaccagaaaaacaatatatcaacaaaatacaatcaacaaagacaaaaaatgcacacacacacacacacacacacacacacacacacacacacgaaattctggagctgaagaacaccataaatgaaataaaaatgtaacggccaacttcaatatcagacttgataaagaaaagaaagaatctacaaactcaaaaacaggtcatttgatttccagtcagaggagaaaaagaaaaaaaaagaatgaaaaagagtgaggaaagcctgcaggatttatgagacaaaatgaaccaaaccaaaatatgcatgatagaagtctcagaaaaagaagacaaaaaggatttatgggacaaaatgaaccaaaccaaaatatgcatgatagaagtcccagaaaaagaagacaaaaagaaagaagcaaaaggcttctttagataaataatgccttaaaactatccaaatcttgagagagatatggacttccatgttcatgaagctcaaaaaatcaagaccaatccaaagaaaattacactaagacatgtgctaatcaaattaccagaagttaaagacaaagtaagactttgaaaggagcattagaaaactgactcatcagagacaaagaaacaccaattagcctatccacaagcttctccctaaaaatgttacggaccagaagaaagggataatatattcaaagggctgaaaaaaaccatgtgaaccaagaatactataactagcaaaaatgtttttcagaaatgaaagagagattaaaaactttcccaaacaaaagctaagggagttcaaaaacagtaaacctgccttacaagaaatgctaaagggggttctttaacctgaaacaaaactattctaattaataacctgaaaacatgaaggtataaaactaactggtaaaggtaagtagatagtcagtgtcagaatattacactataacgatgatacacaaatcatttttaactctggtacaaaggcttaaagacaactattaaagtgactatagccataataatttgttaagtatattaagataaaaagttgtacattgtgacatcgataacaaactgttggggtggggggaataaaagtgcagagtttttgtatgtgagggaatttaagatgttatcagtttaaaaaagactgttaaaactataaaatgtttgatatgtcttatgaaaaccaaacacacacacacacctctaatagaaacaaagagaaacaacaaatagaaagaaatcaaagtatgccactataaaaaaataaagttacaatgaaaaacacaaaagaggaagaaagaatcaaaggacctacaaagcagcaggaaaaaaattttaaaaaatggcaatactaagttcttatctatcaataattactttaaattgcaaatgaaactaagttcttcaataaaaagacaaagtgggtgaatcaataataaaacaagacccaactatatgctgccaacaaaagactcattttaactttataaacacacataggctaaaaggggatggaaaaaggcattttgtaaaaatggaaaccaaggagacagatttgagtaattataaaactccaatctcctgcaaaactggctctgtgttaattactctttctctactggaattcacccatcttgataaattggctctgcctaggcagcgggcagggtgaacctgttgggcagttacaaatttggaggctcgtctgggattgcccttgtggctgcctgcctgtggttcagtagccccctctctggtgatggatccaaaggccagcccaagcggccacagttgtcttggactgggggctgattctggcaatctctctactggcagggtgctgccaatccaatgtgcatgaatttaactgcaatagagaaacagtcctggggagacgtcccataactgtagccctaccacagggtgtctgtctgtagctccatggcagggtatatgtctgtagcctggtcatggagtgcttatagctgtagccccactatgaggtatctggtttggtgagtatcctaggtactgcccacacctccttccttctcctgatcagtttggatccttcaggggtgttggtttttctgtagccccatggtggagtatccgtctgtagccccactgcatggtgtctgtcttggtttggctccatcaggggtcttggttttcctgtagccttgtgtggaggtgtctgtagctccactgcagggtgtctgtcttggttcagcccctttgggggtctcagttggctctccctaattagtaggaggagtcttggttcagcagacatctaaatcaggaagatttcagggagatttctcagacggaaaatagaatagtttagaaaggatactctcggagttcttggttagggatctggatttggaaggccttctgcctatcgtgtctttgtgtgtgtgtttgtttatgtgaagggaatctctggaggaattgctggcacaagttcagcaggcctaactcagagaaccctccttatttgtctggtcacattcggtgagccctgaaggaagctcaacaggcctgactcggggagactatccactcttcgtcttacccagcaactacccaatgaattaccattcggaggtcatccctccccgcctggagtgaatcaaaggcaacagggaccaacaggagaaagctgagccttgccagtttaatactgggtgctgaatgagttgactagtgtctgttttgttatatgtattttgctttggctgggatggaaaatgttaactcagttccccacacagtctgttgggcagcatcttgcaaaattgagaatcttttgccaatagttccataaaacagaaaagggtgatttccttttgtaaagtggcttgacccccacagctatgccacagtaagcagggtcatcaaaaaccgctccatttttctggaagctgcagtgaaatggaacccggaaacctggtatgccggcaaaaagggtaagaaattcttaccagtcaaaagtttctggtgtgtctctctctctcgctctgtgtgtgtgtgtgtgtgtgtgtgtgtgtgtgtacatggtaaatgtcaatatttatctcctctgcaagggtttaattaatagaaaaaaaggatttgtgagactagtcttaggctgcagcaaatctggtgcgctttgtgctaagaatgtctttcagtgtcgttctgtaatggagagagaggtatcacaggatagaacatgggtttaggacccctataagcctacctttcaagccagcctggcaggctggtcagttacaaactttgctaggggtccctgaaaccaatactagatgaaactttgtcttgttttatgtccttaagagcttaaccttgtgaccatgtggtgatactctctcttggtttccaccatccagaagacacgtgattttagtaattttctgggaataaagacagttttaaagactactggtaaaattaaaagtcctccaaatttagacatttggtctaaattaaggtcaggtatcagatttgctaaatgctttaaagtcataaactgcttctttgacttttgaaaattgttcagtttacctaatttggagcattagattctagataaggcctgggaacatgtggagttagcctggctccccagctatgctggaaagagtaagacctcatctgcacttctgtctgatgtcttaggctccacacctagtacataattaaaatcacttatttatcagctttttcatcaaaaataaaagttgctaagagttaaacactgtaacatgtaattgagactactggagaaacagcttgacatacaaggttgcaaggtatagaaggaaaaagtagaatatggttttgctgggagatcaaaagaaggcatggggatatggttttcgtgaaagacaatgtaattttgtgtagttcagagggttttaaagattgtctcaacctaaaagagtaatgggacaaaactgaaagtttaagcaggttgaaaagggtgtgtgaagggttgatcctgtaaaaaaagttctgggggtataagcaagttggctaaggtttgaagggtattatttttttctgcaggttgaacattaaaataaaagcacactgatatggggccacagtctgggcccatgtgtctgagtaacagggttttcttagaaaatttatctgctgtttaacagaaaattataaagagatctaaaaagtttatgaaaatcttaccttatggtaaaactaataaaaagtggatggatttataaaattttatttaaaaactagctttagcattaaagatgcactaataaaaacataaaatttttctcttttgaaaaagatttttatgtaatattgagagacaatgaaagatttttgcttgccttttgagtaaactacaaaaaatggggagagagaagaaacagattcagttggcctcagggtgtcttcattgggtctaatatattgtttgaaaagctgagtctcctaacagagtaaacgtttttctttttaaaaatttttgagttatcattttggccaaatgaatgaattatgatgacctgaaattctattttgtgatatccagtgttttaaacctttgatatttgacaaactttccaatatcaaattatgaagtatgcatttttctgacctaattaatcttttagatattatgtcctctaaagaccaaaaacgacacacttggtttatttggtataaaaatcataaaagaaacactatcaaatatgaaatggtgtttggctttctttgtgctatatttgtgtaaatgtgttattggtatatgttgcaaaattatatgaaagtcataattctgatatgacttagtatatggtaccagtaataattatgttaaattattgtgtgccacaaaagtaacaaatttccttgtcaattttgtctttacctgtggctaagactttttgtcatccacagacaattgttgtcttgctttgatcctctttaaatggtgattttataatcagctgtaaaactctaacagatgttcttaaatgcaggtttctgataactttgaagatggcaacagtagaatgaagggaaataacttttaggactctcatggagagctgatatgttcatgaatatcaagcaaaacaggagttaactgaatggactgaactaacagataatgaaggccaggtgcggtggctcatacctataatcccagcactttgggaggccaaggcaaaaggactgcttgagccgagatagctgagaccagcttgggcaacatagtcagacctcattgctccaaaaaaccttttaaaattagccaagcatggtgatgcacacctggagtccaccctactcaggaggcttaggtgaaaggatcacttgtgcccaggaggtggaggttgcagtgagctgaaactgcaccactgtactccatccatctggggcaaaagagtgagaccctgtctcagaaaaaaaaaaaaaaagagagagtgccatttccataaatgtgtgaattttccaattttacttctgctagtgagtctaacttcatcctgttgtggtcagagaagatactttgtatggtatctcttcttaaatttgaggcaaaaatttgtgtcctaaaacacgatctatcctggaaaatgttccatgtgtaactgagaagaatttgaaaacaaaaaagaaaaaggaaacagtaccagccctttaaatcccctggaagtcacttgtcaaaagaagagcagtttgaaacaatggtggaaggtataacaacaatggctgcccacttctttgtctggaaatctgagatcagaagcagcaatcggcaatcagagcacagatccccaatatttggagaacaggctcctaacttccgcaacgtaggtgcaaactgctccaggaatatgtacatggctgcctatcacggggctgggtgtgagagacagggagctggtactgtgctaagagctgaaactgaccaaaacaaactacatttatcatctaagccttttcttggaaactgtaagcattaaacagtctccagagttccaaaatagtcacattagattctaccagtgcaactgttgtctaggtggggagacagattcttattgcttcctactcagcctcttcccataatcctccaatagattttcttaaataagttttcctttatttgctatatgaccttaggaccatttccagagacttaaaatacttgtggagcatctcatgctatcgtttcagaagtcatctttgactatattattttctcttcttcactgagtattaaacaagccttgcattcctggaataaagtccacttggtcacagcatatgatctattttatatattgctagattcaaattgctaatattttgttaaggatatttttatcatcttcactgggaacactggcctttttttccccctgtaatgtgtttgcctgattttaaggtgagaataatgctggccttataattagttggaaagtattcctcctcctctattcactgaaagactttgtgaacgatgggctacagatagattagcgctgtaagggttcaaaagaaaacactgtgtcttgaaaggactgatacagttggtgaaatctgacctgcaaaagccagtcttaggagagaggggtgaagaaataccataactaagggaacaaatatgagaaattttaaaacaaactaaggaaataagcagcctactttgcttaactcagcaacttctggtacattggtaataagctactaaaacatgatgatagaaagaaacatacaaggaatttatatctccaattttcaattacttcgtgaagaataatcacaccactataatcttactaaatagattaagtaaatggattgtaccattcttgtacaatgtaaacatggtatcactacatgctatgtaccttttaaataacagagcagaaggcatttgatattcttttagcctgtgaaaaataaaagctcacttttttatatttagagaatatccagtgtaaggccatttcactaacatatgctgtaaatgtcaaacacttgctctcttagtcttctttgcagccagggaaaggcacatgacctaacctgtatcgatcagccatcagctgaagcatgaatgggtaaccggaagcaatagtcaaatccaattttcaaagcacattctggcagattctatagctatatcaaactctaaaaatacaatctaatgcatagtgacagaaagcatatcagtgatagctgacagagggaggtgcatggagaagagcaggagggagattaccaaggggcaataggaaattattagagttgatgaataattgcattatcttcaaaagtgacttcataggtgtttagatatgtcaaagcttttcaaatgtgtgtagttttattttttattattattactattttagactcaggaggtatatgtgcaggtttgttacatgggtatattgcttgatgctgaggtttgaacttctaatgatcccatcttgcaagtagtgaacatagtacccaataggtagtttttgaacccttaccccacttcctcacttccctctgtagtttttaataggtgtagttcactgtgtgtaaattatatctcattatacctttttgaaataaagaaaataaagaaaagacagggaaaaacctttgctacaggggtaaggcaataatcctttagatacacaccaaaaaacacaactggccgggcacagtggctcatgcctgtaatcccaggactttgggaggccgaggcaggcggctcacctgaggtcaggagttcgagaacagcctggccaacatggcgaaaccccatctctactaaaaatacaaaaaaaatagccggacgtggtggcgtgcacctgtagtcccaggtggcgtatgcctggaggcatgagaatcgcttgaacccgcgcagcagaggttgcagtgagccaaaatcgcaccactgcactccagcctgggtgacagagcaagactccgactcaattaaaaaaaaaaaaaaaaacccacacaattaaaaaactaacgaaattgttaaacctgttttttttgaaatacacttataaagtaataaaaaagccacagattaaaagaaaaatatttgcaaatcatgtatctgaaggacttgtatccagatagattttttaaaatctctaaaccaagtaagaaaaatctaatttaaaataaaaatccaacttaaaaaatgggccaaagaattgaagaagtacttcaccaaatgagatatacagatggaaaatgagctcataaaaatgctcaatattctaattcattagacaaatggaaattaaaaccacgagatgccactacactgtagtccaatggttaaaattaaaccaattgtcccttcctagatgttagtaggatgtggaggcaatggacctcactctacttgaagaaatggtgtacaatatatttgaaaaatactttggcagtttattccaaaagttaactatatacatatacatacttaaataagtccaggccattcagcttctacaaatttacccaagggaaatgaaatcatgtgttcacacaaaaacttgacacaaatattcatagtaacttaatttataatagccaaaaaactaaaacaaccgaacattcatcaacaggtgaacagataaagtgtggcatatacatataaatggaatactattcgtcaataaaagatgaattattaatcaatgcaataacaaagacagatctcaaaataattatactgagttaaagaatctagataaaaaagaatattgtatgactccatttaggtaaaattctatacaatacaaactgatcttgtattagtttcacagggctgctgtgacaaattaccagaatcttggtggttttaaacaacatagatttattctgttgcagttctaaaggccagggtccaaaatcaaagtgttggcaggattggttcattctggaagctctgaaggattatgtattctgtgtctcttgcctagcttctggtagctgccagcaatacttggcattcctttccttctaaatttattattccaatctctgcctccatcacatcacctcctctttatgtctcctcccctctcttctaaggatatttgacattggatttacggcccgtcctaatacaggatgatctcatctgaaaccctcaattacatttgcaaagatggtttttttccaaataaggtaccattcacaggttatggatagacatcttttggggtggggacaccattcaacccactacaaagctctagtgacagaaagcaaatcagtggttatctggagatggggagggattagaggaaagaattgcaaagaggcatgagaaaacttctaaggtgatagatatatccactatcatgattgtggtactggcttcatggatataaatgtatattaaaagttatgaaagtatacgctttgtgacaagaatatgataatttctcatgcctgagtctccggatacagccatcaaatataacctaagtaaccataaattcaaacacgatagaacaaatagttttaaaaagatgtggaattgagaaaggatagcagaacactgagctataaattaataaatgacagaggctaaggaagaatgagttctgctaccccaaaagggaagacaggtaaatcagacagtttacaattagttccctgagcattgtcttctacatagaccctaaacaaatactggtggagtgagtcaatggctcaatgaagcactaattcagagttccctgtgttaactatgaagtggtatttatagatccagggcagtttgggtgcttgttggaacaaagtaaggcacacagaacctcaaagaaggctgcaaaaacaaacagtaatagttaactttttttttttttttttttttttttttgagacggagtctcgctctgtcgcccaggctggagtgcagtggcgcgatctcggctcactgcaagctccgcctcccgggttcatgccattctcctgcctcagcctcccgagtagctgggactacaggcgcccgccaccacgcccggctaattttttgtatttttagtagaggcggggtttcactgtgttagccaggatggtctcgatctcctgacctcgtgatccgcccgcctctgcctcccaaagtgctgggattacaggcgtgagccaccgcgcccggccaatagttaactttttaaggggactgtatgtaccagtacgacaaaccagatttctatagtaacattagcatacataagaccaaataaattaatgttcccacttaactctcatttgccaagaagaaaattttacatggtgcagactaaaggaggaggaaaagttagaagaaagaataagaggaaaagagtaggaacctccaaaggctggccccttccaagcctcttacaatatctacaatttggtgatgcattggaaaatatgctgaacataaaaattcctgccatattatttagaaaccgccaaattaaatacatatgcaaaaggcatttttttctattccacagaaagttcaaaggtatgtgtgtatatatatatatatgcaaatagctctagatttatctatgaataaaccttataatgttattatatggaaaatatattacatgttaaaggaccaaaaaataatccttgagaaagatcaaacatcttctttaatgagggagatttattaagcagcaaccatttgttctagtgtattgagtttaattcacatgactagcagcttgatttggcagtctcaatgcataagacaaataattcataaaagtttgacagtattatttttagctcgcatgcttcttggactcagcccacaaatgctgctgctttatgctaccctagggactccattcaaatacaaatacatttgttagcaactgggaggctgagggaggcactcagtgcacacaacatgatattctgagaatccaaatttatcatctcatttgggtagacacttagaataattaaaaaatgactgttgttgcttctacatggactcaacgaagtaagatggtataatttaggccacataacattatgtactagaagcatgtttctagtaaggattatggttaccaatgatcattacctagtaagtttaacagtttaattgatctctctttcataaaacaatatttgagaatggtcacctaaaacatcttgttaaatgtaaacagtgttttcacataccttgattatattatgaagcacaaaacatttttatttttcatgagggagaaatatatctaaaattagaacttaacacaaacatgtgaatcaattgtttctcaactacttccaaacaaaatatttcaaattccacacaagattctgcaaacccatgagtacaagctctaatcttgacactgaatttggatcatctccatggaggaaatccatgaaccagatgtggatttattcgtccagatgtatttcacatgtatgaggaaaaataaaacatttcttcactgcctttatttgaggccacttaaaaatacactagataaaaatagcaaaaaaggaaatcctacaaatcttgaatcttgagtcttccactattctgaaggaatcatttgttgaattattactaaattaaccaaactacatatcgagtagttttcatattatcaatgcacattaaagttactagtaaatcacaatcaacttaacatcatttttataatcctccatttttctcggtattcagtagccatactaattaaaatagaaaattttaaaacaatttttgctttcacattatttgcaaattaaagagaaaaagtattccttcagttttaactaaaatgtcatgacttcaagatctaaaataaacttctatgcacaaagaaaacatggatctacaatggcaaattaatgatcacaacaaaatttcataaaattagtaatacacctggatctaattgtatggtctcaaaatttcaaattactttaaaataccaatgacacgagttttaaaagctataaatttaatatcacaaaaccaacctccatcatattaagagttcaactaactagaaaaaaacaaaaatggttctgttggcacatatatttcctttgccctctactagagatccttcaaatgcttaacaactctatttaaatgttaaagaaagtcaaatcaggaaaatgggtgatctagttgaaatgtttaattttacccaggaaaagaatgtacacatatactatttagttataataattgtaaacagatataacgatacttattttatatgaaaatgtttaatttactgagacacagtagctagtcatatatcaatgcaaattacagcagtacagatatacacatacgaccacattaaactgaaacagtagctagtcatatatcaatgcaaattacaggagtataaatatacacatacaaccacattaaactgaattaacttttgtacagcttaggttgtcaaggatttaataagaatgttaaaattatatgctgacataaaaatgaatattttaaatttagtaacccattttaatttaataaaatatgattttaaatgatttcacagaaatacttcatgcttgctccaaaaattaaaattctaaacaaacagaagaaaatttccagccaagaaatattttataaataattactttttaatttatggaggagggatggtttcccacatgcatcagaaataaatgcgaagtagtcggcaagaatatatgttttaggcttcagtaaagttgtacaatcactcaaatcatagcaacagtatttcatttccaatactataaagaaccagaagtagatcattttcataaacacatacttaatgcataattttggagtgtgtcaacaacactagagccttaagaatttctctctagaaaaaagtaactgtagttggattttaaatacaaataaagaacaaaaattttacttggctgggtgcagtggctcacgcctgtaatcccagcactttgggagacggaggtgggcagatcacttgagatcaggagttcaagaccagcctggccaacatggcaaaaccgcatctctactaaaaatatgaaaaattagctgggcgcggtggcgcacgcctgtaatcccagctactcaggaggctgagacaggagaatcgcttgaacccgggagacagaaattgcagtgagctgagttcacaccacttcactccagcctgggtgacacagtgagactcagtctcaaaaaaaccaaaaaaaattaacttagagttctgttagagatgttttgtttcactatttaaaaaattctatcaagggcaaaatctcctatttcagaggaaagcagttataagctgtatttagacatcaaatttgaatgacataaattactctgaatcacagaaagatgtagtctctaatttcaagaatcaaagtatgaataagaccagccatgaactaaatgtcacattctacacatgataaagtttgaacccctgatttctaaaacacatctggtctttcctttatctaaactcttgaaagcaaaagaacaagaactgagagtaaagagggcacttaccacctgatatggtttggctatgtccccacccaaatctcaccttgaattgtaactcccacaatttccatgtgttgtggaaggaacccagcaggaggtgactgaattatgggggtgggtctttcctgcaccattctcgtgatagtgactgagtctcacaagatctgatggtttttaaaatgggagtttccttgcacaagctccctctttgcctgccgccatccatgtaagatatgacttgctcctccttgccttccgccatgattgtgaggcctccccagccatgtgaaactgtaagtccattaaacttctttctggtataaattacccagtctcaggtatgtctttatcagcagtgtgaaatggactaatacactaccagacaaggacaatgcaacctttaataagtcagttagcaaacacatctttggggaaaataaaatttgtaaggctcaagaaacagaagacagaagcaaaatgaataaacagaagaggtaagagcagggaaagcaaaatcatgtaaatctgactctgacacagctctttaaattataagtgcattaaagaaaataatatgagaatgttccttattaaaaggaaaacctactgaagtatgctgacaacagaatgaaaaataaataggaaagaagtgcattacatatgtgtacttatcatgaagaacagaaaacaatttttctatcttctcctctcctgaattatttctaaaaagtaacaaaatacaaaacactcttgtatctcatagagatcattctcttattttatttgttgttgttgtttttgagacagggtctcactctgttgcccaggctgtagggcagtggatcaatctcagctcactgcaacctccacctcctgggcttaagcgatcctcccacatcagcctcccaagtagctgggaccagaggtgcacaccaccacatctggctgattttttaattttttatagagacagggtctcactatgttgcccaggctcatctcaaacccctgggctcaagcagtcctccgaaatcaatctcccaaagtgctgggattacaggcgtgagccaccacgcctggctgggactattttctaataacaacatacatgttcaaaaatgacacacattaaaaatcttaagtatttaaacctgaaatatctgcagagaataaataataaaatataaaaatataaacaaacttgtttcatctgatatttttctatagcaattatgatagttcaaataatgagagcaaatataattatcaaagacttctaaatattttaaaaacattaagatattactatatctatttttcagtgaaatatttattgagagcctaacacatgccaggtatttcactataaagactaaagatgtagatggcaaataagcaaaacatgatccgtgcccttataaaggttactttttagtgggaaagtgaaacatacattaggtagagatgtgtggtaaatgtcactcagaaaaattattcaattttatattttctggaaatactaatagaagttttgggaaaattcacaaataaaatgtatgagactggtgtttctcttacatgcagtttaaaaaaaaaaaaaaaactaatgagtcaatgtctttaaaggttagagttccttaagattttctatttgcttttacatttctccagaaaatttgtaattctttgttcaaaattttcataattttagaataaacttgttcaaagctgctattataattttaaaaatctcaacaggtaccctttacattcctaatattgttagtgtgtatttctcttatttattgatcaatgttaggaagattgcacaatttcaaacactggctccaccatttactacttgtgtggctttaggtaggttacttctctgggcctcagtttcctcaattttaaaaaaggaataaaaacagtactttctcccaaagcattactgaaggaattaaattagataatgcatgtatttagaacatgcctgagatataacataataagtgctcaataaatgtgatgtattatttttaagtgtagatttatttgtatatactttatttggaactcagcatccatcttcaatctgagatctcatgtttttctttaattttggaaaatatatgctttatctttctttcagatggcatttcttattctttttattctctggttctaaaactcctattaggcataagttgaagcttctcattctgtcttccatgttcttaacatttctcttcctttcctctttctttatatctacatgctgttttctaggtgacatcctcaaatcttccttcatattatgtaagtctgcctttgcatgattataaaatactatagtaagaactacacagtggcacatagaactcaaaagtttgctgaatgaaaaccgatgacattttaatatcaattattgtatgctttcatttctaagtattgtctgaccgctttcaaatcttcctgttccttttgtattgcacaggttttccattatgatcccattgtcctttttgtctataatcatttcaaacaaatttgtttcacagtctctttgaagtttttctattatcttcagttcttgttgtgtttattatcttacttatgtttgcacattcttctacatgatggtttgttttctcctgtggtttataatgcctgtaaccatcagcaaaggtcagtttatcctgtgggagcctggtgtgcctggagctatggaaacccatctacagggcagttgcatttggacatttgcttcagccaggctccaggagctctcattagttccaaccagggatatgggaaagaggttcatatgcaactcaagtttgtaggaattgtttatttatgcataattttttgcttattttacagtattttttattttgataggaatgactacatcattgttaatgaaattcctggcctcggtgaacaaattaacattcctttagatgtttttctctgaacaatatattcaagtcataccagatatgtatactactatcccaagtactggcagttctaaccttttctataaatcacctttttaataaaggaatgcaatacattgctgtgtatttttagagtaattgtcataaaaataatattaaatacattcaagttgtatgctaagagtttacataatcctttaagtaaattcaaaaaatggtgtcttccatgtattccttgcaaccaccctgggaagaaagggcatggtttactaatcccatttgagacatgaagatctgagatccaaacctactggctcatgtgcacacacagaaatatactacattcccatttactgttcatttggagtacacatatttgatattctcacattggtaactattcttccttgttttctgctaaattctagatactaaatcctgcaactcttcccacctattttacttcttcaattattaacatataacactaattggcactcctaatctacgagacacataatgctataggcattatgaaaacactatataacctcaaacctaaaatatatctttcacactttaatgtttctacaatcaggatgtatctttcaattaatgtcaaaggaaactttctgatgatcaggtagaaaagtaagttataatactactacaaacacaattgtacatataaaatatttgtttatctgggccaggtgcggtggctcatgcctgtaatcctagcactttgggaggccgaggcaggcagatcacgaggtcaggagattgagaccatcctggctaacacggtgaaaccccatctctactaaaaaaatacaaaaaaattagccaggcgtggtgatgggcgcctgtagtcccagctactcgggaggctgaggcaggagaatggtgtgaacctgggaggcggagcttgccgtgagccgagatcacgccactgcactccagcctgggcgacagagcgagactccctctcaaaaagaaaaaaaggaaaaaaaatatttgtttatctgaatattactttggttgaggtatttgcatttgtatgtcattgtgactgaattttaattcatttaattcctggttgtctagttttctaaaaagattatactgtgatactgttctgaaacagaaagtaagacgatacatataaagttgactgtcatataccaggtaaggcatttaattaaatacagtggaaaacatgaaatctttaagaactggttgctgaattacaatgccaggagaggatttatgcatcagaaaaaactcaagatactctcttctaaatttttcaaaaataattgatatattatttttctaaaacattgcttttgtcatattatttccctgttcaagaatctataatggtttcccactgcttcctaattcaaatataaactcctacacaacttgcaaggccctctattacctggcttcattagtttatacaattttaattgtcttttttttttcctccacaattctccatgagctctctgctttagtcagatcagtctctttaagtaagtctccatcttgcttacaactctgccttggtcctcacttcctgtgtcaccctcttactagcaggaaaaaccctgcctagccttcaggcccattcaagtcttaatctacgtcattttgagctcctatttatagctagagacattgttatgtaagttacccatggcatttgtctattcttggtttcaaaactattactttttccaaatttatgttgaatatggaaaacattattgatcatttctctttttcattagaggaaattctattaaaaagaaaagagattgtaaagatagaaaactaaatctcagagtaattaagtgaagtgcccagatcaaagagataaatatttcaagctagtcaaaaaaccaggttagtgatcttttactttcatagtactgatacatgaagtaaggagcaaaacaaaagatatgtatcaggccgggcgtggtggctcacgcctgtaatcccagcacttcaggaggctgaggcaggtgaatcacttgaggttaggagttcgagaccagcctggccaacatggagaaaccccgtgtctactaaaaatacaaaaattagccaggtgtggtagtgcacacctgcaatcccagctactcgggaggctgaggcaggagaactgcttgaacccaggaggtgggggttgcagtgagtcaagatggcaccattgcactccagcctgggcgacagagtgagaatccaactcaaaaaaaaaaaaaaaaaaaaagatatgtatcaaatcctgtgtcctattttgcttttcagctagcttaatataaaaattaaaatcacaaatgggacccattacacatttctgtttattgcatgttgatccactgacattcctctttcctgatcagactgaaagtttatgaactttcaagtgtaagttcacataaatacaaattaggtgtgattattgggagcaggggagatggggaggattaattatggatttgcttagagacacaaagatatatttgaacttgggaaagcagccttaagagtctctcttgggtgctatttccatgttgttgggttttttttttttctggttatacttatgcaatatgactccatttgggatttcaagtaaagctggaatgctgtattctctaaggaattaatactgttcagtttttttgttaaaacaaagaatgtgatacttttggtcaaaagttctttctctggaattcatgataaatgaaaagaatcttggcagtttctatgtcattctgcatctcacaagcaacgtgcaattcttcatgtcactacaacttggttattcactgaaacaactgatcttattacaaaacaagttaaagaaacaaacaaagcctccttcagttcctgccttgattcattattagaattcacctttcctttcacctcacccacaatcccagatatttgaaggccaaatgttgttctctctgaaagacaggacattagacaatttaaacatcagcaaattgagttcagctatccttagtcactgactgatgactctattcctatttgtacatttttaaagtaatacttatgtccttcctggaagttctttttgcattccagattacgacagggactaaagtacaacaaagaaaaaacgcaaaaagtcaagtgtcaggcagaataagatccataagcatacatatatgtaagtctgggtcaaattcaccagggtattaatctttattttaaaattacaagtaatatttatcaaattttgcccaaagtaatttaattctggcttagtatcaaattttaaaatatggtcagaggtatacatttcaaacatatgtaagcagaaaatatttacaaagaatttaaattctataataaataatatttggttgtaccatatatcctctttctaatgtcatgtgataatcagatgtaaaaattgctaccatccattttccatctccaattttagaagatgtaatgtacctgttccccccaaaatcagagatgacataattgaatgagttaaaatttctaaaatttccctagaggaatttcaaagaaaataagcaatttagtaagaacattagaaaatctcaaacatttttaaatggtatacaccctctatctctaaattacctaaggttcatttagcaaataactattgtctttattctgctgatcacctgaagtactggaagaaaaaaaaaaaacaaaactaaacaaacaaacaaacaaaaaaaaaacactcagcatcttcctctgttaaagtcacatctgcaggaaaaaggctactaaaaaaagaacaatctgctgttccaagttcatatcctgccagtagatattttgcaattctcagggtagaacaatgtttgaaaaaaacagttttataggatcaaatatttaaggtggaaattccatactcagaatatttaaatggtagttacattactaattaatatattttactaagtctgccactttgtccaagtctccagtttgtaccatgttttctaaaactttatatgacaaagcttgtcttagtacttcctgttccgcttgtttttcccatggactatatttaccatttatgattctcatgagtaaatactagtataaagaataaagtagagacaatttttctgaaaaaatccagaaaagaattaaagagatatacagataaaaacaataaaggcataagcaacaaacactattccagttgaactgtacttaatctcccaaagcaaaagtttaagttaaataaatgttcatttaactgttcttaggccactgcaaggtcaaaaatagattcaaaagttcttaaccaagtgatatgctgttatcttgtatacactggtcaaagtcattgataagagaacctgacatgtctgttttcacattatttcttcatttattaaagtgattctctgttttaaactctgatggctaaattaataaataattgcttagtaaattggagtccgacagtatgtgaaccaaagaatgtttaatctcctgggataaaattatttatagggtcataaaaaaaccacctacctaatatcttgtggttacaattacttatgtttttatgtttatttcagtgtttctcaactctgtgctgtggaatcaacctgggaggctttttaaattttgcaatatcaagactccatctcaaattgtataaatcagaatatcttggcagtcgggccttagaatcaatattttaaattttctaattatggtaaaaacataaaatttatcatctcatccattggtaaatgtatagttcagtagtgttaactatgtgtacactgttgtgcaacagatctctagaactttttcatcctgcaaaactgaaactctatacccactgaacaactccccattttcccttcccctagcccctggcaatcccattctacttcctgattctatgagtttgactactttagagacctgttataaatgaaattattaagtatgtgtcttctcatgactggcttgtttcacacagcataatgttctcatggtttatccatgttatagcatgtaataggattttcttcttttttaaggctggataatattctattgaatgtatataccacattttctttattctactgacagacatctgggttgcttctacttcttggctgcagtaaataatgctgcaatgaatatgggtgtgcaaatatctttgcaattctccttgaagttcttctggaagtacacccaaaagtggaattgttgaatcattcagtaaatataatttttttaatttttagttttaattttttaaggacccttcatactgtttcccacaatggctgtaccatgttacattcctgctaatagggcaaaagggtctaatttaatccacatcctcagtaacacttgttgttttctgtttgttttttcttctgttttttttgagacagagtctcgctctgtcacccaggctggagtgcagtggcgtgatctcagctcactgcaacctccgcctccgggttcaagcgattctcctgcttcagcctcctgagtagctgggattacaggcgtgtgccaccacgcccagctaatttttgtatttttagtagagatggggtttcaccatgttgattaggctggtctcgaactcctgaccttgtgatccacctgcctcggcctcccaaagtgctgggagctagcaggcgtgagctaccgtgcccagccatgcccggctaattttttatatttttggtagagacgaggttccaccacgttggcaaggctggtctcgaactcctgtcctcaagttatctacctgcctcggcctcccaaagtgctgggattacaggcttgagccatcacgccccgcctgttttttgtttgtttgtttgtttaatagtatccaacctaatgggtgcggtgtgacatctcattgtggttttaatttgcatttctctaatgattagtgatgttaagaaacatccacataataacatccagtcagaaatacgggatcagcactcagaagataatgcatagataggtaatggttgaaatacaattagatgagagacaaaactttcaagtaagactggtttgcttcttccatctaagacagcctgcttctgtctttgaaatctctccaatctctcctttttctatattctttcaatccaattctgctcttaagaaaggatttaatatgacttgaggaacattttttatttctcccagggacatttatgtatgaagtcttaacactgttaaaggaaagatatatccccctcccaccaccacatggtaaggaggatgggataaagccttaagacttagctacaaggcagaggtatgcagggctagtattctcgaaaccaattttacatatgactagcagctgatcccctatttcacctaagactgacaatttttagaaacaaaaacaaccaacattgatataaaaatatgcttttgtacaagccaagcatttacttgggaacctgtagaataaattacagttgtcctcttttacccacagtttcattttctgtgccttcagatctgaaaatattaaacagaaaattctagaaataaataattcataagttttaaatttcataccattctgcatagtgtgatgaaatctgtcaccactccatccagcctcggacagaaatcactcctttgtccagtgaatccacaatgtgtatgctatctgcccacctgttactcacttagtaccatcctggttatgatgactgctgaagtattacagggtttgtgttcaagtaacccttattttacttagtaatgtccccaaagtacaagagtagtgatgctggcaattcagatatgccaaagagaagccataaagtgcttcctttaagtgtaaaagtgaaaattctcaagtgaataaggaaagaaaaaaatcatatgcttaggctgctatgatctatggtaggaataaatcttctacccatgacattgtgaagaaggaaaaagaaattcatgctaatgttgctgtcacacctcaaactgccaaagttacagctacagtgtatatagtaagtgtttagttaagatgaaaaaggcattaaatttgtgggtggaagacaggaataaaaatgtattccaactgatggcaatcaagtgggtactgtccacagtttcagggtgggagtcttcgaacatatactcctcagctaagtggggactaatatatatttatgtattttagagtgcacagctagaactcagaacaggccctaaaaacttgcttaatatttgaattatgagacttttccaacatctcacttgttcaacaccctcaattatgtggcacacagccaaggtcctaaaagtaggccaaacaagcaaactataaaaaactaaaattagatatcacaaatctttattaaaaggcacttgattttcctcataggagaatcatttgacactcactcagttattagatactattagtttacacataattctagcaaattcaactagtcattttccaatttataacaaatgcatttacactgggggtgaagatggagacacgggagtctcagcacgcacagtaggctaggtcagcccttcatacctgcacacttacacattacttgtatgcatcatttactagagtagattacaagaattgaaactctatagaatagccttagtcatcaaaggttaaattatattagtatgtgctctcagaaatatgcatagcttgtacagcatgtagttacacacacacatacacacccataccttgtctccgtttttcttctgctttctgccaaaagctattcaaacctcaaccatttcatgagtcaccacacaggcagctcttactttggctttacctctccctgcttggtttcaccactccaatcacctggctcaactatagaaaacccttctgattttccctactgaaggaaacatcagggttagagtgtcacaaaacactacaaaaccgaaatgaatccatgtatgctcatctttgaaagagaaagtcagggaggaagagttcgacaaacagaaacaggaataagaagggaaacatagggttcagctcacaaatacttgcaatttatttgagtacaaaatattcattcctctaagtagtttatttatgacagacactttgaggtactgtatactctaatcacttgttctactttatctgtctttaacattactaggaaaaactgaaggatttccctgttatctgggtagttttataaatcccgacaataaaaaatctaccaagagaatgtgatatttaagtttttgtattcatatttttaaaattctttttaaaaatacaaaaattaaaatcacttatccctacttgaaaaaagagagagaaatctacttcctaacagtgcctaatggttatagatctccactagttcctgttgtattcagagtcgagtttaatctctctcccctagtcttgactataaagtcttccttacaaaaaaaaaaagaaaaatattttccttacttccactaacataaataagctttattgtctgcattattcagacctaggtataaacatacacatgtaataatagctttttaaaataaaaatgtacatttgtccacatcttgcttttctcacttaacaatgtcattcttttctacacttctcaaacatggtgtatttacctaacaacaagactactgagacggttttcagtattttgctattccaagaaacaccaatgaatatgcttataacaaattagaatctcactattaaagtgtgaatatgaacagcctaacactaatagttagttatagaaacattttatggtttggccaacctgatagccaaaatcttcattcacttttattttagattgcctttaaaaaattatgactgagattgcaggcagcttctcatggtttctggcaatatgtgtttcttcagtgaactgacagtttgtatttttttggttgttgtttagttttactattaagttctaaggtgtttttgatcaaggtaatcaacctttgtatcttttaacttggttgacagtatctaccacagtacactaacattaagaaaatttatccttccaatggcatactagaaaactgttaacctgcctacttactctatctgattagagtctagacactgtgaagttccatgtaacttgtacatttccgtcctagagaaagcagaaacccaaaggttaccgttttataactttttagaaaattaaccaaatttgtatctaatcaatattattctgaaggcatcatttttcaattttcctggaaaggtgaactatataagtccctattattcaaatgctctaatatcaagttttattatcttactggttcctactttaattaaaatgttgaatgagtttttgacacatgttcattctgtattttcatgagagtcatttttctaatgtgtgaaaatttcctgacatttaatttatttgtagatagagctatcacaatgttattcctttaaagcacctgggctttctcattaactgaggaaggtcatctccatctctgcactgtgaaaaaataaaaacaaaaaaatatatatactcatctattttccacagattaaaaaaattttctggctgggcgtggtggttcacgcctgtaatctcagcactttgggaggccgaggcaggcggatcacctgaggtcaggagttggagaccagcctgaccaacatggcaaaaccccgtctctactaaaagtacaaaaattagccgggcgtggtggcaggtgcctgtaatcccagctactcaggaggctgaggcaggaggagaattgcttgaacccgggaggcggaggttgcagtgagccgagatctcgctactgcactccagcctgggtgacaagagagagactgtgtctcaaaaaaaaaaaaaaaaaaattctacttagaattttaccatgaatagtatgattatgcagttttactctttcaatatgtaatgaattatattgatatatttcattataatgaaacatactgtacatctcaaatgaaaactacatagcatattactctctcaacagactacgagattcgattttctaatactttgcttaggatttttgcaaccatattttcccttttttgctatcttcattaagttttttttgtactgaagtaatgccaccttcatataatacagtgagatgctttctatatttttaatatttggaaatagttttaatagtaatttaagaattttcagttacttgttaatgaacgacactagaaagggcagtaagtctataaaactacatagcctcctgccttttatatgtgtgtctgtctgtcatatctttaacaactctagatttaaagaaaattgtaaatatagaatacagtccttatatacccttcactcagcatcctcctatgttaacatcttagagacagggtacagttgtttgaactaagaagttagcattagtataatactatcaactaagctacagactctatccagatttccccagtgtttccactaatgtccttttctgttccaggacactatactgcatttagcatcatgactctttaattgtcctcctctgctctgtgataatttctcagtcttttctttttttcccataaacttggcaattttaaaaagtatgagtcagaaattttgtagaatgttccaaaatttgggtttattttctgtgttctcatgcctagactgtgttacggatttaggggaaggataccacaaaggtgaagtgatcttctcattgcatcatattgggaggtacattctatccacatgacttattactggtgatgtgaatcttggttacttagtttttaacagtccttttcacttcatccatcgttatcagtttgttcaggttttctctctcaagtttcattctgatactttatattttattttaaaatgtaattgtctcatctagatttaataactgtgtatgtttaaaactgcacaaaatgttttatcatttttggtactatctaaatctgtggttatactgcttttctcaaccctaatactgtatattattgttttctttctcttttttcttaggcttctttagggtatacctaatttgttcatttttggagtttcattatcaattatattttggttttctaatttactgtcaccgttgaactctattatgtatcaaaggaatggtatttagatcttgataaatggtcaatgtgttgacagatcaagaaggaaagaggaaggcaaagggaacaagccagatgactacagcaatagaaggctggaaaatatggagcatgtgatctgtaatctggtctagctataatatataatacatgcaggaatgaaaaagaatagatgtaagcaagcaacattaaacaggtgggaataaaatattatatttagtaaataaatactgaaaaattaaacacaaaatttcatacaatccaacaattttacttctgggtatatatccaaaagaactgacaccagaaattcaaacagatatttgtctatccatgcttatggcagtactagtcacaatagccaaaaagtgaaagtaatccaactgtccatcaatggatgaataggttaaacaaaatgtactataatcatacatcaggatattattcatgtttaaaaaggaaagaaattctgatacttgctataccatggatgacccttgaagtcattacactaagtgaaataagtaagacacaagagatcaaataattgcatgattctacttataaagggtacctaaaataggcaaatcatagagacatacaagggaacagagattaccaggaggtaggggcaaagggaaattgagagttttttaaaaaatgaatacagtgtttcagtttcggatgatggaaaagttctggagatgaatagcaacaacagttgcacaacaatgtgaatgtacttaatgcctctgaatggtacacttacaacacttaaaatggtacattttatgtgtatgcatattttatcataatttaaaaaattaaataaatacagattccttactacctggaattaaagattctacataattagtttgaaatgtttttcacatattatgctttactatttactgacaaagtgtctggctctctcaaaagaaagtttaaagaatgaatgggcaaaactgtttcctcttttaggctggtcttaacctcacaatattctaaaagagtcatgctaattcctccaatgcatccttttctattgttgttatctcatcaacatccctccattgcctccacagtccacctccccatctatatctttatcttaaccatcttctaagggtcagttctccatggagtctttcccaataattctacttgatggttctctatctctattttctatccaaaaatccttttgtgtcaaagtatgtcatttgactacactttttagaattttatctattaacatcacctaacagttaaatatattgtctttatctactggaataagaccgaaagcaccttaagagatagggattttggtcatgcttcttttatatccctatatggcctaacacagtgctaaataatacagaacagaatacacaagtggttaagagctcaagatctgctgttactaactcaatataaaaaccacttctaccactaagtaggctacgcaaattatgaggctaagcaagtaacgaggttaggcaagttacttaatctgagtctcttctttctcacttgcaaaatggcaagaataaaagtatctatactttataacattatgtgagcattaaataaaataatgaatgttaaaagaacataagcactcaataaaggttagcattcagtattactattagaagtgtctgatactatttagcctaaatgatgttgagcaaatttctgagaagttgaattataaatgaaactcgattttggtgactctacagcgcactggtgacaaacttgagaaaataatacgattaaacacacacttgtttgtttgccagttctttagctgtcttcctaactacactaccttcacgaagtcaggcattgtatcagttttacctactaccatatagagagcacctaaacacagaagttgggagaagtatactgcgcacaaatttggcattcaaataactactgaataaattaatcaaaaagctaatattttgtaaaattcaaactcagatgcttacattactaacaataacacctcttcctcttttccctgtaagaaaagatgattctgcctccttgaacagtaaaagcagagattatattttttacaaaggtaaccacagaatatcaatctgtttcagtccctgcctattttacaacatgctctaatcccaagaacatatgctagataaagaaaaataatctgtagttgtacattacacactggttaaaaactctgatgactctggcaatagatgaaactacagtactaaacctcaaggtcctaaagaaaatactgctgttcagactgaaaatgagaaacagtatactttggcagttttattaatttataaactcaacttgtagaaaaaagaatgctcaacaaaataaaagttgtgaatttagaaagttgcaaacatttcatctgtttaaaacacgtaggggaaataagtttgttttctttcaaaccacatttgctaataaatacatgtttattttcccgcttcttttcttacctagttctattcagctatcaaaacaggaattcctttccacctgcaccaacgtagatagtatccaaacaattagactacaggctaaaagagtcatgtttcccatgaaatactatttcttactcctttgttaccattttcttggtgataagaagcattgagaaaaatggttttgttatttgcacgcaattttctctctttttttttttttttttttttttttgagacacagtctcgctccatcaggctggagtgcagtggcacgatcttggcttactgcaacctcgacctccccagttcaagcgattctcctgcctcaacctcctgagtagctgggattacaggcatgcaccaccacacccagttaatttttgtatttttagcagagtcggggtttcgtcctgttggccaggctggtctcgaactcctgacctcaagtgatctgctgccttggcctcccagactgctgggattacaggcatgagccaccgcgcccggccaattttctctcctttcttcaaaggaatcaacagctatatatcaaacacatagccatgtgctgtgcttaggaagtgagaaaactaaaaaataaattataagtaaggcaggtgctctcttatatcagctcacacctaattagatcctcctttaattttgttgaaagcaattaattgggaatcatctaacttctaatagggtttgtacacagacatgagaattattcagtttctaatcttctgggaagtaaaccaaaatagtttttccaaaaattatcttgtgaatattaattatgtctctaaattttttacctacggacagcgtctttaatcaaataaaaaggcagtaatcgtagcagtttgggaggccaaaacaggagggttgcttgaggccacgagttcaagaccagccagggcaacatagcgagacccccatctctaaacaaacaaacaaacaaacattaatgaggtatggtggtgcatacctgtaattccagctacttgggaagctgaggtgggaatctcatttgaacccaggaggtcaagactgcagtgagccaagatcatgccactgcactccagcctgggtgaaagaaggagaccccaatctcaaaatattaaaaaagaaaaaaccaaaaagggactggaaaacttaaaatagtcttaaatttcaatacacctcgccaggcgcagtggctcatgcctgtaataccagcactttgggaggccgaggtgggcagatcacgaggtcaggagattgaaaccatcctggctaacacagtgaaaccccatctctactaaaaatacaaacaattagccgggtgtggtggcgggcacctgtagtcccagctacttgggaggctgagacaggagaatcactttaacgcaggaggcggaggttgcagtgagccgagatcgcaccactgtactccagcctgggtgacagagcaagacaccatctcagaaaaaaaaaaaaaattcagtagatttcttaacactcttaacaatatacccttaaacaatttttttagtttttattttaaaattatagaaattcatcaagttacaaggcaatacaatgaggtcccctgtactctttactcagttccccccatggttatttcttatataatacaatatcaaaaccagaaaaatcacattgatacaatgtgtgtatagttctatgtcattttatcacatgcatagatctgtgtaatcaccatcacaatcaataaataaaactattctcactataaagagcttcctcatgctacacttttatagtttcacccaaccccgcccccacaaaaatcccatgactaccattaatttcctggtgacctctacaattgtgttgtttggagaatgctatataaattgaatcgtacagtatgtgtctttttgagactgatttttttcacttacataatgctcctgactgagatctgtccaaatttttgagggtatcaatagttcattactttatattgctacgagatataccatagtatagatgtaccacagtttaatcactcctactattgtaggacattttggttgtttccaattttgggccattgaaaataaaaccatgtatgggattctgtgcagaaataaattttaatttatctaggagaaacgcccaagagtacaactgctgagtcatatggttaagtgtatagttagcattttaagaaattgctaaaccgttttccagagcaactatactattttacaactcctaccagcaatgtgtgagagactgtattaccatatccttgccacctccagtggctgttccttgcccacatttaatattgccactaattttttttttttttttaaagatagggtctggctctgttgcccaggctggagtacagtggcacgatcacggctcactgcagccttgacctcccaggcttaagtagatcctcctaccctaaatcctttttggcaaaatatctttttgtgtcttttgcacattttctaaatgaactgttgtttactgttgtttttaaaaaagattgtgatttgagagttctttatatattctcttgttttgctcttgttgcccaggctggagtgcaatgctgtgaccttggctcactgcaacctccgcctcccaggttcaagcgattctcctgcctcagcctcccaagtagctgggactacaggtatgcaccaccacatctggctaatttttgtatttttagtagagacaggatttctccatgttggtcaggctggaggctggtctcaaactcctgacctcaagtgatctgcccacctcggcctcccaaagtgctgggattacaggcatgagccaccacgcccggccaagagagttctttatctattctatatacaagtcttttgtcaggtggtggtttgccaatattttatcctagtcttttcattctcattacagggtatttagcacagcaaaagttcttaattttaatacattccaatttagcaattttttatagatcatgtttcttgtgtcatgtctaagaactcttcaccaagttttagttccaaagatgttctatgttttctcctaaaagttttatagttttacattttaaacttcagtctattatccattttgagttactctggtaccactgtgagtcttaggtcaagattatttttttggtctaagttttttgtctatggatatccaattgcactggccccacttctgaagaatactattcttttcctttgaattgtttttgtacctttgtcaaaagccaggtggctgtaattggataggctatttctgggtttgctgttctgttccactgacctagtggtcaatggaacaaaccaaatatatatatttggtttctgcccctggttctaacacaaagctcctaaaactcttgtaatttcgtgaacgacaggggtcctaatgtgtccagaattggtgggttcttggtctcactgacttcaagaatgaagccgtggaccctcgcggtgagtgttacagctcttaaggtggcgtgtctggagtctgtcccttctgatgttcagatgtgtttggagtttcttccttctggtgggtttgtggtctcgctggctcaggagtgaagctgcagaccttcgcggtgagtgttacagctcttaaggcagcgcgtctggagttgttcgttcctcccggtgggctcgtggtctcgctgggctcaggagtgaagctgcagatcttcacggtgagtgttacagctcataaaagcagtgtggacccaaagagtgagcagtagcaagatttattgcaaagaacgaaagaacaaagcttccacagtgtggaaggggacccgagcgggttgccaatgctggctcgggcagcctgcttttgttctgttatctggccccacccacatcctgctgattggtagggccgagtggcctgttttgtcagggcgctgattggtgcgtttacaatccctgagctagatacaaaggttctccacgtccccatcagattagttagatacaaagtttccacacacaggttctccaaggccccaccagagaagctaggtacagagtgtcgattggtgcattcacaaaccttgagctaaacacagggtgctgattggtgtgtttacaaaccttgagctagatacagagtgccgattggtgtatttacaatccttgagctagacataaaggttctccacttcctcaccagagcagctagatacagagtgtcgattggtgcactcacaaaccttgagctaaacacagggtgctgattggtgtatttacaatccctgagctagatataaagactctccacatccccatcagactcaggagcccagctggcttcacctagtggatcccgcgtaggggctgcaggtggagctgcctgccagtcctgcgccgtgtgctcgcattcctcagcccttgggtggtcgatgggactgggtgccgtggagcagggggtggtgcttgtcggggaggctcgggccgcacaggagcccatggagtgggtgggaggcttaggcatggcgggctgcaggtcccgagccctgccccgtgggagggcagccaaggcccagcgagaaatcgaacgcagtgccggtgggccagcactgctgggggactcagtacaccctccgcagccactggcctgggtgctaagtcccccattgcccagggccagcagggctgcctggctgctccgagtgcggggcccaccaagcccacgcccacccggaactccagctggcccgcaagtgccgcacacagccccggttcccgctcatgcctctccctccacacctccctgcaagctgagggagtgggctccggccttggccaggccagaaaggggctcccacagtgcaatgggggactgaagggctcctcaaatgccaccaaagtgggagcccaggcaggggaggtgccgagagcaagcgagggctctgaggactgccagcacgctgtcacctctcactaagagcatcttttgttctaatatttggtctttgaccttggttcctgacacagaactcctaaaaccactgagtgatagcaatgataggaacatcttacgtaaagcttctgaattccttagactttgtattagtccgattttatgctgctgataaagacatacctgagaccgggcaatttacaaagaaaggcgtttaatagactcacagttccatgtggctggggaggcctcacaatcatggcagaaggtgaaaggcatatctcacatggcggcagacaagagaagagaacatatatatacagggaaactcccctttacaaaaccatcagatctcatgagacttattcactatcactagaacagcacaggaaagacctgcccccctgattcaattacctcccactgggtccctcccatgacacatggcaattgtgggagctacaattcaagataaaattagggtggggacacagccaaaccatatcattctgccctggccccccccaaacctcatgtcctcacatttcaaaaccagtcatgccttcccaacagtcccccaaagtcttaactcatgtcagcattaacgtgaaagtccacagtccaaagtctcatcagagacaaggcaagtcctttctgcctatgagcctgtaaaatcaaaagcaagtttattacttcctagatacaatgggggtacaggcattgggtaaatacagccatttcaaatgtgagaaattgaccaaaacaaaggggttacaggcactgtgcaagtccgaaatccagcaggtcagtcaaatcttaaagctccaaaatgatctcctttgactccaggtctcatatccaggtcacacggatgcaagaggtaagctgtatggtcttgggcagctccgcccctgtggctttgcagggtatagcctccctcctggctgctttcacgggctgctgttgagtgtctgtggcttttccaggcacacagtgcaagctgtcggtggatctaccattctgggatctggaggacagtggccctcttctcacagctccactaggcagcagcccagtggggactctgtatgggggcttcaaccccacgtttcccttttgcactgccctagcagaagttcttcctgaggaccctgccccagcagcaaacttgttcctggacatccaggcatttccacacatcttctgaaacctaggtggaggttcccaaacctcagttcttgacttctgtgcactggcaggctcaacaccgcgttgaagttgccaaggcttagggcttgcagcctctgaagccacagcccacactgtaccttggcccctttcagtcactgctagagcagctaggaggcagggcaccaagtccctagactgcacacagcagtgggaccctgggcctggcccaggaaaccattttttcctcctaggcctctgggtctgtgatggcaggggctgccacagaggtctctgacacgccctagagaccttttccgcatggccttggcaattaacatttggctcctcgttacttatgcaaatttctgcagctggcttgaatttctccttagaaaatgggattttcctttctattgcattgtcaggctgcaaatcatctgaacgtttatgctctgcttccgttataaaattaaatgcctttaacagcacccaagtcacatcttgaatgctttgctgcttataaatttcttctcccacaccctaaatcaactctctcaagttcaaagttccacaaatctctagggcaggggcaatctgtcaccagtctctttgctaaaacataataagagtcacttttgctccagttcccaataagttcttcatttccatttgagaccacatcagcctgaactttattgtccatatcactatcagcattttggtcaaagccattcaacaagtctaggaggttccaaactgtcctacattttcctatcttctcctaagccttccaaactgttccaacctcggcctgctacccagttccaaagttgcttccacattttttgggtatctttactgcagcgccccactctcctggtaccaatttattgtattagtccatttttatgttgctttataagcaacataaagacatacctgatactgggcgatttacaaaagaaaggcgtttaatagactcacagctccacatggctggggaggcctcacaatcatggcagaaggtgaaaggcatgtctcacatggcagccaacaagagaagacaacttgtgcagggaaattcccctttataacaccatcagatctcatgagacttattcactatcacgagaatatcatgggaaagacctgcctccatgactcaattacctccacaaggtcccccccaacaacacatgggaattatgagaactacaattcaaggtgagatttggatagggacacagccaaaccatatcaggcttccttggtgacaagcgtatctttgctctaatgaagaaactcttggtgggctcctgaatagcttcaggatggggagctgatcaccagaaagaccaagccataatttgaagctggggacttttagccccatctgcattctccagggagtggctggagactgagttagtatttgattatgtgtacacactgaagcctccacaaaaagcctatctgctgaagcctccaaaactgcagggcttggagaacaaacaaattatcaaacctgaggaggatgttgtatggccaagtcagacaaaagcatgcatactccatacttgcaactagcacctgaaatgggaggtaaggtactcttgtgggactgagcctttaatccgtgggaattctaggtaattaatgtcaaaaactgagttaaactataggacactctattggtatccacagagaagtgaagaactgcttggtgtggaacacccatgcatttgatataagaagtgttgcgaataaagaaactgtttttcttttattatctttctgccaatacaataggatgattcttcccacttttttcttctttttctaaattgttttagctattctaattccttcaactttccatatatataatcttgtccatgtactagaaaaatctttggggatttttataagaattgtgttaaacctgtgtatcaacttgagtggaattagcatctttactgtattgagtcttccaatctatgtacacagtatttccatttacttagatctttaattttttccccaacattttgtagtctcagcatataagtcctgtatgtgttttgttggatttacacctaaatacatcatttcttttagtaactgtaaattacactgtattttaaaatttttccacatcttcattgacaggatatacaaaaatacaattagtttttgtacgatctcataacctgtgaatctatataactcacttattagttctagatgtgtttttgtgtactctttggaattgtctatacacataatgatgtcaactacaaacagggacagatttattccttccattttgatctgcatgtcctttatttccttgttttgtggtattgagctggctagaacttccaacagcatattgaatagcagtagtgagagcagacatcctttcttattctcaatcttagggggaaagcattcaatttttcaccagtaagtataatgttaccttcggctttctgtagctgttctttatcaagctgaagcagttcccctctattcctagctttctaagattttttaaaaattataaatgggtgttgaattttgtcaaatgctttttccacatttataaacattttgtagttttccttttttgtctttgtctgcttttggtatcagagtaacacaggctttaaaaaataaattgaggccgggcgcggtggttcacgtctgtaatcccagcactttgggaggccgaggtgggtggatcacctgtggtccagagttcaagaccagtctagtcaacatggtgaaaccccgtctctactaaaaatataaaaattagctgggtgtggttggcggacgcctgtaatctcgggaggctgaggcaggagaatcgcttgaacccaggaggcagaggttgcagtgagccgagattgtgccattgcactccagcctgggagacagagtaagactccatctccaaaaataaataaataaataaataaataaatttctatttttttggaaccaattgtatagaatgaatgttaatcagtctttaaacatttaatataattatctggtaaaatcatctaggtttggagatttctattttgagaattttaaaattatgaattcaattttcttaacagaattattcaaattatctattttatattgggtgagttgcagcaggttgtgcttttcaagtcatttgtccatttcatctaactgagtcaaatttacatgcatagagttatttgtagcagtttctcattaactcgttgatgactgactatagggtctctagtgatatttcatttcatttctgatattgaacattttgtctatttgttctaggggtgtaacaattgtatcatcccctcaaagagccaactgtgtgtttcattgatttttctctagttttcaatttcattgatttctgttttcatgtttattgcttccttcttactgcttggcttaactattctgagcttcttttcctatttttttttttttgagacaggattttagatgatcaattttagacttttcctcttctccagtataagcatgtagtactgtaagtttccatctgagtaatactttagctgaatctcagaattttgatatgttgtacttccattcaatgtatttttatttctttgaaccactatttagaaacatactgttcacttttcaagtgtccagagattttcctattttctttccattatggatatctagtttgattccatggtggtgagagaacatactctatatgtttcaaatttaaaaaaatttttcagatttcttagtggttcagactatggtctgtcttggtgtatttaccatgaacatttgaaaacactgtattctgctatttgtggatagaatgttccttgtctgcgttttccttggaaagtcttcatgcatcccaggataagactgctaatttgcccatcaactggactctttaacaaatgtgactatggaaaaccatgtaagaaactaactcatataataaaaaagtattaatggaaggggagattattcatatcataaactattactacagtaactccagaaaattacatatttaaatttcatttgggaaggagtgtgtattatttttagtttacatgagtattaaaaattacttatttttgggaaaatgttaagattttcatttatttagcccatcaaaaaatattttctaagcactctatcatatacaaaggattgtggttggtccagactctctaggggatcgtaaaccaggcatattgtagagtctccagcagttttttccttgtgttagatcaccgccatccaaaagcattttctgtaatgatggaactgttcttcatctgtgatgtcaaagactgtagtcactagatatatgaggctattgaacacttcaaattagcgtattagaagtgtagcaccagaacataatacaggccccttgcatttattacactttccttgttcaaagctgtgcaagatttgtctgaatttaaagcagataagacaggagtgactgagatacccagttttacattagactgcttcagattttacttttacattttctatcacatgggctaaaattgctcccgtatataagctcctgttcaatcttagctatttgctttatttaatttttgttcaataaaaaggatggtgttaagtaattgtcttcctgccttcattccaaaaatatgactaatcttggccaagtaagttattgtcctcattagtttccctgccaaggaaaaatcaacagaaaatgtcagccttctacatagctccttccatctacattcctgtgtggctactggctagatcattctgctcctacccactgggtgcggattagcagaagtataagtcaactatgatgcagatgctatccggagactcagaagggcaatccttaggtgtggtttccatgaataaaaggcctttggacatataaatataggagattaaacttgtatttcactttgatattgtgatttgtagtaagaaatatacatttggtctttgccaccagttcccggcacagtgcttctaaaacccttgtaatttcctgaatgacaggagtgccaggaccatcttttgttttaatatttggtctgtgactagaaacacagctcctaaaacctctggaatctcagaagtgtctttttttatgctaatgagatacatggtggctaaagtctcctgaagagcctccggttggggaatggcttccaggggaaccaacaatatgattagagcactggaagtttcagctctcctctcctgatgtcttacaaagagggactggcaattgagttaatcactattggccaatgattttaatcaatcatgcctacacaatgaggcctccacaaaaccccaaaggacgaggtttcaagagattctgggttggtgaacacatggaggttctgagaggtggtgtgcctaactggggcagggaagctctgtgtctctcccccttaagtgtcctatgtgtgtcttgcatttggttattcctgagttgtattctatataataaactgacactcataagtaaagtgttaccctcagttttgtcagctgttctagaaaattttcaagcccaaggaggggccatgagaacctcccatttatagctagtcagtcagaagcacaggtgacagtttggacttgagagtggcatttgaagtggggagcagtcttgtgggactgagtccttaacttgtggggtctgtagtaaccccaagtatataccatcagaattgcattgaactgtaatacacccagttggtgtcagaggttggaaattggttgatgtgggaaaaattcccacacatctgttttcagaagataaatattttaagtataggaaaacagtttatttttccttttttattcatataactttctttaaagacaagcaaatcatgattggaggtaaaatatgcccagaaaaaaagaaaaatggaagaaaaataaagacaggtaaatgaaaatgactcggtccagagatgcatatatccttactgtgtggcaaatataaaaatgcttgatctcctcttaccaaaaacacagacttaaatctatacctgtgaataaaagcatagaacccatgtaatagctacagtgtcatgttttgtattcagaaaaggtttataacagtgtttctcgggacccaggaaagaagagaaagctatgttattagaagtcactatgtacactattatctccagctgaatgtaaactgtgctcttgatgggaatagctaaagaaacatcaaatttaaagaaggagtcattagataatttttccatttcaaacagtgctttctgtgcttgctggttttgaccttcttctattccttcagaggccatctccccctctctctggaagagactgtaaataactaattattttagaacaagaaagaggcttgattcccttagctaatgtaatatgcatactagtctgtatgaacgctagaaatcatttctttcaaaagacattacaacttttattatccatcaaactaaatcatcaaaattatagcttccctcaagtttttaataaggtgatgctgcttgataaactaccacacatcttttgtcatcatataaatattttagtttcataactctctcataaatactagtaagtataggattggaaatcctttcagaaagcaaatcatagtgaagcatctatccagttctccaacaagactccccaactgatacattagttcaaaaataatcttaaaagcagtcaccatcaaacttattacaaaacttgcattcatcaagaaactatgccagaaaatttctgagtttaaatgtgttcaaatctgacttcgtagagcatttgatgtaacattcaggatagtaagaacagaagtaaaagctatccatcctctttaagctcttaaccttagagctctgcacctcttcttagaaacatcattcctccaatatttcagcctagatttttctcactgctaatactgcaattctgagaagaaggcaaattaactaaagttatcatcattagcagaggagtaacctgtgtcatagatatgaactgtaccacttctgaatgctttagacatttttcttagcaaagaagtatagatacggataaccagtactataacctgaaatactgcacaaaagcttataatttcttatcttgcatctgtcatttagaggtaaattaatttccttaattgctagagactaaggaatacatttttactctgtatttttcaatatttaagggaactatgttgttaggtcctcctgcaatgtgaaaggactgcaaggtctgactctcacaactaatttaaaaattgggatcattgtagaaagcctcttccatcaaagccacgggttgtaagaataaccttgcttttcaagattagttatactggggcaaaacattttttccttctctctactcaaattcctgaagtcccattatacttttctcaaagaagagtttataatacaaccagcgtgaagtcaccattctctatagaaatggcttctgatatatgaatttaacaaatgataggatataattctataaaacactgatacttagcacttccccacaaaccacataaaacttgtgaagtcaccattctctacagaaatgacttctgatatgtgaatatcataaatgataggctataattctataaaaccactgatacttagcacttccctacaaatcacataaactcgtagactgattttaaccaatacaactatttcacttctgtttgaggaagtattcaaactcagaatttattttgactgttttaagactttgtaacttgagatgtctccaaagagaatggtctaaagaaaggtaccacttggcaatgcaatgatagcatatgtaattgacacactcttagggaatcactctgcaaacccctgaacttataagggtataggtactattaagtagacatctctgctacaaagctaacaggtttgtgaaagtattcctcttcttaaattattgccaattctacccactttggttaatctataaaatattgatacggtgggcccccatccttactcctcccattaatttgacattgtaggctctagtcaattatgattttttttttttgagacagaattttgctcctgttgcccaggcgggagtgcaatggcgcaatctcggctcaccgtaacctctgcctcctgggttcaagcgattctcttacctcggcctcccaaatagctgggactacaggtgtgcgcccactacgcctggctaattttgtatttttagtagaaacggggtttcaccatgttggtcaggctggtctcgaactcctgacctcaggtgatccgcccacatgggcctcccatgaatttttacctataaaatgaaatcaaagaaaggtacagcagggagaaaccagctggctctgtgtgatataatcccatgagaaacaacatacaatgaaagaaaataacactaattactactatacctatactaaaacagtaaatgaagaaaaattctgggttcataaattggtagatcaatatcagtaagatgtcatgtctccctaaattgatctatagatttcagtgcaatcttcatcaaatttgtggcataagtttttttagatattaacaactgggtttttgcttttgttttttttttttagacgaagtctcgctctttcgcccaggccggactgcagtagcgctatcttggctcactgcaagctccgcctcccaggttcacgccattctcctgcctcagcctcccgagtagctgggactacaggcactcgctaccgcgcccggctaattttttttgtatttttagtagagacggggtttcaccgcattagccaggatggtctcgatctcctgacctcgtgatccgcccgtctcggcctcccaaagtgctgggattacaggcgtgagccactgtgcccggcccaacaactgagttttgacaaatgcatagagatatgtatccccactgaataatatttcctgatcttgatttaaccttcaagccttttctattgcatttacgctttgcatattcaataccattacttaatatatgcacgtagccaaaataatttttagcgccctatttagaaataaaaattacataataggtcaggtgtgatggctcatgcctataatcccagcactttgggaggcagaagtgggcagatggcttgagcccaggagtttgagaccagcctgggcaacatggtaaaacactgtctctacaaaaaaacacaaaaattagccaagctggtggtgtgcacctgtagtccccgctacctgggaggttaaggtgggaggactgcttgagcccgaaaggtggaggttacagtgagccaaggctgtgccactgcactccagcctgagtgacagagcaagaccctatctcaaaataaaataaaataaaataaacattaaggctggctttcttattagaaacaatttcatgaagaaaaaaataaatattttcactttacaagaactatgcttctggcagaatgtacatgtttgagaaatgtttgctgagtgaacatatgtaagtataaataaactttaaacacattctaggaagttgagatgatgtaaaagaaagcgagaaagttccatagtcattttctacatgttcttctatgctcaaaaaatctttatggtctcatggtacaagggaagaagtttagacctattaatgaaatattaggaaccataaacaattggcccctaatgcctttccagacttctcttctgttacaacctaacatccttccaaatccaaaataaatactaagcgtcaagcaacttaacatactacttcaggacttttgctgaagcagtgcaaatgccttttctctttagcatgtgttcaagctccacttacattccacttactgttgctacataataaattaatcccaaacatagcttaaattaaggatcaccttatcatggtcaaggagtatggggattaggaattcacgtagcacaaagaggcgatggcttgtctttgctttacaacgtccagggcctcagttaggacaacctggagactgaagatgatgcaacagtttgaggctggaatcatcttaagtcttgtccactcatacgcctggcacctgggctaggagattcaaaggctatgactgccaaacagagtaccaacccttggcctttccaaattgcttgatttcttcaaagaatgaagacctcagagtagtcagacttcttacattgcaggctcagggatctaagtgcaagtattccaagaaaaaggaatacatctggatcattatttatgacccagcctcagaagtgcatattcttttgttccaatcagttatgagaccacccagatttaaggaaagaagaaagaggtatacatcttgatgggaggggtataaaagagctttagggctgtgtttaaaaactaccacagcttttataatcatgacaaatttttacctccaagaaaatgtttacaaactcttcctaggcaaacttaaattctcccaaaatactcttagtattttatagttattatcatcacaggacttaatataaccttccatttaattgggagttcctcgagagatgggcttcataatttgtataccccattacagcacctggtatagtgctctatactaatgtcacaaatacattttttcaatatttattctatagtcaaactatccctgtttgcagatgacatgattctacacctaggaaatgtcacggtcttggcccaaaagttccttcagctgataaacaacttcagctaagtttcaggatacaatatcaacatacaaacaccactagcattcccatacaccaacaacagccaagctgaaagccaaatcaggaatgcagttccattcacaattgccaaaaaaagaaagagatacctaggaatacagctaaccaggaaggtgaaagaggtctacaatgagaattacaaaacactgctcaaagaaatcagagatgacacaaacaaatggaaaaaacattccatgcttatcagagaagtatcaatattgttaaaatggccatattgcccaaagaaatttatagatttaatgctattcctatcagactatcaatgacgttcttcaaaaactagaaaaaacattttaaaattcatatggaaccaaaaaagggccagaataaccaaggcaaatctaagcaaaaagaacaaggctagaagcatcatgttacccgatttcaaactatactacagggctacagtaaccaaaacagcacggggctgccacaaaatcagacacatagaccaatggaacagaataaagaacccagaagtaaggctgcataactacaatcatccaatcttgaacaaagccgacaaaaaacaagcactggggaaaggactccctatttaacaaatagtgctgcaataactggctagccgtatgcagaaaattgaaactggaccccttcgttacatcacatacaaaaattaactcaagatagaataaaaacttaaatgtaaaacccaaaacaataaaaaccctggaagacaacctaggcaataccattctaaatataggaactggcaaagagttcatgacaaagatgccaaaagcaattgcaacaaaagaaaaattgacaaatgggatctaattaaactaaagagcttctgcacagcaaaagaaactatcaacagagtaaacgacaacctacagaatgggagaaaatttttgcaagctatgtattgacaaaggtctaatattcagcaactctaaggaacttaaatttgcaagaaaaaataaccccattaaaaagtgggcaaaggacatgaacagacatttttcaaaagaagacatgcatgtggccaatgaccatatgaaaaaagctcaatttcactaatcattagggaaatgcaaaccaaaaccacaatgagataccatctcacaccagtcagaatggctattattaaaaagtaaaaaaaaaaaaaaaaatagatgctgacaaggttgtggagaaaagggaacacttatacactcttgggaggagtgtaaattagttcaaccattgtggaaagcagtgtggaaattcctcaaagagctaaaagcagaactatcatttgacccagcgatcccattagtgggtatatacccaaaggagtataactcgttctatcataaagacacatgcacccatatgtttactgcagtactattcacaatagcaaagagatgaagtcaacctaaatgtccatcaatggtagactggatacagaaaatgtggtacaaatacaccatggaatactatgcagccataaaaaagaatgagatcatgtcctgtgcaggaacatgaatggagctggaggccattatccttagcaaactaacagaaaaactgaaaaccaaatactgcatgttctcactttgagggagctaaacgatgagaacctatgggcaaaaagagggcaactacagacactgggacctacttaagggtggaggagggaagaagggagagaatcaggaaaaataactgctaggtactaggtttagtacctgggcaatgaaataatctgtacaaacaaacccccgtgacataaatttacctatataaaaaacctgcacatgaacccctgaactataacaaaagtttaaaatatatatatttattccacaactactacaaattctataatctactagtgataaataacagtgaataaggcagagtttgtgtctggttcttaaaacactattgtccatcagaatgaaattaagtaagtaattatggtaaaatacaaacccaataaatagcagctactagaaaaagttacttataaatgttctcagcttcagattcctaaatctctaaaacaggaataacattcacttctgataagtaactataaacagcaaataagatgacaatgtgctaaatgcttagcatggtacctaaaacactgtaaataatcaagaaatgttattttctaaaagttatcaaaatagtataaatgtaaaatattgatttttatatttgtgctttactatataatacgaagtttactgctataacccaaatctcaatgccttaacccaatgaaagtctaatattcattaaataataatttgggggtggcggtgagcaggagtatcgcagtagagagagaatacttggtacatggtcatttagggaactaagttccaaaaatcctgtgagatctacttttgaggacataattgaaagggaaaagaaagcaaaccctacatttgcctcgaaatgacttctgctcatattccattgacaaggcatagtcacatagcctccatacatgggggctatctgagtctatctgtatgccccaaaagagcaaagagagaatctaattagtttctggaacaatccattatttaactcactaaatacctattttttttttaattcttcctcccagatatagaatgcactcaagctctccactaggaagattaccaaaggtcccagccaggacaaaatctaggatctccagttcatacataatcttcttcatcagatgtagatgtcgctctccatgtccccacaacatacgccttaaagagaagatatctgtcctgtctccctctgtacaaaacacataccatggggaaacagagaaaggatcaccgcatttagaaatgcaaaaaaaaaaatggaaaatattcagtggttgctaatctgtagcattatgaaatcccactggatgtatgaacattgtgaaggaagaaattccttgttaaggccctaattttgttctccaggagaaactccctagtcctttgttgttctccatggctcctggcttcaccctctatgggttttccttgcctgttatctcccgtggccacatatgaagttggtgttgagaagtatgccacttgaggacagcttttagggctcaatgaacagtcacatgccttctaaggccaagttccaagtttctctagcaacaaaattccatcagaatcatagcagcttccagtcagatccaaatgctaataaccaactccaaaattactttttatcattctcaaatctgctttatttttttgcttcttttcccaatgtctcatctctctgttaatttactggtggctactctgacttttcaggctcaagaaagccacacatcttaatctgaccattatatcaatgtgtagccactcggctacacgtaagactgagaagtcttatggggtcttttttgctcaaagccttcttaaaatccatcttttatttttgagagtttaaaaacagtcattttttccaattctgaatttctggttattattttctttcactcctgtaaaccaaacaatagtttcctaaactcatctcttccttgactacatttggcaaggtaatgcaattacaatgaacacacactactaacaacttcttttcttaaaccttcaatcttggtagaaacatgaaatggcctccaagttgccaaaggtaagagttttacaaacattcatcacatgacatagatttctagccatcccaatatgctgtatgtgttcctcactgcccaacccttaggccaatgtcatatactttgggatcttgttacagtagcaacacaattcaaaatgtcaatttctatgttgatcagggtaagtaactctctctgctgtaacaactaactccaaagcttcagtggcttacacaacaaaagttttccctcttatgtcacaatcaatttgggacagggaaagatggtctttcactatgtgactcaatgacattttgtctactagtgtctatcctagggccttggaaactcccactaaatattcctcaatgaggagagtatggaaagttttgaaggaaattttagggttagttctaaacgtcatgctcattattttcatccacattctactctcgagagctagtatcatggccccacctaatacaagaggaagtacgtctaacagtatgccacagaagagagaaaatggttataatagaataaccacccagtctctgccatatctgtatccttgaacaaaaattgcatactcttatctatgccaaaatccaaaactatctatcatttcaagcagacccttctcagcccacagatggagaatactaaataaatgaagtccataggttcatttagttactctagtatataaagtataattctgatataaccatatgaacttaatccaaatcaaatatttcgttgtcattcttttaaagataaattatcttagtcatgattggataaaatttatgacagaaaactcattactttttcaggggcgaaacactattttcattcctgaccaaatgtcaacataaaagattaagatgaacaaatcaagatctattatttctggagaatgggattactgatggaagagggggtacttaaatggaaatataataatttaatatttaaatttactttgaaatgttttaaaatctatttcaaagaaaaaaattgttttgttacaataatctgtcttgtttaaataagtaacaatattttattgactagaaatcaaccccaaaagctagtttttaagctgtttagttgaaaactctttatcgacaaataactgatcatctgttttagttctaccttaacataaatgtcccacatattgtacctggataaaacagtaaagacttaaacacttcaaaggaaaacatactttaaatataaatggaggcatttagttatttttttttccctcaagtctatataaaaaggtcaactgctaagtaaaaacaagaataggaatgaaatgggaggataaatcttttaccaaataaggataaacgtagaactggagcaattatctaatatattaaattattaatcacatatgacttaaaccttctggaattggcatgaaatcattatagaaacaccagtcagcatttcttgtaagactcctaaaaaagtagaaggttcttcccaactttctatgctaaaggttgacatgtatttcccttggagaacatgtctatatgttatcaaatcttatattccaaaatacacagtctcttgccttcagggacgcaataacatttgaaaacatctatgcatacatacacaatactttatacctctaaaaatatccagtaatctagttctaaagaggttctataatgctaaccagaaaatcccttggcatctctttgctcgctcagccatctggatccatcttttttcgctgattagggaggaagagcacaaggttccatatatccattgatatctttaattaggattcctttcctccccatgttgttgaaagtcaaagaaacagcacacccaaaatatctttgaaaatggtaaaagtggtattcaaatgttactactgcatagagcttattttcttggttataataactcccattcacataattccttatagatcgcaaagtatacagcaggttaatctgattactccaactagttgacaaatgtaggaaatcagaaaaaatgataaacatctctgttcattttaacttaaaacataaatgtacaacttttactacaataagaaacttttagatttagaagaaatgtgatgatttcctgaataacctttctactgtttttcataaattaaattattgagtataacataaaattatggactgggggactttggctaccacagaagaaatttctagctttgcaggtaatttttgcccatcttcctctttatatttaaataggtctattgctgtcactatgcatatgattcctatatcacccataatttcattttccaatgaatagtcaacattaatcaactattactgtcatcttcactaaacgttcaggaacacatacttttatagctatcagccaataaactatatttttagttctttttgtgattcattattttctgtagcattgtcaaagttagttcttgtttttctctaagatttactaaaaattaggctgggaattctgctttacctgtggaactgaactgggaattctgttctatttgtaaaaactatccataatgcagatgacttgtaaaagacatccttatagaatctatgattttgaatccaatttatcttaaaacataacttaaaaattttcgtcatgccagaaccccttgatccatatgctgaattaaggaaggcatatttattaattagaaaacaccccatataggccgggagcggtggctcacacctgtaattcaagcactttgggaggccaaggtgggcagatcacctgaggtcgggagttcgagaccagcctgaccaacatggagaaacccctctctactaaaaatacaaaattagccgggcgtggtggtgcatgcctgtaatcccagctggtcgggaggctgaggcaggagaatcgcttgaacctggggggcggaggttgcagtgagctgagattgtgccattgcacaccagcctgggcaacaagagtgaaactccatctcaaaaaaaaaaagaagaagaaaagaaaagaaagtaccccatatattgtcctaatttcctcacaactgagatacagtgaatgcctactgtatttcaggtattaaaagattagtagaaaaaatgacatctactcaaaggtgagaacaatgacacaaaaagtgtcacccaaagtcaaagtataccataagaaacatataaatggtgaaccaaagataaagcaggattctgactaagggaattaaaaatgttccacatgtgctgcagaatcaaccatgggtattaaatgaaaagcaagaaggtgagagaaggggaattcaaagagaaaggaatagcttgatcaaaggcacagaggcctgaaaatccgtaatacattttctgggggaaaaaaagccaataaaacatggctgaaatacagaatgtttgggaagaagcagcaaagggtgacagtactatacgaggctttcatagaaaaataacttataggcaaataatgaaagcattttctacaatgataaagaggattcatttcattctgtagatagtgggatgtccctgacacttctggagtaaggtaaaagtgacaagatcaaattggtgtttaggaatagtaactctggtgatagtgaaatgtaagcaatgataaactagaggaagactggataagaaatttttataattaccaagaagaaagataatgagagccttaaatttaagcagtagaggccaaggtggaccatatttggggccacaaaactagcattcataaaatttaaaataatttgaattatacaaatctacatcttctgaccaccatgcagttaaattcaaaaccaatttatctacaaaatctcacaatattaggaacacaattctaaataactcacgggtcaagaataattcaaaagaaaaatttaaaaatattttaactgaataaaataaaacacaatttaataaagtttgtgagatgcagttaaagcagcgcttaaagattaatttatagcactaaacagttttaccagaaaggaataaaggtctccaatcaatgacttcagcttctatcctaaaaacttgaaaatgtaatgcaaattaacccaaaagtaagcagaaggaggaaaataataaagttgagaatggaaatcaatgaaagtggtaacaaaagtaacagaaaaaaataaatgaaagctggtcttgaaaagatcaacaaaatttatagattgatcagggaaaaaagaaagaaggaagttttataattttagagtttacatttaggtctatgatttatttggatcatttttaatacactgagagatggattgaagatcatttgttaatatgcttattcagttattctgcaccatttgttgaaaagactatcctttctccactgaataatctttatacattttttttaaaaatcggttgtccatatatgtatgggtctatgtttgtattctctatttagttctattgattaaattaatattgtttatcgtctatcttgtctacagtattaaactattttaatcattacaatgtgtcttcaagttaattagtggaagtcttcaaactttgctcttacttttcaaagttgttttgcctagtgtaggtcttttgcatttacatataaatttgaattccaatagattattgctatcctatacaaaaataatttttgtaaattgatcttttatcttgcaacttctaagaaatccttaattagttttagtagtgtttggagattctggaaagtattccacatacaggatcattttatcaactcttttctgtattttttatttttttaagaaaatccctatgaaatagtttcggtattttcttctggcctatattttagttcacgaattttcttcaacaatactcaatgtgttgctaagtcaatcctctgagttgctaatttcagttatcatactttttcagttctcgtatttgatgtaattcctagtttctagttctctgccacatactaagtcttcttcccccttaaacgtattaagcacagccatgtatgatagtcccattagctaaatcccctgtgagtctgtttctagtaatatttctcttagtttcttaatcacattgtcttacctccttgaatgtctgactatttttgattgaatgctaaatgctgtatgttttttatgtggccataacttgagattctcaatggtgctaccttcatccaaattaaacttatgttttcttttagcaggcagctagcctaatggccttagaaataacaaatcaccttaatccaatcagaggttaaaattattcaaggctaggattcagtctcagtgacagctgatctatttctagttcaccaatacacatacaatgtagtctattttgacaaactaaattcagaaactgatttaagttaaaagaatgaaagttacccagtttctgactccattaaagtcagaaaattctgactatctattttagtactgaaagctctctccaaaattaaatgctctctatcttctgtttttgtgttaaactccacctggacttctttattaattataaaacaaataaaccatttgcaatgagctataatgctagtcacatggaaaacacgttaggcaaaactactttctgcatatagttgtaattcagtaattgtttcactatcactcagaagagaattattttatacactggttgcatttagtccacaatttaaatcattttcccgcattagagaatagtaaaatgtaagagaaatataaatttcatgtttttaatttgttcaaaattttaaaacattaaattttgtaacactgttgccatgctctgttgacagttatattagaagagggtggaacaaactcataagtatgaggcctccctggttcaaagaaagtagagacagaacattcaaatatatattatttccatttatttgtttttttaaaggggaactttggggtaatgccaaacaataatatttatgtttatagtctagaactttatgtgttcttttgttaaaatttcccaccaattttattctcatttcagaggggaaggtcatacatattttaaaacttcacatatataaaggattaaatagttaaataatgtttgtatttctgacaattttcaactctaccttattctaaaataaagtaacattttaaatgtcttcataattttatttttccaagcctactggtattttcacattattgaaacagttacaaatggggaaaattaccatgtactttatactatttgtatcttttcaaggatacaacttatcaagctatcagatcatttactttactgaaagaatgaatacaaattgatggtggcagtggccagtttggaggagcccctgtggggatgccagctgcagtcagggacgtgtggctggggctgtgcattccacagagcccacgggggtgggacaggtgggagccccgccccctaccaagtcccgtgctaccaggcacagctgcagccgcccagctgcagctctggacccgggcatccctgcactctcggaagcccaggaagccccccctatccccacaggcttggaagtgcctgctcctgttccctggcctctcctcgctcccagtgcccactctgatttcagagaaaagctgtggctgagcctggatgctgtcgccacctggccaggtgtgtgcactcagggtggtgctgacatgacagccctttgctgactcacccacctctggactttggtaaccatggtaaccagcgagcatgggagggtggcctggggtgaagacagatgggtgcaggcttgcagctgcccctcggcgcgaacagcctgggcatcgtggacagcatgtcgatggcagtggaagacagaaaggttaccaggcatgaaggggccggtcctcggtgaaacccccaccttcaggccaaggatagcctgaagcctggggtccaggccatccagtcctgggtgaagttggcacgtcagttctgggtgaagtctggggctcagagtgagaacttcattgatggctgttcagccagccagatggtgctttttccaggcctgcctgtggccacacatggaccaatcagcacacagagccaaatcaggaatgaacttccattcacaatggccacaaaaagaataaaatacctaagaatacagctaaccagagaggtaaaggagcgctacaagaagaactacaaaccactgcccagagaaatcagagatgacacaaacaactggaaaaacattccatgcttatcagaggaacaatcaatattgttaaaatggccatactgcccaaagtaatttacagattcaatgctatgcctattaaactaccactgatattctccacagaactagaaaaaaactattttataattcatatggaaccaaaaaacagcccaaatagctaaggcaatcctaagcaaaaagaacaaggctgagacatcatgctactcaacttcaaactacactacggggctacagtaaccaaaacagcatgggattgccacaaaatcagacacacggatcaatggaacagaacaaggaacccagaaataagactgcacacctacaactatctgatcttcaacaaacgtgacaaaaacaagccctggggaaaggattccctattcaataaatggcgctggaataactggctagccttacgcagattattaaaactgaaccccttccttacaccatatacaaaaattaactcaagatggattaaagagttaaatacaaaactccaaaccataaaaactctgaaagacaacctaggcaataccattctaaacataggaactggcaaagaattcatgatgaagatgccaaaagcaattgcaacaaaagcaaaaattgacaaatggaatctaattaaactaaagagcttctgcatagcaaaggtaactatcaacaaagtaaacagaaaacctaccgaatgggaggaaatttttgcaaactatgcatccaacaaggtctaatattcagcatctataaggaacttaaattcacaagaacaaaacaaacaaccccataataagatgggaccttctagttgcaagaaaataagcttagggctcccactgattctaccttatggtgagttttataattgtttcattatatattacaatgtaataataatagaaataaagtacacaataaatgtaatgcacttaaatcatcctgaaatcatatccccctgcccacagtccatgaaaaaactgtcttccatgaaactggtccctgatgccaaaaaggttggggaccactgctctggaacaaatggacctaacagacctatacagaacattccacccaacaacagaaggataaacattttcctaagcacacattaaacattctccaggatagatcaagttaggccacaaaacaagtcgtaacaaatttatgaaaactgaaatcatagcaagaatattttctaaataaattggtatgaaattagaaatcaataatgggaggaaaaactggaaaattcacaaatctgtggaaattaacacactcttaagcaaccaatgtatcgaagaataaactaaaagagaagtaaaaaaatatcttgagaaagtgaaaatgaaaaaaataacgtatcaaaccttatgggatgcagcaaaagcagttctaagaggaaagtttatagtaataaatgcctacattaagaaaaaaacaaagatctcaaacaaacaacttcactttatacctcaagaactagaaaaagaagagcaaactaaatcagcggaagaaaagaaaataataaagattagagtagaaataaatgaaatataaacaaggaaagcaaaagaaaaaaatcaacaaaactaagaggtggttttttgaaaagacaagcaaaattgacaagcctttagccagactaggaaaagagaagactcaaataaataaaatcagaaataaaacagccaacactacaattgatatcatagaaatagaatcataagagattactatgaacaatcatatgcaaacaaattgaataacctagaagaaatgtatcaattcctagaaacataaaacctactaacactgaatcatgaagaaataggaaatctgagtagatgaataataagcaaggagactgaatcatacagatcataaaaagccatataaagactacagaaaaagaaaattacaagctaacatccctggtgaatacagactcaaaaatattcaacaaatggaattcaacagcacactgcaaacatcctataccatcatccccagtaggatttatccctggagggcaagaatggttcaatatatgcaaatccataaatttagtataccacattaacagaatcagtatcacatgatcatctcattaaatcacaaacaacatttgataaaatccaatatattttaatgataaaaactctcaacaaattaggtaagaaggatgtaccccccaaataataaagtctatatatgtcaagtccaccagtaacatcatattcaatgacaaaaagcttttcctctgaaagtttttcctctaacatcagagacaagcaattatgaaaccacctttgcaaaattatgactgagacagtgaaagagatctaacttaaccgactccatcttgcttctaacctccaagctgtccttgtttgttccttggcgtaggctgaactaactttgggagaaatgtagtttatagtttaaaaaaagatggtaacagccctttcccaaagcagacctccttctggcctggggactagattacatttgtgggactaacattagccacaagattagaaattatggtttaggagtcatacagctggaagctacaagattctgaccctccctgaattgctcctaagatcagagtttgagatgttttgcagaccctgcacttgacagatcagctggcaccactcagatcaataaactggctcatctgatcttgtggcccccacccaggaactgactcagcacaagaagacagcttcgactccctatgatttcattcctgaccaatcagcactcttggctcactggcttccccctaagttatccttaaaaactctgcccccttggccgggcatggtggctcatgcttgtaaccctagcactttgggaggccaaggcaggtggatcacgaggtcaggagatcgagaccacagtgaaaccccgtctctactaaaaatacaaaaaattagccgggcgcagtggcgggtgcctatagtcccagctactcagggggctgaggcaggagaatggcatgaacccgggaggcagagcttacagtgagctgagatcacgccactgcactccagcctgggcaacagagcaagactccgtctcaaaaaaaaaaacctctgccccctaaatgcttggggagactgatttgagtaatgataaaactctggtctcctgcacacctggctgtgtgtgaattgcactttctctattgcaattcccctgtcttgatgaatcagctctggctaggcagcaggcaaggtgaaccccttgggcagttacaattagacacgaaaaagaaataaaagacactcaaaatgtaaaagaagaagtaaaaaatatctttgcagatgacataatcttatgtatacatagaaaaccctgaatactccaccaaaaatctgttagaagtaataaacaagttcagtaaagtcgtgaaataaaaacatgtgttggtaaaaaaaagtgttggtgaaataaaagcatgtctaatgaccaaattcaaactctccattccccaaactatacctttttctataatatttatttcagaaaattattctaagacaaaaaccttgcctctttccatccctaatctctattttcagtgagtgcttcaagtttttgctatatgggccaaaaagatctggccagagaagaggcaaagagaggaaaaaaggaagaaggaaaaaaggaaagacaggaggaaaaagagaggcggaaaaatagaggaattacggcagtacatacaccacaatgttaacagtggttatctctggttgaagagattatgagtcatcttcatatttttctttatacacctttctgtattttggagattgtccttaaaaactgtgcttcctttttcatgagagagagaaaaaaagttgttttgaaaatgtctttaatgatattctgaaagaactctaagcccttcattatgtggttcatacacctcctgccacaccccatacccttgtatcttttcatatctgtacctctgcacaagcagctatctcttcctagaacattatccccatttacctgcacctggctaattcctattcatccttcaaaactacacgtgtaccacttcctccataaaatcttcttgtaccacaaacctcattacaggttcatgcctctaatcccagcactttgggaggccaagatgggcagatcacttgaggccaggagttcgagacacgcctggccaacatggtgaaaccccatctctactaaaaatacaaaaattagctaggcttggtggcacacgcctgtaatcccagctactcaggagtaaggcaggagaattgcttgagcctgggagacagagtttgcagtgagcctaaattgcaccattgcactccagcctgggcaacaaagcaagactctgtctcaaaaaaaaaaaaaaaaaaaaaaataggtcataagaaaatagcagttttcaatcgtttttttctggctgccacaaacatggacacacccaaagttatgcattcttcccacaacaagctaaataactctactcctaatagggtatgaagcctcacagtgtttgccagttatactgcctcttctttaaaagcaagccaaagcagtctaatttacaaagccaagaatgacaagagaaaccaattttaatttcctaaccacaaatgattagcacaggaatgactagctgaagcctgcactgttaagaactctccatattggataatatgggagagacggctggctgttcaccagtatccattttccatattatatatggcaatatgcctaactcaaacaaatacacactaaatttctctgcctcctttgtagtcagacatggttacacatcagttctggccaaagagataccagtaggagtgattggtacactttcaggaaaattctttttaaaaggaggaagagggtgggcgtggtggctcacgccagtaatcccaacaaggattgcttgaggctaagagctcaagaccagcccaggcaacatagcaagacctccttctctacaaaaaaaaaaaataataattaaaaaataaggattagccaggcctggtggcacatatctctagtcctagctactcaggaggctgaagcagcaagagtgcttgagcccaaaagtgcaagcctgtggtgtcctgtgattgcaccactacattcttggctgggcaacacagtgagaccctgtctaaaaaataaataaataaaaatagtaggaagactcggttgcatttttagcactgttcccctttcctcttccttctgtgtaggacgagaacatgaagataagagtgatatcctatataggaaggaatagaaagctggacagagcatgagtctttgacaacatcacaaagttactgttaacagccccaaatcacctaccttgtctttttttttttttttccaacagggcagaaaaatacatccctacctcatttattccattatagtttgagcattctgttacaggcatttagttgaatataagcctcagtggaggctgaggataactagtggaactaaccgaaatctctatccttggggcaaaggagtaatataattgagaatgacaaatataaccaagagtgaaaagacaaactctaatgctgagcacccaaagagtttctgttatgtctttgaaataagaacgcagggtttcatgttgtctgagcttcattgcaggccagagcagcaactaaaatagcattggtttctcttccatttaaaaagatatcagaatgcagataagtgagaataaccttatcttacagatacccttaaatgcactcttttaaaaatttttaataaaacagtcacaagttttggcagtcaaattatcagaaccaaattaccagtactccgtcaccctccgtattctagcatccttatctggcatgcagttaaacagacaggctctatttaaaacattgaatgaacagaaatggatatgcataatttatttaaatagtgatagatggaaggaaatcaaagagaagaaacatccaaaactatatgacctttacagatccaagaataactaggaacagttctgtttatatgtggggcttcctccagtctgacagcattcctcagactgtccctttcatctggaaatttcccaaaaaacccagctttttcagctgagtctttagactagttttagctcctctaagcatgcaaattgcttcctatatgtttcatgaaaatatcagggaatgtatgagggtcgaagacagcataaaacatgaagtccaaaggactagataaattcactgagggacaaagctaatgtcattaagtgaggtctagtaggagaaaaataaaagctgaaatcacaactctgaacttaagctaaacacagtgtccagatgagaatgacagaaagtgggcaataaacattttcaatatggttctttaaaattcaaaaagaattgtaattacagcaaaaaaaaattttcaaagactctctcacatccctaaaatacacaataatgacaagatttaataattaaaattgcacaactaattttccacaccttggatctacaagtttcagagggcaaaggtggccaagtaaggaaagaaaatgaagtctcctagaactgctcctaatgaaagaaatccttttgataacattaggttttatactgaaaccacagcattatttttgaaaacataccctaataatgacaataagagtagcaacagattttacttttatgcttactatataccaggaaccattttaagcacttgatgtgtattaagtaatttgatccatatatctctcccttccagacatataccaaacacaaattggataagcaacactttaaagtaaactaaaagaaatcaatcacatttcctattcaaatgaaatgcagagcctttaagattttagtactggaaacatttaatagatacataaggatcaaatgacttaatatacatagagtgcttaaaatggttcctggtatatagtatatgaagtttatccccattagactgataaaaagaggtatagagcctttaaataatttgcccaaggtcacagtgttaccaagtggagaagccagaactaaaactcaacaagactgttctagagtccatgatattgaccactgtaccaaattactttgtaagtgttataccttaagttcatttagagagtcaagctggacaaagctgaaattatttctggcttctcactactctatcaaggtagtgcttctctcccagttatccaaatttgaatcagtgagataacttttggtgcctcagtgcattccatattcaattagtcatccaaccaaaccctgtcaattaaatactccattcccactcatattgtcaccatcttggatattccacagtcaaaaactgcatcagcttttctataagctaatagctcatgccagccttattaataaaacatctaggtctttttcacatgaactgcaggtcttacatcataattttgtaggacataattataataaaatattttacatttcctcaaaaaaattcactttattaatttcagtccattattccagcctatatattaactcttccttccagatatataccaaacacaaattggataggcaaaactttaaactaaaagaaatcaatcacatttcctattcaaaagaaacacacagcctttaagattttagcactggaaatatttaatagaatcgatagtcaaagacagtagctgaatcaagtgaccttttaacacataagttacactttggagtggggcgctcttagttcagttaccaaaatcctaatttatataactgttacgggagcacggtgcttcctttaatctatcttggttccactgagtatcactgagacagtttgaagactaaaaagactaccaaatggaaacaaccaaacagctaaaaacagtccacagcatacaataaatcacagtgctctccaacctttttcacttcatgcaacatagaggatgttatctatacacccataccacagctaatcacaagactgctcacagtcagagatctcaatatctcaacacacttagggctaagccaagtgcctcagggcatctcttagcaagtttcacactaaactaccacaatttatttgctctcagcattaataaatcctcatctattccaaaccagatagtcatccaaaaccttggaacaactctgaaggtccctcatatggattccttgcttcccagctccctttacaactggatgtgaaaggtgctgtcttctgtactttctcttgagaggcagaaagaaataaacaatggctaattctgacctatacctcgggccctcctattttctatttttaatctggagaaatacctattctagcagcttgggtaacttactatataaatgattttggtctttaggtgagctcttgcctccacagacaagggacagctacctgatccaaagcgctaaggtgatgtgagattgtaagatataatgcattgctattggtatttgaagcttgccacagatattaatccagtgtgatatggattagatcaactttacattatccaatgccttgcccatgctttcatgccctaatagcaatacagctaacatccctaaaaatgactgccagaataatagcaagagctcatggccccattagcaatagttggcactagtttccagtttccaatatgatctgttgcaaaattagccaaaaatgatgtccaaagatttgccgaagttgaatttctttttgaaatgcagaggacaacttcattaagattctactagtacactgtagcattgtacactgtaccagcactaaacagaaccaaatctccatcccagtcacttcaactagatagtatctaaaatctcacccttagtataatgtacttaaatgagatggaaatactccacattctgccctgcctaagttctagaaatttttattaggttaagggttctatatttataacttaatgacacatccatacatattaggaccttcaactcttgaaaaaggaatttgaatatgtatgtattttaatacaaatttagcaaataggcttctgagaagaaaaagatctcacagtattttcaattatagtaactgtacttttagcatatgtcaagttaatggtcctataaactcacagaaaagaataagactcttaaagataatatgtatcaatgaaggcgagtatacatacaagaggaagttcacaatcactttaaaaaccatacaataccgagtccataagggcattgccacattggttttatttaccactatattcccagcacccaataccttgactagcacataataggcactaagaaaatacataaggctgaatgaatcatagcaaatatttaatataaactaaaattagatgatcacttgacaagggtattgtatacaaacttatttaatcagtaaaaggaaggttagaatttgaccaggaaatctttaaggtgctttccaaacctcaagacttcataacattttcatcactatgccagtgaaagtattaaatgaaggtcatactctattatagaaaggactactagaaacatgtctatcaataaccacaggatgcattataatctaccagtcagcctttttatacaaataactgtcaagcgggggtgggcaggggaagggaccacaagagaaaccataaaacattagtaatcttaaaggataaattaatcttgtttatatacttctatatttatacacaaaaaaatgttaatctaaaaatgactaggtctatgaattgtgttaaaagaacaaatccaaaaatgatgtattaataattagggggaaaatccctggtatcgaaagtaatagaattattttttccttaaaagctgcaaattagctgggcatggtggctcattcctgtaatcctagcactttgggagaccgaggtggggagaccacttgaggccagcagttcaagaccagcttggccaacatcacaaaacccatctctactaaaaatacaaaaataagccaggtatagtggcgcatgcctgtagtcccagccactcaggagactgaggcgggagaatcacttgagcccggaagtcagaggttgcagtgagccgagatcatgccactgtactccagcctgggcaacagagcaagactctgtctccacacacacacacacacacacacacacaaaaaggctactaattgaaaagttcagtaccagttaagcaactgctcagttacagaattagtttagaaatacacaggatttttatacttgtacttaatgataagctgcaaatatctgactatatttccctactcttttctctgtccttctataaaatacaaatatttttgaaatttttgaattatatacaaataggtcacacattaaataatggttaatttaacgcaagaaactaatgtccaccgttaatgaacttcacataacttcccataatatacttcacattaaagatattttcttcagtaatttgttaagattaaaagtctagttacaggccaggcgtggtggctcacgtctgtaatcccaggaattctagaccagcctcagtaacatactgaaccctggtctctacaaaaataaaaattaaaaaattagctgggcaaggtggctcatgcctataggcccaacaacttggaaggctgaggtgggaggatcacttgagctcaggaggtccaggttgcagtgagccctgaccacagactgtactccagcctgggcaacagagcaacactgtgtcttctaaatgaataaataaataaataaataaaatctagttgcaatttgcttggtaatataggaaatatgaaaaatgctaaaagctattttacctagatcatttgcttttcttagactctgtttggcaaaaagcagcaggaaactggttgccttgatgaagtaataggccacggccaagcacggtggctcatgcctgtaatcccagcactttgggaggctgaggaaggcggatcacctgaggtcaggagttcaagaccagcctgaccaacatggtgaaaccccatctctactaaaactacaagtatcagctgggtgtggtggcacgtgcctgtaatcccagctacttgggaggctgaggcaggagaatcacttgagtcccggaggtggaggttgtggtgagtagagatcgtgccactgcactccagcctctgcaacagagtgagactctgtctcaaaacaaaaaacaaaaacaaagtaacagaccacattccacccatcactgttttactgtttttttacagtacttatcaattatcacatactacataatttactaacattatggttagtactggtctctctccactagaaatttaagttctgagaagacagcttttatctggtttacagctatatcttcaaccctgatctcagttcctggcacataataagtaccaaatagatatctgttaaatgaatagactagaatctatcattgctaaatattcaaaaaggctataaattttaaagtaatattctgcataaatgagcaacgaccaaaaaaggttgtttttctctaagtacctgcaagccagctgttggtgatctttaactaacttattagtttctagactccacccttacccctgtttcatgttcaagaaccaattcttcccttttactaatatcagcatcacatggtcattctactcaaatttgtcactgtcaccaataggaaacaggctgctatgcgagatgaaattacagataatacccaggtagaacaatattaatccaggtaaatatttatatgaatttgaaatgtaccttccggaaattttaaagaggccagaatcagtctaaaagaatctgtagttaatagaatgagtggaagatattatttatgagcaggtggctttcctgtgctgcttctcaactaaggacatgtctcttcttctgcttctttggcttgtcagaaagtaaaatatttaaaacaacgcagggttccacctcatctttttatcaaagctcagaagtctcaggaaaaacagttatactgcataaggaaaaagaaagtgaacttcaagcaatggaaaccacaataaattaaccaattgagcacatttttcacacaagttttaaagcagtttaatactctttccaaagtaagtacataatattgtactgtttttctttcttttgaagagcatttaattggagaaaaatactgaagctgttagtactctcaatgaaatcttttttgaatttttaatttttatgggtacacaggtatatacatttatcaggtacatgaaatattctgatatgcatataatgcataataatcagtaaatggggtatccatcacctcaagcatttatcctttgtgttacaaaaatgcaattatactcctttagctatttttaaatgtacaaaaattattgttgactgtagtcaccctgttgtgctataaaacactaaatcttattcattctacccaactatatttttgtgcccattaatcttctccattacctcctctcccccgccacactacccttcccagcatctggtaaccatccttcttctctctctctctatgagatcaattgttttaatttttaactcccacaaataagtgagaatgtgcaaagtttgtctttctgtgcctagcttatttcattcaacatgacttccagtttcatgttgttgcaaatgacagaatctcgttcttcttatggtcaaagaatactccattgtgtatattgtcacattttctttatccgtttgtctgttgatggacacttaggttgcttccaaatcttggccattgtgaatagtgttgcagtaaacatgggagtgcagattatctcttcgataaactgatttcctttcttttgggtatatgcctagcagtggaattgctagatcatatggtagctctattttcagttttttgaggaacttccaaactcttctccatagtggctttagcaatttacattcccactaacactgtgtgagggttctcttttctccacatccttgccagcatttgttgttacctgtcttttggatataagccattttaactggggtgagatggtatctcgttgtagttttgatctgcatttctctgatgatcagtgatgctgagcaccttttcatataactgtttgccattcatatgtcttcctttgagaaatgtctattcagatcttttgcccagcttttaatcagattattagattttttttcactacacagttgtttgagctccttatatattctgtgggttgtctcttcactttgttgattgtttcctttgctgtacagaagctttttaagttaatgtgatcctatttgtccatttctgctttggttgtctgtgcttatggggtattactcgaagtctttgcccagttcagtgccctagagtttctcccatgttttcatgtagtaatgtcatagcttgaagtcttacatttaagtctttaatcaattttgatgtgattttttttatggcgagaaagaggggtctagtttctttcctctgctatggacatccagtttcttcagcaccatttactgaagagactgtcttttctccagtgtatgttcttggcacctttttcagaaatgagttccctgtagatatacagatttgtctctggattctctattctgttccattggtttgtgtgtctggtttcatgccagtaacatgctattttggttactatagctctgtagtttaatttgaagtcagataatgtaattcttccagtttttttaattttatttttatttttatttttttgctcaggatagctttggctattctgggtctttttttgcctccatataaactttagaactgtttattctatttctgtaaagaatgttattgatattttgacaaggactgcactgaatctatagattgctttaggtagtataaacattttaacaatactgattcttccaatccatgaacatggaatatctttcctttttttgtgtgtcctcctcagtttttttttcatcagtgatttataattttcattgtagagatctttcacttctttggttaattccttggtattttatctgtagctactgtaaatgagattactttcttgatttttttcagatagttcactgttggcatatagaaatgctaatgatttttgtatgctaactttgtatcctgcagatttattcaatttgttcatcagttttaatagttttttggtgaagtgtttacatttttccagatataagatccatcatctgcaaagaaggataatttgactccctcctttccaatttggatgccctagacttccttctcttatctggttgccctagctagaacttccagtactatgttgaataacagtggtgaaagtgggcatccttgtcaccttctagatattagaggaaaggctttcagttttccccccattcataatgatattagctgtgaatctgttgtatatagcttttattgtgttaaggtatgttccttctatacccagtttttaaacagtttgtatcataaagggatgttgaattttatcagatgctttttcagcatcaattaaaatgatcacacggtttttgtacattctgttgataaaatgtatcacgttgattggtgtgtgtgtcttgaaccatccttgtatccctgggataaatcctacttggtcatgatgaaggatcttttaaacattttgttaaatttggtttgctaagattttattgaggattttttgcatcaatgttcatcagggaaattggcctatggttttcttttttgctgtgtctttgcctggttttggcatcatagtaatactagtctcatagaataaggtttggaagtattccctcctcctcaattttttggaatagtttgagtcgaaattgcattagttcttctttaaaagcttgatattaatagaattcagcagtcaagccactggatcctgggctttcttttgctgggagactttttattacggctttgatcttgttacttgttattggtctgttcaggttttggatttcttcattgttcaatcttggtacgttgtaaatctctgggaatttatccatttcttccaggttttccaatttattgacatatagttggtcacagtagccactaatggtcctttgaatatctgcagtatcagttgtaacgtcttctttttaatctctggttttatttatttgggtctttatttttttcttactcaggctaaaggtttgtcaattttatcattacaaaaaaaccaactttttgttttgttgatcttttgtattgttttcttaatttcaatttatttctgctccgatctttattagtttcttttcttctcctaatcttgggtttggtttgctcttgcctttctagttctttaagatgcatcattaggttgtttatgtgaagtttttcttcttttttgatgtaggcacttatagctacaaacttccctcttaatactgttttcactatattccataggttttggtatgctctgttttcattattgtttgtttcaaaaaaaaatttttttttttgagaaggagtcttgctctgtctcccaggatgaagcacaatggcgcatctcagctcactgcaacctccacctcccaggttcaagggattctcctgcctcagcctcccaagtagctgggattacaggcacctgccaccgcgcccggctaatttttttattttttagtagagacggggtttcaccatgttggccaagctggtctcaaactcctgacctcaggtgatccaccggcctcggcctcccgaagtgctgggattacaggtgtgagccaccacgcctggccaatacaattttaaatttcttttctttttttttgagatggcgtctcactctgtcgcccaggctggagtgcagtggcgccatcttggctcactgtaacctctgcctcctgggttcaagcgattctcatgcctcagcctcccgagtagctgggattacatgcatgtgccatcatgcttggctaatttttatattttttagtagagacagggttttgccatgctggccaggctggtcttgaactaccgatctccactgacccgcccaccttggcctcccaaagtgctgggactacaggcatgagccagcgtgcctggccttaatttccttcttaaactcttcatggacccacaggtcattcagcagcatattgtttaatttccatgtgtttgtatagtttccaaaattcctctttattgatgtctagttctattctattgtggtcagagaagatacttgatattatttcaatgttttcgaatttttaaaaacttagtcaggagaggagccaagatggccgaataggaacagctctggtctacagctcccagcgtgagcgacgcagaagacgggtgatttctgcatttccatctgaggtaccgggttcatctcactagggagtgccagacagtgggcacaggtcagtgggtgcgtgcaccgtgcgcaagccgaagcagggcaaggcattgcctcactcgggaagcgcaaggggtcagggagttccctttcctagtcaaagaaaggggtgacagatggcacctggaaaatcagttcactcccacccgaatactgcgcttttccgacaggcttaaaaaacgccgcaccaggagattatatcccccacctggctgggagggtcctacgcccacggagtctcgctgattgctagcacagcagtctgagatcaaactgcaaggcggcagcgaggctgggggaggggcgcccaccattgcccaggcttgcttaggtaaacaaagcagcagggaagctcgaactgggtggagcccaccacaactcaaggaggcctgcctgcctctgtaggctccacctctgggggcagggcacagacaaacaaaaagacagcaggaacctctgcagacttcaatgtccctgtctgacagctttgaagagagcagtggttctcccagcacgcagctggagatctgagaacaggcagactgcctcctcaagtgggtccctgacccctgacccccgagcagcctaactgggaggcaccccccagcaggggcagactgacacctcacagggccgggtactccaacagacctgcagctgagggtcctgtctgttagaaggaaaactaacaaacagaaaggacatccacgccaaaaacccatctgtacatcaccatcatcaaagaccaaaagtagaaaaaaccacaaagatggggaaaaaacagagcagaaaaactggaaactctaaaaagcagagcgcctctcctcctccaaagcaacacagttcctcaccagcaacggaacaaagctggacggagaatgactttgacgagctgagacaagaaggcttcagacgatcaaagtactctgagctacgggaggaaattcaaaccaaaggcaaagaagttgaaaactgtgaaaaaagtttagaagaatgtataactagaataaccaatacagagaagtgcttaaaggagctgatggagctgaaaaccaaggctcgagaactacgtgaagaatgcagaagcctcaggagctgacgcgatcaactggaagaaagggtatcagcgatggaagatgaagtgaatgaaatgaagcaagaagggaagtttagagaaaaaagaataaaaagaaatgagcaaaccctccaagaaatatgggactatgggaaaagaccaaatctacgtctgactggtgtacctgaaagtgatggggagaatggaaccaagttggaaaacactctgcaggatatcatccaggagaacttccccaatgtagcaaggcaggccaacattcaaattcaggaaatacagagaacgccacaaagatactcctcgagaagagcaactccaagacacataattgtcagattcaccaaagttgaaatgaaggaaaaaatgtgaagggcagccagagagaaaggtccggttacccacaaagggaagcccatcagactaacagcggatctctcggcagaaactctacaagccagaagacagtgggggccaatattcaacattcttaaagaaaagaattttcaacccagaatttcatatccagccaaactaaacttcataagtgaaggagaaataaaatactttacagacaagcaaatgctgagagattttgtcaccaccaggcctgccctaaaagagctcctgaaggaagcgctaaacatggaaaggaacgaccgataccagccgctgcaaaatcatgccaaaatgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactggcaaattggataaagagtcaagacccatcagtgttctgtattcaggaaacccatctcacgtgcagagacacacataggctcaaaataaaaggatggaggaagatctaccaagcaaatggaaaacaaaaaaaggtaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagtcaacaaggatacccaggaatggaactcagctctgcaccaagcggacctaacagacatctacagaactctccaccccaaatcaacagaatagacatttttttcagcaccacaccacacctattccaaaactgaccacatacttggaagtaaagcactcctcagcaaatgtaaaagaacagaaattataacaaactatctctcagaccacagtgcaatcaaactagaactcaggattaagaatctcactcaaaaccgctcaactacatggaaactgaacaaccggctcctgaatgactactgggtgcataacgaaatgaaggcagaaataaagatgttctttgaaaccaacgagaacaaagacacaacataccagaatctctgggacacattcaaagcattgtgtagagggaaatttatagcactaaatgcccacaagagaaagcaggaaagatccaaaccggctcctgaatgactactgggtgcataacgaaatgaaggcagaaataaagatgttctttgaaaccaacgagaacaaagacacaacataccagaatctctgggacacattcaaagcattgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggaaatagagacacaaaaaacccttcaaaaaattaatgcatccaggagctggttttttgaaaggatcaacaaaattgatagaccactagcaagactaataaagaaaaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctcgacatatacaccctcccaagactaaaccaggaagaagttgaatctctgaatagaccaataacaggagctgaaactgtggcaataatcaatagcttaccaaccaaaaagagtccaggaccagatggattcacagccgaattgtaccagaggtacaagaaggaactggtaccaatccctctgaaactattccaatcaatagaaaaagaaggaatcctccctaactcattttatgaggccagcatcatcctgataccaaagcctggcagagacacaaccaaaaaagaaaattttagaccaatacccttggtgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcacaaaaggcctttgacaaaattcaacaactcttcatgctaaaaactctcaataaattaggtattgatgggacgtatctcaaaataataagagctatctatgacaaacacacagccaatatcatactgaatgggcaaaaactggaagcattccctttgaaaacaggcacaagacagggatgccctctctcaccactcctattcaacatagtgttggaagttctggccagggcaattaggcaggagaaggaaataaaggctattcaattaggaaaagaggaagtcaaattgtccctgtttgcagacgacatgattgtatatctagaaaaccccattgtctcagtccaaaatctccttaagctgataagcaacttcagcaaagtctcagcatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctctccaaggagaactacaaaccactgctcaaggaaataaaagaggatacaaataaatggaagaacattccatgctcatgggtaggaagaatcaatattgtgaaaatggccatactgcccaaggtaatttacagattcaatgccatccccatcaagctaccaatgactttcttcacagaactggaaaaaactactttaaagttcatatggaaccaaaaaagagcctgcattgccaagacaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccacatatctacaactatctgatctttgacaaacctgagaaaaacaagcaatggggaaaggattctctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacataagcatgggcaaggacttcatgtctaaaacaccaaaagcaatggcaacaaaagccaaaattgacaaatgggacctcattacactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaatcccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctagagaggatgtggagaaataggaacacttttacactgttggtgggactgtaaactagttcaaccattgtggaagtcagtgtggcgattcctcagggatctagaactagaaataccatttgactcagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcatgtatacaccatggaatactatgcagccataaaaaatgatgagttcatgtcctttgtagggacatggatgaaattggaaatcatcattctcagtaaactatcgcaagaacaaaaaacgaaacaccacatattctcactcataggtgggaattgaacaatgagaacagctggacacaggaaggggaacatcacactctggggactgttgtatggtggggggaggcgggagggatagcattgggagatatatctaatgctagatgaggagttagtgggtgcagcacaccagcatggcacatgtatacatatgtaactaacctgcacattgtgcacatgtaccctaaaacttaaagtataataataataaattaaaaaacaaacaaaaaacaaaaacaaaaaaacaaaaaaaaacaaaaacaaaacaaacaaacaaaaaaaacttatttttgtcacctaatgtatggcctatccttgagaatgatccatgtgctgaggagaacatatattctgtagctgctggatgaaatgttctatagatatctattaggtacatttgttttatagtgcagattaagtgtgatgtttctttattgaactttctgtctcgatctgtccaatgctgaaagtggggtattgaagtctccagctattattgtactggtgtctattctttagctctaataatatttgctttatatatctgggtgctccagtgttggatgcatgtggcaggacttactcctgccattttgttatttgttttctggttgttttgcagtcttctcttccttgtttccttcctgtcttccttttagtgaaggtaattttctctggtggtatgttttcatttatttttatttttacccccttttgttttgtgtgtatttgttgtatgtttttcaattcaaggttaccatgaggcttgcaaataatatcctataaccaattactttaatgacaagttaacactaattgcataaaagcaagcaaaaagaaaaataaaaactctatactttaactttgttcccccactttttaactttttgttgtttctatttctacctcattgctctgtatatgtcttgaaaagtccttgtggtttttattttttattggttcatcttttagtctttctatttaagaggagtttacacatgacagttacagtgttataagtattgccagtgagttttgtaccttcagatgatgtcttatttcttattaatgtttttttctttctgatggagctattccctttatcatttcttgtaagacaggtctggtgttgatgaaatccctctacttttgtttgggaaagtatttctcccacgtgtttgaagaatatttttgctagatatactatgctaggataaaagcctctttccttcagcactttaagtatatcaggccactctctctggcctgtcaagtttccatgaaataatctgctgtcagacatactagagctctattgtatgttatttctttcttttctctggttgctttcaagatcctttctttatccttgacctttgggagtttgatattacatgtcttgatatattcttctttggattaaatctgctagctgttctataaccttcttgtacttcaatattaatatctttctctagtttggggtaattttctgttattatcactttgagtaaactttctacccctatctctctctacctcctctttaaggccaataactcttagatttgccccattggggctattttctagatcttgtaggtatgcttcattcttttttctttggtgttctgcctgtcttcaagctcacaaattctttcttccacttgatcaattctgctgctgttaagagactctgatgcattccttagctttattgaaatctttcacttggttttgaatccaatagtaaaatctaactttttcattagaacactgtggctgtcataatcaaagctattcctaatttcacagatattagaggtttttctggtaaatatggtctatctttggaaaaaataaaagctgccaactctctaagcaccgagtactcatgtcattacactcttctgattttaatgttaaaatgctttttctctaagtgtctttctaacgccacttaaaccatcctaattggaatctagggcttagtctattaattttttaagtatcagaaataaagaaaacttttttaaaaatcagctttctcatataatactactagcagaatagttttagaaaagctttagcagagaatcaaaagaccagggttttattatcatctcagcaattactaagtagctacataacactgagcaagctatgaaatctgagatttcaatttctaatttttttaatgaatgaattttagcatttaagaaataaatataacttacctaaaactgtcacttttctctttggttttctaaatcttaactttatacaaattttcccaatttttgaagtgatttttctaaatttctacatgcagttcagattctagataatttttggccagacttaaagtatctttaagagttagccagaattaactgtttaaaaaagtacattttactaaggacttttatctttataattaatctatgaaattgtgactccctttttagctttcattacatttcaaaagaggtcagaaatattcccaccatcctccttcctggacacatctcaattcaatgcaatagtaaactatttctgaatgttaaatacaagttacataaaaattctcccaattaagagatatgagtataattccaaggcatttcttgaaagtgaggaaagtttagtggtgataataatttgctataaaagtagatacagccatatcattgataaatttatatttgattaatgagcttttagttctcaaagactaaaaaacttttcttcaataaatacacatatgtgtttactttgtcaccttagtaactctcaccctaaaattttgtacattggtgactttttatagacacataagtaccactagaggccaccaaatacttcatcttattaaatcaacagatttgcaagttattctggctagcttaaaggtactttaaattaagctaagttacaaggagatgaccatacatggtaatatccgtaactggaaactctcaaagaattattcaaagtcaagcaaaaagatgtaaacatatttcgtacagtaattaggatgtatggatgtatagatgtataattcgacaaaaagctttatgagatcaaaatgggggggtaggtaatataaaaattcattccttacgtacctttgaaagtagacctagagagatgacctacaggaatgacctagagagatggtgttctctcaaattgctgttgtcctttataagcaaattatgtatttaaatatacacctctctatatatacataaatataaacatacagatacataaaatcctagagttcagtattctttcttgcatatcacaaagtctttcacataatgattttaatatctcaagttggctaccatttacagcaatcaaaacttcaagaaagaagtcttattgtcaaaatcacctgactttttttttgtctgtttattttaagacagggtcttactctgtcacccaggctggaatgcagtggtgcaatctcggctcactgcaatctctgcctcctgggctcaagcgaccctcccacctcagcctcccaagtatgtggaactacaggcaagcaccaccatgtccagctaatttttctatgtctttttgttgttgttgttgttgttgttattgtttgtttgttgttttttaatttttttttttgagacggagtcttgctctgtcgccaggctggagtgcagtggcgatgtctcgtctcactgcaacctccgtgtcctgggttcaagtgattctcccgcctcagcctcccgagtagctgggactatagcacgcgccaccacgcccagctaatttttgtatttttagtagagacagggtttcaccatgttggccaggatggtcttgatctcttgactttgtgatccgcccgcctcggcctcccaaagtgctgggattacaggcgtgagccactgtgcctggccagtttttctatgctttgtggagacagggtttcaccatgttgcccagggtgatcatcaccccacattttctaatatacccaaaattctggcttgaagaagaaaacctggcatctggcaaaaataacacctgagtaaactttgctctccctttctaggtgaaagcgctgcttaaagcgtcccacatcctctcatttcttccagcgtcctcctcctttccaatggtaaatagtaaaaactagaaggcccaagtagcatccaaagattctgtagatccaagggaaacttctaaaaaaaatggggcttattgctattgtattatccaccttttctgcatggttatatactatttttcaaggtttttcaggaaatccagagaaactttaatcagtcacggttttgacattctctctaaaaaatcttggcttaactaaaggtctcaaaatcctaagttttcttttaaaaactttatagtgttagcttttacatttagactatgatccatttcaagttactttttgtgtatggtttaagggtcaaggctcatttttttcctaaatggatatccagttgttctagcaccatttgggcttatcacttccacaactgaattacattagcaactcggtccaaaaaccaatttatgaagtcaggcacagaatgataactactgtgtgttctcatccatatgtagaagctaaaaacacaaaaaacaaaaatttgagctcatagaagcagagagtagaattgtggttattagaggctgggaaggatgtggggagggaaggaaaggaagagattggttaacagacacagagtcatagctaaatgggaaatataagttctcgtgttctgtagcaccgttaaggtgaatatggttaacaataatttagtgtatattttcaaaaacttagaagattctgaacgttcacaacacagagaaatgataggtatttgaggtgatggatacactaatttgattccaccattatacattgcatacatgtactgaaatatcaccctgtttcccataaacatgtagaattattacatatcaactaaaaataaaaggaaaaaacaaaaaagataacacatgcttttctttcaataaagtggaacatttcagaaaaaagaaataaattcatgatatatatgtgagtttgcttctagactgtaccatggatctacatgtctattccttaagctaataccatactgtcttgattattgagccttatgggatgtcttgaaaccaggtagtataagtcttccaaactttgttctttttttcccagatagtttttggctacttgctataaaatatgccttagagatttattcatttcagtacataaagctttatttcatactgttttaaaaagttaactacagtaaaatatatataacacaaaatttatcatcttaacaatcttaagtggacagttcagatagtgttaagtacattcacactgttgtgcaactaaactccaaaactctttccatcttgcaaaattcacaatctatacccactaaacaacttgccattcctccctttccccagcccctggcaaccaccattctacttcctgcctgtatgaatttgattactctatgtctctcatattagtgaaatcacacagtattttgttttgttttttattgttgttgttgttgcttgagacggagtctcactctgtcgcccaggctggagtgcaatggcgtgatctccgctcactgcaagctctgcctcctgggctcatgccattctctcacctcaacctcccaagtagctgggactacaggcgcccaccaccacgcccggctaattttttgtatttttagtagagacggggtttcaccgtgttagccaggatggtctcgatctcctagtatttgtgtttttttgtgattggcttatttcccttaacatagtgtccccaaggttcatccttcaggttgaaccttgcataacacaacaaatgttggcacatgttgtaacatgtgtcagaattttcttcctttttaaggctgaataatattctgggggggggtgtgtgtgtgcgtgcacacgtgtatcacatctcacttgtctattcatctgtctatggacattcaggttgcttccaccatttgactactgtgaacaatgctactataaacatgtgtatgaatatctgtttgaatcccagctttcagttcttttaggatatacccagaagtgaaattgttaggtcatatggtaattttattttcaattttttttgaagactctccataccattttccatagtggctgcaccattttacgttcccaccaacagtgcacaagagttccagtttctccctaatcttgctaacatttgttattttctgggatttttgttttgttttggggctttttttagagttggaatctcatctatcacccaagctggagttgcagtggtgcaaatcatagctcactgctgcctccaactactaggctcaggtgacccttccatctcagcctccccagttgctgggactgcaaatgtgagccactgtgcttggcttttttttttttttttaatagcaataataatgggcatgcaatagtatcttatggtggctttaatatgcatttccttaataattggtgatgttagcatcttttcgtgtgcttgtagatctccttatctcgtactttttaacagctgtactatgttctgatgagtggctgtggtaccgctaattcaacgagtccccatactaatggtcatttagatagtttccaaccttttgcatacaggtaattcatacatacacatatatataagtaaccatacaaatcagttggttctagatagctccagtttatgcatatttttgattcaatccttttcactctcaaaaacattctggtttgaataagacacagttaccctagtttcagattaaggataagataaattgctgaaactgaaattaggcatgaacgagctgtgatttaatcttccaggctatttgttacccagaacttacctcatattagaaatttagtattagaaaaagatatttatatttaccacttgattataaaggatacaactaagaaacagacaagtgggagagatatacagagtgaggtatggcagggaccatgccctctctcaggtgtaccactttcacaagacattagtgtgttcattgggcaagcacagcggctcatgcctgtaatctcagtgctttgggagggcgaggtgaggagattacttgaggccaggagtttgagaccagcctgggaaagacagactctgtctctaagaaaaataagaaaatagctgggcatggtggcacacacctgtagtcctagctattctggacactgaggcaggagatcgcttgagtccaggagttcgtggttacaatgaactaagatcacaccactgcactccagcctggatgacagagtatgtaagatcctgtgtctctttaaaacaatcaaaaaaaatgtgttcatcaacccaaaagctctctgagccctgttatctaggggttttaatggaggtttcactaagtaggcataactggttaaatcattgccattggtgactaaactcaatctccagcccttctctctccccactgggggtgaaagttccaacccactaaatgcataattgcttcctctggtgaccagcccctatcctgaaactatttagggcctctcaacccaagagccatctcactggcatataaaacacagtaaatcacaaaggtttcaggagctctgtgccagaaactgggggcaaagaccaaacatttattttttcattataccacaaagaccaaattaatgaggtcaaaaaataaaatggtcaaggaaaattaagataagggaaacaatctttggattcagcatgaacagtgtggcagaggaaagctatttgttcagtaaatctgtttccttcttctcctaagcacacatctagggtttatttaccaatctcctattacagctaactggctttgtgattgacttctgattaatagaatatggataatatatactgcctccagacatatcccataaaactaacttttactatcctccatgctttctcttactactctgacgaccaactactgctgcctaagaagaccctgaggactgtaaccaagtacccccatttttctgtaggtgatttaattattctctttttcctctctctcctctctctctctctctcctttttctctcctctctctctctctctccctgcgtcccctctccacctgcctcagaacttacacctacttggagggcttgctgaaagcatgtccacttggcaccttttacaacttttcccaggaaggtgccaacccaactgcctagtagataactgcctggtagcagggggacccctgccttcgctcatctcctcccctgccttataaaaatgcctgctttctgctccaaaggtgaagtgggacatttaaaagaagaatgctttgtgcctcttccccccaatgagctttggaataaactcactttttttttttttaatcagacatcactcttgttaattgaactctacatttagtgggcatctaacttgctttttcgttacaagaccacattttgaaaatggcaaaccccactcccatctaccctactgccactaattagccattatgtaaataaggggaaaaaaaaccttctattatgttaagttactaagatttccaggtatatctattacaaaagctagcattaccttaaccaattcagaaaaaattaacttcaactttgtgatttcagaacagacaggacataaactatacttcagaataaatccctgcaatgtgcgtgagatagaggtatgaaatgagagtaaataacaacaaattgtaacattacaaatattaaaatattaacagatgatcatctaataacatccctgtaggaaaattattattatcagagagagtaaattaacttcgctcaaggcttttaaatttcaaatcccgtattctttctactgaaccacattagtctcttagagaaattgggacagcaaatgaagactcactgaaaacattttataataaagaagaaataggatagtagctaaaacataaagtcaagaaatttttttttgctaaaattatagatacaatggaaatgggatgaatagaaatagaatagtagcaaaaaggaactggaacttaagaagtacaggataagccataagggtgatatgacagacaagcacatgagagatgagtagcagtatgataccatgtaacgaagtccaggctgtccgcaaacaatacacagatgtagtgggtcaggcctgtgtagctctacatcttcctcaggaagttctctttggtcttaaagcatcaggtagagcagaaccctagcatgacaagaaaactttgtctaaagtggttctgagagcagaagtgaagtacgtgactgtaggggaaagattttctagcataactgagggtatcgatgcactgacaaaataagcagaattgagagacactagttctagtacaggataaacaaaccattgtagtgagtatggaggagtgtattagaatcataacaccaagattaattaatctcttcctcagagatgataaaataatctactacctcacatgcactttccagacttcatgaggttccctgccctgtggttttattacttcaaagagacaacagtctgggagtgggtaccaaaaatatgagctcaaaccaccattttctagcttaaactccatttatatccacttgctttgttgtgaacataacttttaaaatcctttttatagttcttagtatgttttaaaagccaggtcttcatacttcgtagcagttttcttaagttttcagcctcaactctatgccaaatcaagagtccttccacacacggtttataccaagctttggaccatctttaaaactgtgtattttacctcgcaccttacctcaggacagaggctttagattccatctacagtatctaccatacataccttttataaactttttaaaatctgtcttcttctatttctcaaacctctctagctggatagtatctgcctatctttattctaaataattacttataaatctagctttatatactcacatgcaagaacttaaatttttacttattatatttcattttcttaaacatcccataactcctgccttttaaaatgtttgtgaaccctgattctgtcatctcattctcctttcaagcatattcttctacaaaaaggaagagaaaagtctcttctaaccaaacagtatttacatctatgtcagatggatgattgctacccatttattgtatgtattgcattctaaacagcttaaagaattaaagcattacatggtacttatatttacctctctgtcctcaaataacatcccatattaaagctacttttcctatgttacacctgcacaatgtggaatacaagctctttttcctctcttctcctcaatctacatttacagaagactgaattcatagggcaggtagtcaaattgctagtgtataatttaaataacagaaccaatttcgtaagaacattaaagttagaaattctaactgaatgcttctctttttcaagccacaaaatttatttactacagtactttagtcttctaaaaaaatcaggtacatctaacaaaaaccttagtacaggcatgccctactgagattgtggcatattttctgaataatgatataaaaaaattcactcctaaaacagggcatcttaaaaaggagctaaggtcggctgggtgtggtggctcacatctgtaatcgcagcactttgggaggccaaggcagggggatcacctgaggtcaggagttcgagaccagcctgaccaacatggtgaaaccctgtctctactaaaaatacaaaattagccaggtgtggtggcacatgcctgtaatcccagctacttgggaggctgaggcaggaggactgcttgaatctgggaggcagaggctgcagtgagccaagattgcgccactgcactccagcctgggcaacaagagtgaaactccgtctaaaaaaaaaaaaaaacaggagctaaggtcaaaacaatacaattttgctttaattctttaagctgtttagatgtctctgatctagccaataaaaatattgttcatataatcaggaatagattgttaaccatagaatgcctctgaaaaacaattttctttgaaatgctgtcactaaaattaactgcaactttatttatatgactgtctgtggttttcgtgtatgcctaaaaagcacaagagaaagataaaaatatcccagaattggaaaagtagtcattatgtttggtttagcttactttcatatttttatttttaaaatccatccgaattaaagtttaccatttttcaatagaaaaatagaaggcaatttctttatgtaaaaatggaaaaagaaattcagcatcctctaaattaaatttggaatttgattagtgaatgaatgcctaaaatccttttccaccagttgtaaggctgaacacatatctatttttcatttagaacttacatacatcaattatgtgttccctgggaaggagaagtggcaacagaaaataatttgaatataatattatattgtgagcccatgtgtgttctcagataaaataaataataaagttggtccctattcaataacacagccttctcttaacatttctcaaccttagttcttccaaatcacagaattctacatttacactaaaagactaaccatttacactaaaatgctaaccacagctaaaagtgtcactcctagaaatctctcagatcttggctgacactaagagtcaaaagatcagggtttgaatcctagctctgctgtatccttgctgttagatctcagtaaagttatttaaatttcctaagcctctgtttacttatttgtgaattaatatactaccaccattatgtacgtgagttcatcacaatctattaatcctatacaactgctacatattaacatgaatgttacatgctaatgttgttccaccattatggaaggggtaagaatttttcccataaatcatcagaaaagggtcacgactacactggaaacaacaaaccacttaaggattaagccagatcaccttcaattagactaaaattttattatatctatctttggtcttgaagccgcagggttactcaagatcacataaggcatcacaattattcaagctattgttgttcatatacagaatattcacactctctaaagatatgcaaaaataaggcaataaagactggacaataaaaaattaatagtgatttattctgtttttaaaatggactttgatagatgtaagataaatttattttgtacttgacaacaccatagacattaaagaattgaaattgcgatccattatggaaaaaggaaaaggaaaaagaaaatttctgacgtaatccaacagattactctttaaatattaatctagcccaacaaatcttgaaatgctatgctaagaatatgccaagaagtcatctaggaaaatcttagggaggaaaagttctgtctaactcttagcacctccatttcactattctaacagcacatgactccacttattggagaaacatttatagcacttgaacatggcagtgtctgtcatacaaagagaaaatatctatttactaagtagtaaaatcagtatgtttctctcccttgctactggagaaataagagaggtatcataggtatctattctcttggttttcaaaacaacactatcctttctctgtcctagctaaatagctatgccaatccatgatttcccttctccctctatgatgtctgttggttcctgaaacttatgaaggtgagtcactgctcatactgttaaattggtatagtttatatctctccacactttgatgtgaatggaggtaggaacccacaataagttctaacaggtccctagcaccaaaaatttcccctcaatcacactaaaagggacattgaaacagggtttaaaagcttttatagaacaaatgcctgcttattcacactgtaaggccaattactggtatttgcaggcatatggggaaaaagagaaaggaatgcaaagggctttccaaaaagccattttccttggatcctcacattccttccccatttttaatgccaaaattcaagatttaccccctctgtaggcctacagaaccctcagctttctttacatggctgagttataacaatcaaaactaagcacctagcaatgtatctttaattttcagtgaagcaaaactggacagttattagctacgacgagaaaatttacaattttcaatacaaaatatctaacagatatttctgatccatgccaacaagagaatgaacaattgttcctgtgggtaaggtgctgagatatgttgaacaaacagcaacaatactaattaaacaatgggacaactcatttatggaagacattgttctaatcattttatgtgtattttttccactttatctttacaacaacctatgagattaatataatcattatcctcattttatagataagtattctgctggctcaaagtagttgagcaacttgtcaaaagtcataccacgcagctgagattttaacctaggcactctgctccagagcctgcactcttaagtatcatgttataccaaatgtcctctcaacaggactgctttgaagacactgcttctatgtgtttatgtgtgtgcatatccataaacacaatataaataagtacacacacacacccccagtaaatctggagaaccaaacttcgtagacatattacaaagtactttagtaatcacctttctagtccctcagtttaccaccatggatccaccaccagatagaatatcttgggtagcataaattatgttcaaccaataaattcctttaaaacgggtaacaacaacaacaaaaggagttgaactgcactattataaaataaccttcagaccttgtagctaaaaacaaaagaaatctaatttgtgattttaagatcaaattcaagccatgactggtcaacattaaatgaacttttggttttttatttatctgtgttttttgttttgtttttactaagacaataacctggacattttcaggaaaaaaaaaatatatatatgtgtatccctgaagttactaggctaagacttttactaaagaagcagtggaatttttctgcttttgagtatatgaaaatcatcaatttcatctttttttttttttttttttttgagagggagtcttgctctgtcgcccaggctagagcgcagtggcacgatcttggctcactgcaagctccgcctcccgggttcatgccattctcctgcctcagcctcctgagtagctgggactacagacgcccgccaccacgcccggctaatttttgtatttttagtagagacagcgtttcaccgtgttaccaggatggtatcaatctccttacctcgtaatccgcccgccttggcctcccaaagtgctgggattacaggcatgagccaccgcgcctggccctcaatttcagctttaatattagaaatttaaatgagaaaaagaagagcaaaataggcattctagaattaatatattcaaagatgaccgtacttgagggactaggagggaagataactatttctagtactgtaatatcttacaattaaattatcaaattatttaacagcaaatgtaacataaatgtaaaaatcaatgtgacaaaaaagaaaagtaacattataaatatgcaataatacaacaaccacttaccaactcaattccctgtggaaaaggtgtatcatcccagtccttctgtggaaatctctggattattttccccagaccttctcctgatcctgttaataaaatcaaagtgaatcattattataggacactaaaaactacaaatactcattctactcttacttatttctaaatgaatatttggtaaataagttaataaactgattaaacattttcaagttttaaaaaacatgtgagtatgcatcatctaaacattatgcagtaggacctccatatccatgggttttgcatctgcaggagacacccaaccatgaattgaaaatatttgggatgaaaaaaacaataaaattaacaatgcaacaatttaaaaatgcaaatcttaaaaatacagtataacaaatatttccataccattttcattgtattaggtattataagtaattaagaaattatttagagtatataggaaaatatgcataggttatatgcaaatactacaccattttatataaggaacttgagcatccatggattttagtatccgtgagggttctggaacaaatcccctgcaaatacccagggatgactatacagaaataacaggcaatctctattctataaacacttttttttgaggcagagtcttgctctgttgtctaggctggagtgcagttgtatgatcttggttcactgaaacctccgcttcccgagttcaagcgattctcctggctcagcctcccgagtagctgggattacaggcacccaccaccatgcccaggtaatttttgtacttttagtagagatggggtttcactatgttggccagactggtcttgaactcctgacctcaagtggtccacctgccctggcctcccaaagtgctgggattacaggtgtgagccactgcacctggccattattctgtaagactgactgatacgtatgaaaagctaaaaaacactagccagaggcattgaaatctagtctctaccacgttatgggagtaactgccctttgtgccccaataaggaaattaatcccaaattgaaatttaagaagaacttttctatggagatgaaataatttcaagtaacaaatgaaatggcactgctagcactaagtttcagttatgggctataaatactgttactggttaaagtttctgaggctggcctgggaacttgaccattgtttaggcagggtttcccaacatcagcactactgacatttgcagatggatacttctttgggggaatggggattgtcctgtgcattgtaggatgtttagcagtattcctagtctcaattcctagattccagtagcaccctctaccaccagcaagatgttacaatgaaaaatgtccccagatgttgacaaacgttccctgggttgaagaccacagatctctatcactgttgttataaaattatcctgtgacaccgaagaaggaatcaacttcccattgaactttggggatgtaatttgtgagtaaactggggatggaaggtacatgttaaatctaaactaattcttgctatagttttttaagatcttcatgttccttgcatattctacatgttgtcctagttcatatgaaatgaaggcaacaatattctgattatttgttttgtatacctaacttgaggaagtcttcacaacgaattcattttgttaatatactgtaaaaatcatccactatgatttctcaacctcatctctatgaatgcaacttctcccttgcccctcacctaaactgcaatcaatttacggccaaatttttatgtttaaaatataaatggaaagtgacattcactttactgaccaactcagaactgtattctgaaacgaggtcaaaccaaaatccatttgaaaaagacaaaataaaaatattctcaattaaaatgaataattgctgcagtacagtaacttatctatctcttgttataggggaatgaaggattttgttaagagtaaaccaactttttatcataggcactcattcttcaaaatccacctcaagcatcatcacttacgacatcccaagcagggttaatgaaacaaattgctaggtgttggaggtacacaaatgaaaaagacatagtccctatcctaaaggaactcataatcaattcggggaaacaaacaaatgaactgataatttcagttatgttatcgtaagctcaatgatagaaagaccatacaaaactttctggaagaaatgacagcaagcttacttcctttcagtaaccaacttgtttccccaagcacctggcatactgaattcctggcatatagtctatactgagtaaaatgtttactttaataaattcattggtactgactgaaattgttttaagtttattcctcccttctttttaaagagataaattaatgtacttattctatcatgtttaatcacatccctacattgttttttcagttctgaaagccatactaatgtattttacgttcaagaaatatttatcatattaattattttttggacagggtctcactctgttgcccagactggagttcagtggcacaatcatcgctcaccgcagccttgacctcccagactcaagcgatcctcctacctcagcctccaagtagctgggactgcaggtgcagaccaccacaaccagctaattttcatattttttgtagagaccgggtttcgccacattgcccaagttggtcttgaacttctggactcaagcaatccacccgcctcagcctcccaaagtgctaggattatagcgtaagccaccgtacccagcccaatcatattatcttttactaattataaaagtaatgttaagtgcagaaaggattttaaatacataaaaatataaagaagaaagcacccataatcccacacctggagacaattattattaacattttggactatccatttattcctaggtttcttgcataaatatatatatatatatatatatatatatattttttttttcctacaaaatgaataccacactgaacctaactttatacactggcttattacttaatattttacaaagggccttaaatgttgttgaacatacattttctagtttctcactattataaataatactacaataaacgtctttatttacaaatctttaacctcatctcacttctcctgaaaaaatactcttttccagattctacctctagtaaactgtggcagcactgtagcatctgtcagcaaatgtctgaggcattctgacaacatttcttccttttactgaagctagaattggtgtgtatcccttataagaaaagaacctaaatgggaccacactactctaagaggcactttgatagatagattgagttctttcaaactggtagaggatctggaaacaattacagtcatacttgggagatactgcaggtttggttccagcccacagcaataaagtgaatattgcaataatgtgagtcacacaaattttttggtttctcagtgcatgtaaaagttatgtttacactatactgtagtctattaagtgtgcaacagcgttacgcctaaaagatgtacatgctttaatttaaaaatgctttattgctaaaaaatgctatcaatcatctgaggctttagcaagttgtaatctttttgctggtagaatgtcttgcttcgatgctgatggctgctaactgatcagggtggtggctgcggcaattattgaaaacgagacaacagtgaagtttgccatatcgattgacactttctttcacaaaaaatttatccatagcatgcaatgctgtttgatgttattttacccacagcacaacttctctcaaaaattgaaatcattcctctcaaaccctgctgctgctttatcaactaaattgatgtaatatcctaaatcctttgtcatttcaatgaaattcacagcatcttctccagaagtagattccatttcaagaaaccattttctttgtttatccataagaagcaaagcttcatctgttaaaggttttatcgtgagattgtagcaattcagtcacatcttcaggctccacttctaacactagttattttgctatttccaccacatctacagttcctttccccactaaagtcttgaacccctcaaggtcatccataagggttggaatcaacttcttctaagctcccggttaataggttcatatttttacctcctcccatgaattatgaagttataatggcatctagaatggtgaatcatttccacaaggctttcaatttactttgcccagattcaatcagaggaatcactacctatggcagctacaggcttatggaatgtatttcttaaatagtaaaacttgaaagtcaaaatgactcttgatccatgggctgcagaatagatgttgtgttagcaggcatgaaaacaacattaatctccttatacatgtccatcagagctcttatgttaccaggtgcactgtcaatgagcagtaatattttgagaggaatatttttatgagcagtagttctcaacagtgggcttaaaatattcagtaaaccatgctataaatagatgtgctgtcatccaggcattgttgtcccatttacagagcacagacagagtagatttagcataattcttaaaggcactggaattttcagaatggtaaatgagaaacagctttaatttgaaatcaccagcaacattagctgctaaaaagacagtaagcctgttctttgaagccaagcatttacttctgctctccagctatgaaaatcctagatggcatcttcttccaatacagcctgtttcgtctacactgttactgtagtgtggctgccctcatcatcttagctagatcttctgcataacttgcagcagcttctacataagcacttgctgcttcaccttgcactttcatgttatagagacagcttcttttcttaaacctcatgaaccaacctccagcttcaaacttcttttgcaactttctcagcctacacagatttgaagagagttagggccttgtgctgaggattaggctttgtcttaagaaaatgttgtggctaatttcatctatccaaaccactcagactccatatcagtaataatgctgtctcattttcttattatctgcattcacaacttggctgtttggtacaagaggcccagcttttgacttatcttggcctttgacatgtcttccttactaaacataatcatttctagattttgatttgaagtgagagacatgcaattcttcctttcacttgaccacttaaaggccattgtaaagtcatcaactaacccaatttcaatactggcgtgcctcaaggaatagagaggcctgaggagagggagagagatgatggaatggctggtcagtggtgcagtcagaatacataaatcatttatggattaaatttgccacctttcatgggtgtagtctgtggcatgccaaaacaaaacagtaatatcaaagatcactgatcacatatcaccaaaatacatataatggaaaagcttgaaaacttgtgagattaccaaaatgcgacacagagacacaaaatgagcccaagctgttggcaaaatggagctgacagacttgttcaacattgggttgccacaaatcttcaatttgttaaaacaaacaaacaaacccacccataatatctgtaaggcacaataaacaaataataaataataagcaaagaacaataaaccaaagtatgtctgtctataaaaaggagatttagtcagaaaatttgaagcaaaaagtaaagccaggtgcactggctcacacctgtaatcccagggatttaggaggcccaggagtgaggaggccagaagtttgagaccagcctgggcaacatatggagaccccatctctacaaaaattagctgggaatggtggtacaaacctgtagtcccagctactcaagactcaactggaacccttgtgcatgttgatggcaatgtcaaatggtgtacctactatggaaaatatggaatatggaggtatggagtatgaaggcttctcaaaaaattaaaaatagaactatcatatgttccaacaatcccacttctgggtatatttccaaaggaattaaaagcaggatgttggtcaggcataggggcatgctattgtaatcccagcaatttgggaggctaaggcaggaagactgcttgagctgaaaaattaacatttatctgcgttttgattgtgacctatcatgggaggttttatatacatatgaaacagggttaagaatatggactcaggatccaggttacctatactctagtccagttccaccattccatcctgggaaaattacattacttctctgtgcttcattttcccccatataaaaaatgaagatactattacctaactcttagagctcttgtgaggaagaatttaagttaatgtgcatgtaaaatatataccagtatgagtaggtgcatgtttctcagaacagcactccaacctgaacataatagttgagattactgagccggtctgaataacatagtgtagagaagaaaactattattgttctagacaattatgttattaacaatgaagaatggtgttatttaaggtctcttggtggccacaagactcttgatttactggagttacttttgaatgaaacatgtaaatccctttttaaaacatgtttaatgctgttctgtacctgtacaaaagatttttcagactcaagttttatccctgttaaatttctttagtcagctcagtacatgcattttttggatcctatgtcagttacccagtgtatttatatccattttttatttaattaacttactttttttagttacagatatatactacaaaatgcaaccattttaaattaacagtctgatatatattgacaaactctcaataaaaacaattgcagtagaataaaaacaaaaatggagaacatggaaattaattatgttatattaaaatattgcttaaggagttcctccagaaaatatttcccgaaaaaaaattcatcaatattggcataagtccaattataatttcccgataataatcaaaatttcctgaggataaaagtcttggtcaaaacatgctatatacacattactgacactggcaccagtgcttctattccattctctcccaaaacaatctgcttggaacttcagcattgtacctagcacctgttcttctctcttcttcattaagaatatcatctcagaagaaatggctaaagcaaacgcacagcactagaaaatcagacttttgggtacatgtattgatttactcattttaatagaatagaagctgatctaaagatatctgtccaaagacagaactaagatgaaggccatattcaacttgcaagttccaagtatcccatttgtgatttggaaaatctgcttttgagcaaatgatttttttaaaatgttattttcatgttctctagaagacctgtgttataatgccaagacagccagaaaatcaaagttcaccagaataagtagatctaattgtgccagtatagaccaactttcaaaagataaggaaaataaaagctgctcattcactgaaaagaaagcatgcaggaaatcattctacaaaaggctttcatatttgatccatttagcatttaatgagagaagtctgtttgtttcaactgacataagccttttttgtggttatttaaaaatttaggtaggaatgtaatgtgattttctgattttccagtacaatctcctattattcaaaaggtttatttggaacatacaagctatttttcccagagttaaacttaggaaagagtccataggcttttacagaagtgaaaaagaatgcatttttactgactcacgcctgtaatcccagcactttgggaggccaaggcgggcagatcacttgaggtcaggagttcgagaccagcctggccaacatggtgaaaccccatctctactaaaaatacaatcactgggtgacagaacgagacttcatctcaaataaaaaaatgcatttttaagttgaagagaatacataacgaacaaggtatgtcattaaaaataataaataaacagcagctacacagctttaatccttataaactcacagttcactgagaatgtataaatccagcaatttagagaatgtcaagattaagaaaaactgagaaatgaatacaaactgaaattaaaactaaacatatgatctagcactttcatgaaattcttcagaatgcatcattttactgaattaaaatgtcttctttaacagcaatgaagaaagaatgattggcagtctggaatgctgtgaaaactatatggttgtacatcaacatttaagaaaagaaagtcttatcaagtcccttctccaaatatgcattgaatgtgttcccacccccagcatcattcacaatcactctagtagttcaaactctcatcatcttcatctgggtaacagcagcagcctcatcatctccctgcttcctgtttcacttcactccgagtcatgttcaagtttccggcagtctagaaataagctctgcaaaatcaaagttcttcacactaatttctctgatcaaaataattcagtaattctcccactagctatataataaaatagtccaaaactggccgagcgagggggctcaggcctgtaatcccagcactttgggaggccgaggcgggtggatcacgaggtcaggagatcgagaccatcctagctaacacggtgaaatcccgtctctactaaaaataacaaaaaaaattagctgggcgtggtggcgggtgcctgcagtcccagctactccggagtctgaggcaggagaatggcgtgaacccgggaggcggagcttgcagtgagctgagattgcgccactgcactccagcctgggtgacagagcgagactccgtctcaaaaaaacaaaaggtccaaaaatcattaccttagggacttctacctcatccaaggtgaagtaacaaggtctgaatttaccctccaacctacaacaactaaaaaaacaaaatctacaaaacaatggttttcagacacctgacatcaggcaatagaggacagtgaacccagagagaaagaaaacaaattatgtgagccctataattgccccagcttacttcttggtaagagtttccatgcaggatctagatgtttagctggggtgggggggtgagaggggggtgcagtttctagactgcagttcaatcaaggaaaatccagaagtcctggtaaaactgaagcaattgaggtgggaatctagggaacccaaagaggttagggttcacagagtatcaaagagaagagagattaacagggagaaagaagttcagagacctgcagaaggctgaatgaagcacacgaaaggaacagaaaggacaatccctagaaatcacacaaggccagggactgtttttgttcccaacagccaagaggaaaaaacgaaaaaacttgcataattcactaggcatcaggcagagaacccagagggtattattgcctcagtgtgaaaaattaaccctagataaaatgttgctgtagatctacctaacaaagctgggaaacgagcctcaaaaagatcaaactatttccaagtgacttaattacatctcagaacgaagttcaagaatatttacaggaacacagaaatatccagcaatcaagagagtaaaattcacaactctaacatgcaaacaaaaatcactaggcatgaaaagaagcagaaaagtatgggccacaaggaggacaaaaatcaatcaactgaaatagactccaaaatgatgtaggtattaattagtagataaagatattctaaattatcattatgttgcatattttcagtaatataaatgtaaaaaatatattggatatagctaatgaattagacactacaaggaaaaaaaggttaatggttgttatatgatagaaacttccaaaatgaaacagagaaacagactgggaaaaagacaaaaaaacaaaaacagagctgtgcaacaacttctagtggcctaatatgcatgtaacaggagtcaggagtcccagcatggaatggagggaatggagatatatctgaagtaataatggccaaatttaatgaaatttgacttttccaaatttgatgaaaactataaacacactgatcatagaagctcatcaaatcccaaacacgaagaacacacagaactcacaaaggcatatcataataaattacttagatataaagataaatatctaaaaacagctggagaaaaaagatacattgtgcagagtaacaaatataagaatgacagcagacttctcattataaacagtacaagctagaagacagtggagctacatctttaaaatactgaaagcaaaaaaaaaaaaaaaaatcaaccaaacgttttatacccagagaaaatatccttcaaaaaaaaagctgagtatatctatataatcgaatattatttgaacttaaaaaggaatgaaagctgggtgtggtgactcacgcctgtaatattacccagcactttgggaggccaaggcaggcagatcacgaggtcaagagatcgagaccatcctggccaacatggtgaaacctcgtctctactaaaaacacaaaaactagctgggtgtggtggcaggctcctgtagtcccagctactcaggaggctgaggcaggagaatggcgtggaggcaggagaatggcgtgaacccaggaggcggaggttgcagtgagccaagatcatgccactacactccagcctgggtgacagagcaacactccatctcaaaaaaaaaaaaaggaatggagtactgatacatgctacgtatcatggataatccttgaaaaccatatgctaattgaaagaaaccaaacgcaaaaggctacatattgtatgagtccatttatatgaaatgcccagaaaagtcaaattcaaagagacaggaagtaaattcatggttgacaagggcttaagggggtaaagggagtgattgctaacggatatagggtttctttggggtgatgaaacattttaagtaaatagtggtgatgtcgcatgttcccacttgtatgtggaagctgaacaatgacaacacatggacatagggaggggaacaatacacaccgcggcctgttggggggaggtgggaggggggaggcagagtatcagggtaaaatagctaatgcttgtggggtttaatatgtaggtgacgggatgataggtgcagcaaaccaccacggcacatgtttacctatttaacaaacctacacgtcctgcacatgtatcccagaacttaaaataaaattgagtttaaaataaataaacaaataaataaatagtggtaatggtcgcacaactctttgaatatactaaaaccactgcattttacattttaaaaggatgaactttacggtatgtaaattatatgtcaataaaggattttctttaatgaatctctgatcagacacaatggtatagactcattttttcttgctcttccccactaagtataagcctataaataacacaggaggcaaccaaaggagaactctgaaaggtggtaagaggaaagtaaactgttttgtaaccctcggaatggaggaacaacacaatggcaggacatcttacctatctctaccaaacagaagaaggcaacccaggcctagcatgtcccaatccccaggttaacaacagaaggcagccaaggtaggctcactcatctcccagatcaaacagaagttccactaacaacacagggaaagcccagaaccatgagcaggggatagacagccacagtgataataagcagccagggaaagcactttccttcactcctggccctgactccctttccccaaaggcagataccatgtgagtaggcatcaccagcaagagagaccccatcacaataagcaggatggcctgggaagcctttgtcatcacaggcctaaggctctcctacacaaccaagagaaactgaggtgtccagctagcaccagcaagaggtatctcgctgtatcaagtaacctcggcagacattttgtttctatgggcttaagaattccctccccaatccagaaacactggggtagtcagaggacaccagtaagagagactccactgtaacaagcagtctggcccaggtagtctctttgtcctcatgagtcagaatctctcatgtactccccagtgacatcagggcagtgaaatagcaccaataatgaacatcgtgccacacaaagtagcctggtccagcaaaacctctttgtccctgtagcctgagagtcccctcccccaccaagagacatcaaacagctcagcctggggaatgatttctgccacctcaggcagcaccagtgggagctctagtgctgcctgaggtgacagaagggctatatttaatggccccagcattaaataaacaaagaaaaccaaataaccaagaaaatcaaaataacactgaaaaggctctgaaaattaaactgccactggaacaacagcctacaaaattagactatggtctacatgctaactctaaacacaaaaactaacataacagccaaaatgtccaggatatagtaaaaaagcacccattacaccaagaaccagaaaagatcacaacttgaatgacaaaaagacaattaactgatgccaacacagacatgaatcagatggaagaattatctgcaaagattttaaagcagctaccttaaaaatacatcaaatcataaactctcttgaaacaaatgaaaaatagaaatatcagcacagaaatacgttataaatcaaacagaaattataaaactaaaaaataaaatatccaaaattaaaatctcactggatggtttcaatagtagagtgaaaatggcatagcatagaatcagtgaacttgaggtgaaatcagtagaatttacccagtctgaacaacggagagaaaacaaattaaaatataaagaacattgggaacccatgggaggtccacagaccataacaaaagatccactattcatatcactggagtcccagaaaagaggagaggaagaggggaactaaaagaatattcaaagaaataatggctaaaacactcccaaatttggtgaagcaccaaacatattcaagaagttgcgtgactctcatactggataaactcaaaagaaatctacactaagatacatcataattaaacatctgaaaattaaaaacaaagaagtcttgaaagaagccagagagaaacattttacctacaggataacaccaattcaaatgacagcaaatttctcatcagaaaccatgaaggacagaagaaagcagcacaacatttttcaagtgctgaaagaaagaactatcaactatgaattctatttcccacgaaactacccttaaggaatgagaggaaaatccagacattcttggaccaaaaaaaacaaagcaaaaaaaactacactaacattgaagattggctgaaggaaggtgtttaaacagaaaggaaattacaaaagaagcaataccggagcatcagtggcaaaacaaaaatacaaatccaagtcatcctcaatctagtacttaaatacttctccagtccaatagctggtgttctgatatcagctggctctaaacctcttcccagggcaatattcttcatgcttattccaacaacctttaagattgcttaaaacttctctgtccttgaagcttactgcttgcctgatttgcaacctttagttgccagggtagggtgaggagggaccagaaggcactgtcagaattgattcttttttcaacacaaaacttaatctgagtatgaccctaacagataagtttagtcctagggccctctctcctaatacttccttttctatgggaaaaaaaaactagatcatacaagggcaagcccaaaggcacaataattaatattttttctcactgtaacaaatggaaaacaagctcaaccctctctcacaagcacttatttaactacttaaagaaaactactatgtcttatcaaaggtaaatatgatatccatttcccttaacttctgagtacaagggcctattaaaacaccagtacattaaagctatcaacagtaattatgaatacacagaaatcatctaaaatataaataccttcccatggttgataaactaatctaagaaagtcctcaagaaaaacactgccatgttttgaaaagaatactacattggtaatcaggagatctgaggcttatcttagctctgtcactaactggtgaccttaagcaaatcctctaacttctctaagccttggtctcccacctgtaaagtgatcttaggtccctcctggctctaaacttcaggcacggtaaaccaacaaaaaatgtgaaatacatacatctaccactagatggcataacactatgattgctgatctgaaaagcagaccaaaatctcctccagatagattatgttgttaggaaaactataccagtttaaattataccaatttaaactaagcctcaataacttgtctgctggcaaagaactcccggctacttcataaacaccttcattttgtatgatgtagaatgagaaacctctttctgaacttgttacagttatcatgaaccaaactgaaaatttacaaagacatgattacagaattctgagaaactaagtttacagcaaaggagggggtgaaggaggcggtgaagacgtgtggcaggaaagaacacaggtggagggacagaatggagaaaaaaaaagaagctgttttttggcaatttctgcagtattatctatgcctatcaaggtattacgaaaattattaccactataccacagaatatttagcctcccttgataattcagcagagaaaacactgccacattaaaatttcagacaaatttcttggaaccagctttaaaaacattaatatattggtagtatctataaaacattgatcctttcagaaaaaaaatacaactgaaaatttaaaacacaattctctatgacttaactgtaccactttcactatgtttaagttatatttacgttttcttccaattgcagataagactagtacatagcaagtgcttagtttcagcatagattttttaaatacaacatttttaaactagggaggaaagttattgattaaaaaacagcaaaggctattatgttaatcttccttaaacaagaaattcgtatctgttgcataatgcaactggacatgatacacataaatttctcattaaaactcattcaatgtgtccctatcaatgtattccctaaccctaagtcaataaaggagaagttacaaaaatccttagttctccagcaacctgtgccttcaaaatcaagtaggcctttctcattacacaaatacaggtgacaaatttcttcttcccaaatacagtttaaacatgtcccctgcctacaatgctctcctctccacaaatttgtttttttttttttcccatctctaacttcctatctgcaactcaaagttcaccctggagcatcgcatctacagcacagataatccaagccgtgtgttttctgctcaactcttctctcaaacgcaaacttcctatcctgcaaaaagcattacagattgtttatctgtccaaacaagttatgaggctggttataatatactttactaccagctgttttccttaacgtttcactctcctgaagacaatcatttccttcttgtaacagatagagtatttctcaagctcccaatgctgtttgtaccccctattaagcatttccataaacacagcaaattaatcatgaccaaattgggattttctattatttctataaaatctgtatcttctctccctccattctctatctcagagaatggcacgttatccatctaagcattcagtgtctccactaggattatgttccactgcatatgacagaaaacctaaaacattaatagcttaaacaagataaaagtatatttcctttcatataaaagatgtctcgaagacaacactcaggatcaatgtcagatctatgggctcaaagatccagcttcttcaggttcatcactccactatctacaggtttagacccttgttctcatggtttaatatgtctgctagagctgcaaacatcacatccatgtttcaagtagaaatcaagaaggaaggaaggaagctgggcacagtggctcatgcctgtaatcccaagcactttgggaggctgaggcaggaggatcacttgagcccaggagttccagttcagcccgggcaacatggcaaaactccatctctacaaaaagaacacaaaaattagctgagtgtggtgttgcacacctgtggtcccagctacacaggaggctgaggtggcagaattgcttgagcctacaaggtcaaggctgcagtgagccaagattgctccactgcactccagcctgggaaacagagcaagaccccatgctcccttgcacaaagaaaaaaagaaaagaaagaagaagagaagaggaagaaaggaggaggagggagaggaggaggaggaagagaaggaggaaggtatagaatattttaaggagaatttctggaagaacaatttcacttacatatcacttgccaaagccttgtcacatgattacacccaatagcaagggagtctcttagtctcttagacaattgccctgctaaaacacaagagttttatttctaaaggagaaaaaaatagtattaggagacaactggccgtttctaccagagtcagctcttagtctgacaggtgccaacacatcatgtagaaccatctgttaaccaagaacacagcagactccccaggaataaaaccatgggtgtggggttgtgaaaggaatcacagtatggaaagggcctcttgtggccaggcgcggtggctcacacctgtaatcccagcactttgggaggccgagggaggtggatcacctgagatcaggagttagagaccagcctggccaacgtggtgaaaccccgtctctgctgaaagtacaaaaattagctggatgtggtggcaagtgcctgtaaacccagctacttgggaggctaaggcaggagaatcgtttgaacccaggaggcggaggtttcagtgagctgaaattgcgccactgcactccagcctgggcgacaagagcaagactcttgactcaaaaaaaaaaaaaaaaaaaaagagcctcttgcttgctcaatgtacatgtgttttcagtacttccattttgcccaatcccaggtatactgcttttatttgacaatgtaacactgctatgcatgctcatgtcactggtatccagtatttagaaatttgttctctatcacatctaacaacaaagccagtagccttctcagagaagatacagttagctctaaaatgaaggaggcttcactgtgattctcctgtcagagcctgccacaaattccacatagcaaccaaatggcagtttttatagattgttgagtcaagaggttggaacagtacacttaaaatttagtatatcctgacttcaaacccagagagacccaccagttactgtacttctttttggtagcagtgaatacaagatgcagtagcttatcttctacttcagaaaggacatcccaatatatcccaaaatactgttacctcagaaatttcactaaggtgtcaggtcctccaattttttatggacttcatgtcccatcatcagctgtgtctttagtgtctttacaaaggatctaaggtgtctgctagttctctatcacaatgtcctatcaattagcatgatgtcatcactgtaggggaccaggataacgtactgtgggatagtgagatgaacaaaatccctacagactaaatgatggcacagagccaaaatactgacctaaccatggaggcaatatgatgacggtgtactatactgctgggtatttctgatgttctcggttaattagattcagtaaggcatttgatagatcaaatagttaactaccaagtgcctgtttctagcaaagttctgtttctagcaagtgcctgtttctaccaagttctgtttctagcaaagagaccacatgtggaaccaaatatacaactggagtggtagaagcagcttatgataatacaccatcattctccaaaatgtatctatcttctgcataggtaaaaccagagttagcaggctgaacctttcaagtctttaatatggcactaatctctgagattcaggatgtgagactgctttggtaaaaagaactttgggaggttacacttggctcttcctaccataaagtccattaacccatggatatgggaactaatttggggattcttccacttgttgaacatatttattccagacatgcagtaagaaacaagatacaaccacggtacgaattcatggactgtgaaataatttcaagtcaaagctccattccatgcctgatttccacaagctcccatctgcctcatggaacacaacggtgtcctgagtcgctgggaattatcattagctcagcttccaataactcctgaaaggtttcagtatttgtcttctgatgaacagttaggcttgtaaataataaaagacccctttctttagggaaggctatgaagaaaattaattgtgcctacttgtgatattatcacaaggtccttccttaaaggaagatatgctgcctcttttttcttcaaggagttctagatttgtaaagtgataaatctataggtattagacattatggagacctaaaatcaatcctacattcattggaccttaagtgttctcttttcatttgtttgtttagttccagtatcaagatcaagaccttagtgagctacccttccatgacagttctaggaaccccttaatcaatttgcatactatattaagcatgcctatcttgagtctgatggttaagttctgttactcgcggcagggcgcgctggctcacgcctgtaaccccagcactttgggatgccgaggcaggcagatcacgaggtcaagagatcaagaccatcctggctaacatggggaaccccgtctctactaaaaatacaaaaattagctgggcatggtggtgcacgcctgtagtcccagctattcaggaggctgaagcaggagaatcgcttgaacccgggaggcggaggttgcagtgagctaagatctcaccactgcacttcagtttggcgacagagcaagactctgtctcaaaaaaaaaaaaaagttctgttacttgcctctgccattccaggattccactaaattcagaaagctcattttgtagcagcatctcttacattcataccaaggccagagaagacagccagtacagtactttttaaggatgccagcatttctctcactgttgtattttcttaaaggtagtagagaacacccatcttggaggatgtttttagagagtaaggaagccagctgcacaaaataaatccaccccaactttcctaactccccaagtttggcatctcaactttactcaatggaggtcactactgaatccacatttcagtcaaacaagcagacaatcagaaccactcctagctgcttcagcaagaaccaaatctaaaatctctcatagatgaatctacattaatagattcagcccaaactaaaattagattcctcctttcctggtccagcacctctctgaatttgatttcatatcaattgcataggtttttgctaacataaactagtaaaattcttgcaattcttttgatgcacaaaacttgtctttcatcatgaagttagccccttgaacttcctgggatctgactctcgctattggtctagaggccaaaaggtggtgggaatgggaataaaaacagctatcactcaacaagctgaagtcattacagcatctttaagcatcactcaaaggaagaagggttacttctgctggcaagggaggctcagtacaaaccacaggttaagaatacctggagtcattcaaatggttccatgtcatgattccaattcctgaaatcttactctttcccaatcaataactcaacttacacctatgaaatctgatgaagctctgagttcactctgcactgaacacagtttaataacttgttggatcagactctgaacccgatttagactatgacagtcctagagttataagacaaaagactcttttaagccaatcaccaaattcctaagtgttctaaccataacttcagccaagatttaaaaatttagccctgcagtttaaattttctttaaaccagaatttctcaaactaaacactattgacattttgggccaggtaactctttgttgtggtggtggggaggggacaatcctgtgcagcagcattcttggtctctactcactagataccagtagcaccctgctcccccagttctgataactaaaaaatgtcaccagacatttctaaatacgccttggagagcaaaatcaccccaggttgagaaccactgctttaaactctacagtggagttaaaaacagccaattggccgggcgcggtggctcacgcctataatcccaacacttttggagtccgaggcgggcggatcacaaggtcaggagatccagaccatcctggctaacacggtgaaaccccatctctactaaaaatacaaaaaattagccaagcgtggtggcacgcgcctgtagtcccagctactcgggaggctaaggcaggataatcgcttgaacctaggaggcggaggttgcagtgagccaagatggcaccactgcactccagcctgggcgacagagaaagactctgtctaaaaaatacaaaaaacaaacaaacaaaaacagccagtcctctcatatctttactttcctaaatggatcatcaatcagtttagcaaagctttgccttcaacaggtacttcatcccaggtaaccacagatgaaaaacactagatgccacaaactggttaccagtgacccttctagattccctgaggatctgttgcccaaaacagttttacatctatttaatggtccaggatcagaatccactccaggtagtttaagcaaaaagggggcttaagataagaatcagatgctcacaaaatctttggaaaaagtagagaggcagggtccagagtgactgagctcctagaaacaactcctagcccacagaaccactctgcctcagccacaatcacaaaagctggtaccatcagtgtaggaagctggcaagcaaggaagctcctgtagaagctacagaattagaaacccactgctaaatgacaaggctgccccacaaactactagctcagagccattctacttttctcataatctaaacccatatccttcctctctccccaggtggttcacttccaaatcaaagtgcatctgaagggtggaacctaaatcatgtccagaaaacaaagcagcctatagggaaaaaaaaattttactagccaagaagactattaggcactctcattctgaaagctatgtttttcactgtcatcttaaaaattggtattctccaagagatgtaacctatcaattattgcattgttgcatttttaacctatcaataatgcagttccctgagcatgaattactagaatatagattccaaaccaaggttaatgtcatcttgtaggaacctctttgtgtaaccatctggacttccataaaggaaaatcctctgcatcaataacaaccaaggtgggaggatcgcttgagcccaggaggtcaaggctgctgtgagccgtgaccgtaccactgcactccagcctgggtgatagagcaagaccttggctcaaaaaaacaaacaaaaaaccatgtacctcttatgattctgaactgcaacattctcccacacttactacaatgaatccatatcatttcttgcatagactactgcaataccttcataactgctctccctgactttacttgttgtgcacttcaaatcattttccccaaagtaccagaatttatataacatgttactccacttaactgacttctcatcacattcaggataatgactgaatttccatctgacttaccaaatgctcatctatgtctttaagagtgctctagtttcaacaacctgtttacagctccccaagtaagtcaggtccattcaaactcatttatctgcttttaagtatactgtcccttctgtggacattctcctctttaatcttacctccatttctcccattaccaggttaacatttacacattttaaagtgtcatctctttttaggaatgtttcctgacaccttgttcccctaggctaagagtggtccttcccgatgcttccataatatcttactcaaaatccttaagggaggaaatgcaaacagttatgtaatcttctccagtaggacttaagtctaagacataaaagaaaaaaataaaaatgattataagagaaggctgagagattatttcattctgttgttgaaagatctaaatcatttagaaactttctttttccttacactgagtcaaaatctttttgaagtactctcaccaactgatgttacctagaataagaaaaaatgcgtctattccttctttaagatgatagcgatagcttctcagctgtttgaaagccataatcatgattctccattcctctctaatgtaactagttttcccatcttagactgctctaatccttaatagtgttcaactaaagtgaaacactttaaggaacgtagaagaattagttcagagtaagaacttctaaaaggattaaaaagtaaaaagagggctgggtgtggtggctcacgcctgtaatcccagcactgtgggaggccaaggcgggtggatcacttgaggtcaagagttcgagaccagcctggccaacatgatgaaaccctgtctctaataaaaatacaaaaactagccgggtgtggtggcgggcccctgtaatcccagctactcgtgaggctgaggcaggagaatcgcttgaaaccgggaggcggaggttgcagtgagccaagattgcaccactgtactctagcctaggtggcaaaaggagaatctgtctcaaaatagtaatttttaaaaaaaagtagaaagggataaaaagtggaactcatcttaagaaaatgcaaatatttaaatgatataaataaatgcctaaatgaatcttttaaaaaatcataaataatacaggagctaaaaatagaaagtataagtataccactttccttgcctttcatagtaggtaatcaatggacactatacatttgataattcaagaaatagaggtttaatgtaataaagtatcctctagactgacaatattaaatattaacatagcaaacagatatcaggaggtagaaggagaagataattattaaaaatacaaaattccccatccttcatattggagaactaatagatgctgtctaaagttgtccaatatattcattgctcataaagcatccaccaacagaacaaaaactgacagaaaagaggtcttattttgaggaagtaggactgagtgtgcaagattatttcttttttcttggaaaggagactttttactttatattcttctgtttaatgactattttgtttacaaaaaacaaaaacaaaacacacacactcaagtagcttaataaaacagttactaatgctatataacatggtagaaaataagtggcaaatctgtgattacatacttaagacaataaaaggcaaataacccctgacaactttacgtagtttcttctatttattagttctaaagtatcattgctataaaatcacaaaatgttcactgctacaagtcagagatgatgagatgcctctatcagaggccaaactgtgctgctacttcctcataatttttatgagagaaaaaactctaagccttagagaggtattactctattttataataatctgtgaaggaaaggataacctctgtactagtctgttctcaccctgctaataaaaacatgaccgagactggttaatttatttaaaaaaaagaagtttaatagactaacaattccacatggctggggaggcctcacaatcatggtggaaggcaaatgaggagcaaagtcacatctttttttcttctttgagatggagtctcgctctgtcgcccaggctggagtgcagtggcgcgatctcagctcactgcaacccccgcctcccaggttcaagcaattctcctgcctcaagcaaatctctagctgggattacagctgtgtaccactgcacccagttgatttttgtatttttagtagagacagggattcaccatattggccaggctagtctcgaactactgacctcaaatgatccacctgcctcggcctcccaaagtgctgagattacaggtgtgagccacagtgcccagccgcaaagtcacatcttacatgacagcaggcaagtgagtgtgtgcaggggaactcccctttataaaagcatcagatctcgacagacttatccactatcacatgaatagcacaggaaagacccacccccccccccacccaatgattcaattacctcccaccagatccctcccatgacacgtgggaattatgggagctaaaattcaagctaagatttgggtggggacacagccaaacaatacaattccaccccggcccctcccaaatctcatgtcctcacatttctcaaccaatcatgccttcccagcagtccaccaaagtcttaactcatttcagcattaactcaaaagtccacagtctgaagtctcatccaagacaagacaagtctgttccacctacgagcctgtaaaatcaaaagcaagttagttacttcccagatacaacggagggtctacagccataccaccctgaatgcacctgatctcatctagatacaacggaggtacaggcatttggttaatacaccattctaaatgtgagaaactggccaaaacgaaagggttacaggccccatgcaagtctgacatccaatagggcagtcattaaaccttaaatttccaaaatgatcccctttgactccatgtctcacatccaggccatgctgatgccagaggtgggctcccacagccctgtgcagcttgattcctgtggctttgcagggtatagccctgctcctggctgttttcatgggctgctattgagtgtctgtggcttttccaggtgcatagtgcaagctgtcagtggatctaccattctggggtctggaggatggtggccctcttctcgtagctccactaggcagtgttccagtggggactctgtgtggcggctctgactccacatttcccttgtgcactgccctaacagaggttctccatgaagactccacccctgtagcaaacttctgcctggacattcaggagtttccatacatcctctgaaatctaggtagaggttcaacaaacctcaattcttgacttttgtgtacccacaggctcaacaccatgtggaagctgccaaggcttgaggcttgcaccctctgaagccatggcctgagctgtaacttggccccttttagccatggctggagtggctggacgcagggcaccaagtccctagactgcacacagcaggggggccctgggcctggcccaggaaaccatttttcttctcctaggcctctggatctgtgatgggagggactgccttaaaggtctctgacatgccctggagacattttccccattgtcttggtgattaacatttggctcctcgttacttacgcaaatttctgcagccagcttgaatttctctccagaaaatagggttttcttttctattgcattgtcaggctgcaaaatttccaaacttctatgctctgctttttcttgaatgctctgccgcttagaaatgtcttccaccggataccctaaatcatctctttctggttcaaagttccacagacctctagggcacgggcaaaatgctgccagtctctttgcatagcaagagtgacctttactccagttcccaacaagtttctcatctccatctgagaccacctcagcctggacttcattgtccatatcactatcagcattttggtcaaagccattcaacaagtctctaggaagttccagattttctcacatcttcttgtcttcttctgagccctctaaactattccaacctctgcctattacccagttccaaagatgctcccacatttttaagtatctttacagagtgcccccctacctcagtatcaatttactgttttaatctgttctgatgctgctaataaagacacaccagagactgcgtaatttaaaaaggaaagaagtttaatggactcacagttccacatggctcaggaggcctcacaatcatggcgcaaggcaaaggagatgcaaaggaacatttacatggtggcaggcaagagagcttgtgtaggggtactgccctttctaaaaccatcagatctcataagacttattcactatcacgagaacagcatgggaaagacccaccctcgccccaccagcccatgattcaattatctcccaccgggaccctctgatgacacacgagaattatgagagctacaattcaagatgagatttaggtggggacacagccaaatgatacctccaatcgttctagattcttgttcattaacatttacagcacatacaacaaatctgttaccaagacctatagcttctattgctaaattctcatgtgagttcatccctcctttctaccaccactcccttaggccttcataatttcttgcctgacttggtatccctacctcctgtttcttaccctatacattgctaccaaaataatcattctaacatgcaaatttgaaatcatactcacatttaaaatgcaccaatggcttcccactatctatgatttaaagttcaaagttcttgacatgagattcaaggccttgaatcatctggctccagtttaacttctctggcctcatattttgacacttccccctttccccatatataccctatactgtggccccaccaaaactacttgcaattcttccaacctgtcattcattgttaggcccccacatacatatttgtgttcttctctcttcttcctagaaagccctttatttaattcctcacttggcacatcctatttctcatagataaaacacaggaatcacctcttctagaaagccttctttcatctcctctctttcctgtcagactgggctaagcttctattcctctgtgttcttcatagtatcctgtttatacctcttatcatggctcctttcacttatattactattttctatttacctatttgtcttccctactagactgttacttccttttttttttttttttaattgagactcgctctgttgcccaggctggagtacaatgccgcaatatcagctcattgcagcctctgtctcccgggttcaagtgattctcctgtctcagcctcccaagtagctgggattacaggcatgagccgtcacgcccagctaatttttgtatttttagtagagatagtgtttcaccatgttggccaggctagtctcaaactcctgaccttaagtgatctgcccgcctcagcctcctaaagtgctgggattacaggcatgagccactgtgcccagccaagactgttacttcctaagagctgtggcttttctcacaagtcaagcactttacaatagtgatattcaaaatgacaatttctcaactaatttatgcatcatacagctacaaagctagtatctacattagggggcacaatcatggagggaatttccccacacaaaaagtaacaagagagaattctgcttatgctatggctgagtaagcacctactagattaacgttcccacaggtaacaactataaattctgaacaaaatataaaaatcagctacctatatataaataggtatataccaaaatataaaaatcaggcactgaagagtgaccaaaagcagacaaatattagagggcagtcagtacttggaagagtatggtattaggtgaatttcccatctacaacttttggcctgagggcagatccagtcagcaccatagcaagtacctaaaactctaagataaaccccactgttttactatcttgaagaatcaaaggacagagttcaggaagaccacagttgctgaaaagtgagaaacacatcctaggaagaagagacccagaaaggtagagacacaaaatctagttacaaactctgtacaaatttctggctgacccctgaaccaaacacgcaaaggacagactgcaagcagtccaggtagagataaaagaactgaactaagaactactgctcaagagacagagcttgcagtttttgtcccatcatgttaactgcctgctaacaagcatcaacactctttggaggaatataatggaattcagaggctccacaacttcatattcacaatatccaaaacacaatctaaaattccttgactaacaaaaaaatcaggaaaaagtggccaagttgcaagacaaaaggaaaccaatagaaactaactccaggatgatccagatgttggaatcagcatagattttcaagcaactattatgattctgcttaatgatgcagagaaaaatacaacacaacaagtttgaaaaattaacaaagcaatagaaacctaaaaaataacaaagtagaaattctagatctgaaaaatacagtatctaaaataaaaacattcactgatggcttaacagcagaatgaagacgacagagaaaaaggtacacttgaaaacagatcaataaattaccgaatttgaagaactgagaaaaagcaaattggggggaaaaaggaacagagcctcatgactggtctgcacatacaatgctaaaagatttctgaaggttgctagatggaaactcaagtcttcagaaggaaagagagcatcggatatgtcttaaaatacactcattaattcaacaaatatttattaacccatttatattggaggttgcaaatttcttttgtgaaaaaatcagaccttggcgatgaccctgagcagcaggatataaataacttccacaagcttagcattccaataatggaacactaggcataaatggattaattacccaggacagataatgtcctttaggcaataaatgagtttcaataaccttatatatatatatcatttttattaatttatgctacatcttcagagacgttttatcggtagatctctatatttaggccatcagtctgtttacctctcaaactgtatttacaagttgtattcattttataaaaccaagaatacaaataaaaagtaactcagtagaaacaaattatttgttaagtaaatactttaacgcactcactgattacataaaatctaacaagctagaagtaccaacatcaattatgtttccctcctgtccgatattcaattccttaatgagtcctgtcatttttatcttctaaatatacagatgacccttgaacaacttgggagttaggaaccccaacccctagagccgtcaaaaatctgcacataacttttaactcttcaacaacttagctactgagagcctactgctgaccagaagccttaccaataaacaacacatattttgcacattatatatatatatatatatatatatatatatatatatatatatagtattcttacaataaagtaagctacagaaaagaaaacgttttaaaatcataagggagagaaaatgcatttatagtattgtactgtatttatcaatactgaaagtttatgtcatctgtttataaatgaatctctgtctgaaatggttggcaactaaagctgcagacttcaatctacactacatatcaagcaattaaactttttcttgtaatggcatgacttttgtctgtttctcaggaacacttccagcatcgctagtggcactgtgtatgagtcccatagtgttattcaactaaacatgatgaaaaataatcaagagtgagaatttttaactatcgtatccaacttactggagagataaactgttcacttggagatgactggcatcatatggtattttaaggtattttaagcagatactcgcaagacttgagctcaccacaatagcaacaggaggcagctacaaaattattaacaatactacagtatatacttcagtatattttatgcagttttaatactgtatctttacatttgtttacatttctcaactgaatggtgtcatgtatagtctacagtgtttgtggcgtaagttttcataaattttaactttttataatagatttgtgtatattttatggtaagatagactagtatctacttatattttatgtattcatgcaacacctttttcttaattttcccaatatttctaggctatgcagtttgtctgcaagttttttcaaattgtcacacatcaccaaataattttccaatatagttattgaaaaaagatccatgtataagtagacccatgttgtctaagctcatgttgttaaatggtcaactatattttgaatgcatacatttccctcaatctctattgcttttacactagatccagccaccatcacttcttattagtctccccactccccatccataattctcacaacagccaaaataaattagatcatgtcactttacttcatttgcttcccattgcacttttaataaaatctaagctccttactaagcttacaagatctgtatgatctggcccctacctccacaacgtcattcatccaattctagcctcaatgtcacccactatattccagccacagaagcatcctttcaattccttgaacataccaagttctttcatacctaaagtttttttaataggctgtcccctcaaactggtttactcccctttctgcatacatggctggttccttcgaattcttcacatgttagtttgtatgtcacctcttcagagtacctaccctgaccaccttgttgaaaatagattttccattatctaacactatattttccctttatagtacttgtcacaaattgcttaattatggtgttgttgttttgttttgcttttattgcctaagacccctacaggcctacagctccatgagaacagggaccacacctgcatgatttaccaggatgcccaatggctaatacaataagagtaagtgatggtgcttataaattttattaactgaaagctcaagataaactcaaattttcacacatttcaaatagtgtttcattttaaataggtttgccatcttggagatagaggggtatgaggagactaatttaacaaataaaagctcatagtgtatttttattaaaaataaagtgaacataaaaacattcccttcgttgtccctgataatctatgttacctcagaattaggatgaaaaacaactgaacttatataaattaagaaactcaacaaatcactggcaatcttccaaatgaactcatatcttaaaatataccaatttgagaatattattggtatttaactgtttcaacaaacaaaaataaaaacacttcttctttaaaaaaaaagacacaagtggaacatgaaattatgccagataaatgaaaaagatctttttaatagaggcagcattttgaaaacccaatttcctattaaaaaaaaaaacccgtcgtctaagtggtataacaatgttcttaagaaaatagtaaacatctaaatcctagacaagggctgtccctaaagactagtcatagaggttgtatttgtgctattataaatagaaatttatttcctaataagtgatccatttttgtgtcttgtattatctttacagaaattctagatgacacaccattttcaaaaagaaaaaagtgctgggttttttgccttcatttatttaattctatcaaaagcattcatccattctgtcatgaaagttcttaaaataacattttgtgcagtttacttctaactatctcacgggaaattattctgacttcttcccaagaacatttcatcattttagactcaaccatttgtaataaggttggcaaaagttaaattgactgacaatgcccacagctgatgagatcttttttaaaaagaaaaaagcactcatataccccacagtttgaaataaaatgtaaaggagtcgattagcagtatgtttttcaaagtcttaaaaaatattcatgccttttaaaccaggattttcattaccaaattttatccaacagaaataagcagccagaagacacatataagcctgtttactataaaactgaaaacactgaaaaaatttaaatgacctatgtgtcatttggatatttaacactggcaatttttaaaataaattatggcatattcatggtcacgacccggtcacaataaaggctattcatttttttaaaagacagtgtacagctactaaaagtagcatttatctttattagcatagaaagatgtcccaaaaaaccaagaaaataaacgagtcacaaaacagcattatactatgaagtaacatttaagaaacaaaacatgttttttgcatgtggtacacatgtatttttttcttaattttattattattatagtttaagttttagggtacatgtgcacaacgtgcaggtttgtaacatatgtatacatgtgccatgctggtgtgctgcacccatcaactcgtcatttagcattaggtgtatctcctaatactatccctcccccctccccaaccccacaacaggcccgggtgtgtgatgtacccctttctgtgtccatgtgttctcattgttcaattcccacctatgagtgagaacatgaggtgtttggttttttgtccttgtgatagtttgctgagaatgatggtttctagcttcatccatgtccctacaaaggacattaactcatcattttttatggctgcatagtattccatggtgtatatgtgtcacattttcttaatccagtctatcattgttggacatttggcttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcgctgacttccacaatggttgaactagtttacagtcccaccaacagtataaaagtgttcctatttctccacatcctctccagcacctgttgtttcctgattttttaatgattgccattctaactggtgtgagatggtatttcatggtggttttgatttgcatttctctgatggccagtgatgatgagcattttttcatgtgttttttggctgcataaatgtcttcttttgagaagtgtctgttcatatcctttgcccgctttttgatggggttgtttttttcttgtaaatttgtttgagttcattgtagattctggatattagacctttgtcagatgagtaggttgcaaaaattttctcccattctgtaggttgcctgttcactctgatggtagtttcttttgctgtgcagaagctctttagtttaattagattccatttgtctattttggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccagtttcagctttctacatatgactagccagttttcccagcaccatttattaaatagggaatctgttccccattgcttgtttttgtcaggtttgacaaagatcagatagttgtagatatgcggcattatttctgagggctctgttctgttccattggtctatatatctgttttggtaccagtaccatgctgttttggttactgtagccttgtatatagtctgaactcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaacttggattcctaggtactttattctctttgaagcaattgtgaatgggagttcactcatgatttggctctctgtttgtctgttattggtgtataagaatgtttgtgatttttgcacattgattttgtatcctgagactttgctgaagttgcttatcaacttagggagattttgggctgagacgatggggttttctagatatacaatcatgtcatctgcaaacagggacagtttgacttcctcttttcctaattgaatgccctttatttccttctcctgcctgattgccctggccagaacttccaacactatgttcaataggagtggtgagagagggcatccctgtcttgtgccagttttcaaaaggaatgcttccagtttttgcccattcagtatgatattggctgtaggtttgtcatagatagctcttattattttgagatacgtcccatcaatacctaatttattgagagtttttagcatgaagcattgttgaattttcaaaggccttttctgcatctattgagataatcatgtggtttttgtctttggttctgtttatatgctggattacatttattgattttggcatgttgaaccagccttgtatcccagggatgtagcccacttgatcgtggtggataagctttttgatgtgctgctggattcggtttgccagtattttattgaggatttttgcatcaatgttcatcaaggatattggtctaaaattcttttttgttgtgtctctgccaggctttggtatcaggatgatgctggcctcataaaatgagttagggaggattccctctttttccattgattggaatagtttcagaaggaatggtaccagctcctccttgtacctctggtagaattcggctgtgaatccatctggtcctggacttttttttttggttggtaagctattaattattgccacagtttcagctcctgttattggtctattcagagattcaacttcttcctggtttagtcttgggagggtgtgtcgaggaatttatccatttcttctagattttctagtttatttgtgtagaggtgtttatagtattctctgatggtagtttgtatttctgtgggataggtggtgatatcccctttgtcattttttattgcatctatttgattcttctctcttttcttctttattactcttgctagcagtctatcaattttgttgatcttttcaaaaaaccagctcctggattcattgattttttgaagggttttttgtgtctctatttccttcagttctgctctcttagttatttcttgccttctgctagcttttgaatgtgtttgctcttgcttttctagttcttttaattgtgatgttagggtgtcaattttagatctttcctcctttctcttatgggcatttagtgctataactttccctctacacactgctttgaatgtgttccagagattctggtacgttgtgtcttcgttcttgttggtttcaaagaactctttatttctgccttcatttcgttacgtacccagtagtcattcaggagcaggttgttcagtttccatgtagttgagtggttttgagtgagtttcttaatcctgagttctagtttgattgcactgtggtctgagagatagtttctgataatttctgttcttttacatttgctgagcagtgctttacttccaactatgtggtcaattttggaacaggtgtggtgtggtgctgaaaaaaatgtatattctgttgatttggggtggagagttctgtagatgtctattaggtccgcttggtgcagagctgagttcaagtcctggatatccttgttaactttctgtctggttgatctgtctaatgttgacagtgggatgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaatccctgcctttttttgttttccgtttgcttggtagatcttccatccctttattttgagcctatgtgtgtcgctgcatgtgagatgggtttcctgaatacagaacactgatgggtcttgactctttatccaatttgccagtctgtgtcttttaattggagcatttagaccatttacatttaaggttaatattgttatgtgtgaatttgatcctgtcattatgatgctggctggttattttgcttgttagttgatgcagtttcttcctagccttgatggtctttacaatttggcatgtttttgcagtggctggtaccggttgttcctttccatgtttagtgcttccctcaggagctcttttagggcaggcctggtggcgacaaaatctctcagcatttgcttgtctgtaaaggattttatttctccttcacttatgaagcttagtttggctggatatgaaattctgggttgaaaattcttttctttaagaatgttgaatgttggccctcagtttcttttggcttgtagagtttctgctgagagatccgctgttagtctgatgggcttccctttgtgggtaacccgacctttctctctggctgccttaacattttttccttcatttcaactttggtgaatctgacagttatgtatcttggagttgctcttctcaaggagtatctttgtggcgttctctgtatttcctgaatttgaatgttggcctgccttgctagattggggaagttctcctggataatatcctgcagagtgttttccaacttggttccattctccccgtcactttcaggtacaccaatcagacatagatttggtcttttcacatagtcccttatttcttggaggctttgttcatttcttttcattcttttttctctaaacttctcttcttgcttcatttcattcatttcatcttccatcgctgataccctttcttccagttgatcgaatcggctactgaggcttgtgcattcgtcacttaattctcatgccgtggatttcagctccatcaggtcctttaaggacttctcagtattggttattctagttagccattcatctaatgtttttctcaaggtttttaacttctttgccattggttcgaactttctcctctacctcggagcagtttgatcttctgaagccttctctcaactcgtcaaagtcattctccgtccagctgtgttccgttgctggtgaggagctgcgttcctttggaggaggagaagcgctctgatttttagagtctctggtttttctgctctgttttttccccatctttgtggctttatctacctttggtctttgacaatggtgatgtacagatgggtttttggtgtggatgtcctttctgtttgttacttttccttctaacagtcaggaccctcagcttcaggtctgttggagtttgctggaggtccactccagaccctgtttgcctcggtatcagcagcggtggctgcagaacagcggatattggtgaactgcaaatgctgctgcctgatcgtttctctggaagttttgtctcagaggagtatccagctgtgtgaggtgtcagtccacccctactggggggtgcctcccagttaggctactcaggggtcagggacccacttgaggaggcagtctgccagttctcagatctcaagctgcgtgctgggagaaccactactctcttcaaagctgtcagacagggacatttaggtctgcagaggttactgctgccttttgtttgtctgtgccttgcccccagaggtggagcctacagaggcaggcaggcgtccttgagctgtggtgggctccacccagttcgagcttcccggccgctttgtttacctactcaagccttggcaatggcggacgcccctcccccagcctcactgccgccttgcagtttgatctcagactgctgtgctagcaatgagcagggctccatgggcataggaccctccgagccaggtgcgggatataatctcctggtgtgccgtttgttaagcccattggaaaagcacagtattagggtgggagtgacccgattttccaggtgccgtctgtcacccctttctttgactaggaaagggaattcccgaccccttgtacttcccaggtgaggggatgcctcgtgctgcttcagctcacgctcggtgcgctgcacccactatcctgcacccactgtccggcactccccagtgagatgaacgcggtacctcagttggaaatgcataaatcacccatcttctgcgtcgctcacgctgggagctgtagactggagctgttcctattcggccatcttggctccacccctcagtacacatgtatttttaagaagtcaggaaatacatagaccaaaatgttagcagaattacatgaaagtagtagggtttcttttttacatttttattttgtcttaattttttttttttttttgtaagggacaaggtcttgctctgtcaccgaggctggagtacattggtgagatcatagctcactgcagtcttgaactcctgggctcaaccaatccgcctgtctcagcctcctgagcagctgggactacaggtacacacaattgtgaccagtttagaacttttaaaatgagtatcttctacttctatgacaagagaaaagatgctttcatttgggaaaagtttatttcctaaatatgaagcctattttcaagcttccccaaactaaattctgttacttctataacagcaaggagtccttcagacaagtcatttactttgtacttagaattagaagttgttatctctgatagggagtgataaatttgtgctgtttcattcaggaaaaccaagagtacaaatttgccatctgcataaccccagttgccagaggtcatgaatccagtctataatagaaaatgctgaaaacataaatggtctacacctcccttttaaggaaatattttcagccaaagaagctaattagccacatacgaagacctatttttagatttttagtactaattttcatatcttttcatttactctatcatgtcttccctttgaaagtttcatatttatatacaaattgaactctttaatttttccttacaaagtagttatcttgtcatttctatcaattctttccatttttatcatattttgacaagatttcttcacatgtatcataagtattatgttctaatcatcatcaaaactgaataggaagaattctattcctgtcttaaagtacaagaactgtgtagtcaatcctctcccctaccctccccaccaaaatctttgtactgccgggtgctcctattatgaataatccatatttcataatcttaatcttataccactgatttttaagatctctaagcttaaaagtattcattttttttcttaacctcttggtgtatatcctaaccaaatatatatatatatctctctctctcaaagattctgtatcattttaaacaacctgtgataattctccaaaaaaaaaaaaaaggtattgattagtaagtcagccaaagatatgagccactcagatctcctttcaagaaagaatttatgactcagctgcagggagggtaattagctattagagccttcaggttctgcatcagcattccggttaaaactattatcttcccaagttatctcccaaccaatgactaagcacagctgtaatactaaggcctggtcatttctgcctaacatgggactccttcgatatacaatcttactcttggtctccctactgggctggctgagactgtcagctctgcatcatggtgaggagactcccctggccctatgttgttttcattaatccttcacagtcattgttcctcaatcaacctcttgcactcctaactccacctcagcatcttcttcccaaaggacctaacagatataatgatttaatactgacacatcagtattattcatcaaagatccagatttaaaattataattctaatacaaatatctatttctctcatttatatgtccccttacattctgccatacctatcagataaaattttaaaaatatggataagctattaaaaacaggtatgcagaggatttgagatgttggttgaggtagttgtttttacccctcattttgatcttgtaaatgcttttaccctggcatcaaggatgtatctttttttcctgagccagtttcactgagccaatatcctatcttgattttctatagcatagttagaccatttattttattaaaaagtgttcatttcactgaattgctggagcaattcatgtacattttgtgataacaattttaatttgttttataaccatatcaatttttttaatgttagcttgtatcacagtaaaatttgggtgagtggcccaatttgtaccttttcctaaccaagtctatttttccaaagtcaaattttacagatctaaattttgtcaagatgatagtgttcctatcagattttaattgacaacaaaattttccatgtgcagctataacagcttttatttgtgttacatctaccctatcaaatggtgggatcaaagattattcggatttaaattctctacttcaaaattatcttcaaattcaggtcacaacttaaatgtcgtcttctcaaaggaataatcctccatctctatgatgaaaagaatgcatgcatccaaaacagaaagaacaaagggaacaagcttagtgtgctggctggacaaaaagaaaatcagtgtggttatagcttggtagaaaaagggatacgggtggccaggtggtacagtatctcttatatgcctcagcccagacatggcacatcaatttgttaaaatttcattgcctaaaattagttacatggcacttcctacgtacaaagagaactacacagggtttctttctgccaaggaaggagaaacaggtgtgagtaagcactggtagcctcaaatacaaataccttccttacggtacttataaagattgaaatgagataatatcaagttcatagctcattgccaacatttttgagtattgaataaataactaatttacactttattgtttttcaagtatacatctaattatacttccttttttaagtgaattgaagcattttttaaaagtcaattaattgaggccaggcacggtggctcacgattgtaatcccaacactttgggaggccaaggcaggtggatcacctgaggtgaagagtttgggaccagcctcaccaacgtggagaaaccccgtctctactaaaaatacaaaattagccgtgatgcacgcctgcaatcctagctactgaagaggctgaggcaggagaatcgcttgaacccgggagggagaggttgcggtgagccgagattgtgccactgcactccagcctgggcaacaagagcaagactccatctcaaaaaaaaaaaaaaaaccaaaaaactcaattgagaaccttgaccaacactaacagcaaaactatttacataaacttccctttttggaaaaattagaagatactttcaaatcaacaatccttcaaacgtttctatagttcatattgtaatttctcaatgactatcactgaccagatcctaggactatcattgacaatgtcctagaacttcattaatccataacaggaaaattgaatcattgctgcatctagatatccatcattcaagataggtagcaaatttgctttttaaaaatgtagtccaggatgaggcaggaggatcacctgagcccaagagttcaataccagcctaagcaacatagtgagaccccccatctccacaaataatagaaacaattagccaggtgtggtgatttgtgcctgtggtcccagctactcaggaggctgagataggacaatcatttgagtccagaaagtcaaggctgcagtgagccgcaattctaccaccacactccagcctgggcaacagagcgagatcttgtctcaaaacaaaacaaaacaaaaataggagtcctcatataaccagaaagtacaaatgaacaaataaaaacgaacaaagaatatctgaaataacgttcgatttaggtccagcttggtggctcatgcctgtaatcccatcaaattgggaggcccaagcaggaggattgcttgaggccaagattttgagactagcctgggcaacatagtaagatcccatctctattaacaattttttataataaaaaaattatttgggtatagtagtatgcatatgcagtcccagctactcaagagattgacggtgggagaaccacttggctgcaggagttcaagcctactgtgagctatgattacaccactgtactccagcctagacaacagagcgagtccgtctctttttttttgtttttttgagacggagtctcactctgttacccaggctggagtgcagtggcgcgatctcagctcgctgcaacctccgcctcctgggttcaagcaattctcctgcctcagcctcccgagtagctgggactacaggtgtgcaccactatacccagctaatttttgtatttttactagagatgggatttcaccctgttggttggccaggatggtctcgagctcttgacctcttaatccacccgcctcggcctcccaaagtgctgggattacaggcgtgagtcaccacgcccagactcgagtctgtctcttaaaaaagtttaaagagtgttcaatgtaaacaaattactttcatttctagtaatgtatattcagtaatttggactaacttctctgatggaaacaaatagaaaagctggataaatctgattaaaggcattaatgagtcaagaaaacagaaaataaattacaggacacagatctggaaagaaaaaaagaaaaccaaaagataaagtcagcatttgggagtacttttcccccagggtatttgccaatctgaaatccagatgaaggtttagaagataagcagggctactgacaggcacaaaggaatgtggaacaaaaactggagccacattttgggaggctgaggcgggcagatcacctgaggccaggagtttgagaccagcctggccaacatgacaaaaccccatctctactaaaaacacaaaaattagctgggtgtggtggtatatacctgttatcccagctatttgggagcctgtggcatgagaatcacttgagcctgggaggcagaggttgcagtgagctgagagcgtgccactgcactccagcctgagcaacacagcgagactctgtctcaaaaaacacaaaaacaacaacaacaacaaaactggagccaaataagggagtgttgttaaatacctgatgcttggagaccatacactgaaggctaccctagggaacctaaaataaactgactatccctgggaatactgcccagcctcaaatcatctcagtacttaaaactggattaaggtgatacagaattactaatacccctatcttgtcttttacttctttgaaaatattgagcaggattattttcttcaggtttattgtgctataatgtcaaataaactgcacatatttaaagcgtacaattaaatgaggtttgacgtgtatatacactggtgaaaccatcatcacagtcaacataattaacacagccataaccccccaaagattctttaggcacctttgtaatccttgccttctacctgttcctaccctagtactccacattcctaaaccaccactgatcggccttctgtcactatagattggtttgtataattagtttagaattgcatgtaaataaatggtatgtactttgggagggggtcacttctattgtataagtagacctgaagttgttgatccattaatccactgaaagacatttgggctgtttctgggttttggctattacaaataaagctactacgaacatccttatataagtctatgtatgggcataaggtatgaatattttgaagcctgtttctgataacactcctatcagattctaaagtacaagaatatagaaagaataaaaggattcaaaaatataacatggaggctggtgcacggtggctcatacctgttatctcagcactttgggggatggaagcaggaagactgcttgagtccaggagctcgagatcagcctgggcaacatggtgaaaccctatctctacaaagaacaggaaaaccagctgggtgtggtggcgcacaccggcaatcccagctactcgggaggctgaggtgggaggactgcctgagcctggggtggttgaggctgtggtgagccatgattgtaccactgcactccggcctgggcaacagagtaaggccctgtctcaaaaatgaaaacaaataaaaataacatgaaaacactaaccaaaagaaggctggtgtagctctattaacttcaaagtggactttcaggaatacttcatattgaaaaaagcttgaattccacaagaagattaacattttcttatgtacctaatggtataaccttgaaagatatgaagcaaaattgagagacacaaagagaaaaagacaaatccaaaataacatggctgggcgcagtggttcacacctgtaatcccagcactttgggaggctgaggtgggtggatcacctgaggtcaggagtttgagaccagcctagccaacatggtgaaactctgtctctacaaaaaatacaaaaattagccaggtgtgctggcacacacctgtaatcacagctacacaggaggctgaggcaaaagaatcacttgaacctgggaggcagaggttgcggtgagccgagattgccccactgcactctagcttgggcaaaagagtgtgacttcatctcaaaaaacaaacaaaaaataaataagtaaaataatagtggacgatgttaacgtaactcttgcagcaactgatgagaacatgtgaacaaacaaaacaggaatacagaagtaacaaaactgacctgaattatacatatatacacacatatatgtttatgtgtatatacatgtataatatatgtatattaacataaacgtgtgtatatgtgtgtatatgtatatctgcatgtatgtgaatatatataaaccactgcacaaactacagaataaaatccttttcaagctcatacaaaatttttaccaaaattcaatttgtttgcaacataaagcaagtttcagcagatttaaaaggactgaaatcatacacagcttcttccctaaccaactgcaattaacctaaaaccaataagactaagataaatagaaaattgccatatacttggaaattttaaaatatgctcctaaataatccatgggttaaaaactaaatttcaataaaaactggaaaatatgttaaacaaaatgattaaaaatacaatatcaaaacttgtgagatgcttccttagcattcatattttggtgcctaatactctactagtaagtgaaccacaatataatggagtaggagaaaaaattggatgtgtctgtaacatcctgctgtaaattttactttcaagatcatagacatcactaaaaaaggaggaaaaggtaaataggggaattatactaattacattttgaaaaactgcacataaaataaaaataccaactaatgatcattaatgttttttattttacaaaagaccgtgacgtcacaacaatggtcaagagaaaacgcaaaatgcactatataaacctaatggtaaatatagtagcttgtttttataatgtatagaaaagtattgatatacatgtatattttgggttttaaaattttgattatgttttatgtgttcatttatagagcacataaatgtgtctgtttttatctttgtaagaagaacagcatgaataaaattagtagtgagccaaacagcactagccaaaagaaggaattatgctacaaacaagaagacccaatcagcactggaggtgccctttagtaactaagtataaggtgagtcccacagctgattagtattggtagttatatccaaaaaccaattagaagaaagattctgcaatgtgtcccaataatacatgagacaaaagtccccaaaagtaagctaactatacagacttaaaaccttatctcaggagatgaaaccctagatgaacatgataattttaatgaagtgcaggcataagttgctgatcattttaggagatatgcatacaattaaaagaacaaaaaaaaaaaaaaaacaggataacctgttaaggctgtctggccaaacaaaatttaaagacttccttatttctgagaaaggtaaccaattttcaaaataaatttataggaaagatgggaacttaaaagtaccatgatataacacataaaactcagattaaatggagacttggtctagagaacaatagctgaaatacgaatcatcatggactaagaaatcagttttcatgtccaacacaaaaatcaaatggtgagtgacacagaatcagtatctttgctgatctgagaacgcatgctctttacctttgagtttggtggtatgactaaaacccagagaagtaaaaagcaaaatataattgcaactggttgaattacctatacctacaaaaacagaaaaattggagcagtagaattatattatcatcaggatatgaaacagtaaaattcatggtatttaatgatgtaactggtttggggtaataatttagatatatggtgcatttttttctgcttcttaatgtgtttagatcatttgaaaaacacttattattaaattttatgactccaatcaataaaagtattaaagttcgcaatacgtgtttaaatatctgggaatttttattgcattatcagtaagtttgattatttgcataaggaatataagaatacttagaggaatattagtgtttaatatctaaagatataccaattgtttgacaaattaatattaatagattaaacaaatttgtgtcacagattagagtgcttaaaaaaatttatagcttgaaatgcatatacaagagagaaagtggccaggagcggtagctcatgcctgtaatcccagcattttgggatgcagaggaagggggatcacttgaggtcagaagtttgaaaccaccctggccaacacggtgaaactccatctctactaaaaatacaaaaaaattagccaggtgtggtggcacacgcctgtactcccagctacttggggggctgaggcaggagaatcacttgaacctgggaggcaagaggttgcagtgagctgagatcataccactgcactctggcctgggtaacagagcgagactgtctcaaaaaaaagagaaagtaagtaatgctaaaaatcaatgatgtaaaaattcatccaaggaactttgaaaatggacagcagattaaatccaatgaaggaagtaaataaagatgagaacagaatttttaatacaaaaaaatatacaatagagaagaatgacaaagctaaaagttggttgttaatttgataagctcccagcaacacaaaacaaaaaaaggcggcaataataatcaaaatcaggaaacattacagatcctactgacttcaaaaagataaaaaagtatattatgaacaatgttatggtaataaatatgaaaatctagatgaaacggacaaattcctagaaaacaacttttcgaaactggctcaagaaactgaaaatccgagaagcagatatctataaaatgccacaataggaggttccaaaattcatttctccatggaaacacaaaattaacaaccatctaaataaaaaattaccttcaagagaactccagaaatcagccttcagcagattcccttggcccacaagttctccaatgggagaaagaaagagtaaggtgagtgtctacctttgccacaaatcctagcaccaggcctgtccacctacagaccacaccaccagactgaccctactccctgcagacccacttgcccacagaccctaggacctaacatgcctgcccacagacacaaaggcaggtgtgttaggtcctagggtctatgggcaagttaggtccactggtgtctatgggcagtggtatgtccaaggactggtcctagcaccaaagtatttaaaaaataaaaactacccacaaaaatgtgctgataagatacacaacataaagagtcgttctgacataaataacatagagtgtgtggcaaaggcattataagtgtatagtttttatatgcaattgaagttaagactgtatcagcttcaaacagactgtcataactattaagaaattttatgcaagcctcaggataaccatgaggaaaacacccatagtaggtacaaaaaaagataaaaagaaaaaaaagtatattattacaaaaaaaatcatcatatcaaagtgaaaacagcaatacaaaacaaaaataactataaaacggacagaaaaaaattaacaatggcaatagttcttatctatcaatcacgttaaatgtaaaattcaccaatcaaaggaggtaaagtaatgaaaggagttaaaaaacaagatccaactgtatgctgtctgcaacaaatacaccttaaatttaagaacacacacaagctgaaacagaagagatgaaaaagggtatttcatacaaatggtagccaaaagagagcaagggtgactgtagttacatcagacaaaatagactttatgtcaaaaactgttaataagagacaaagaaggtcattacataataataaaagggaaaactgaatacaggaaaataaaacaattatatatgcatgcaacataaaagctgctaaatacataaagattgacagatctgcaggagaaatagatagcaatagaaaaatactaggatacttcaatcaccacttaaaataatgaacaaatcatccagacagaagatcaaaagaaaatatcaaacttgaacaacactatagatcaaataaacctaacagacagatataaaacattccacccaaaagtagcagaacacacagtgtcctcaagtgcaaacagaacattctacagggttgatcacatgctaggtcagaaaacaagtcctaacaaatataagaagtttgaaataattccaagtatcttttccagccacaatggaatgaaactaaatcaaaaacaaaaagaaaaaaattcaaaaatatgtggaaattaaacaatatattctggaacaactaatgggtcaaagaagaaaccaaaaagggaaattagaaaatatcttgagacaaattaaaacaaaaatctatctcaaaacttatgggatgcagcaaaagccgtactaagattgaagtttataatgataaatgcctacattaaaaaaagaagatctcaaatcaaaacctaacattataccttaagggtctagaaaaaaaagaacacaccaaacctaaagttaaaaaaatgaatcaaataataaaaattagagtcaaaataaatgagaaagagacgagaaaaaaaattttttaatgacaaaataaagagttttttgaaaaaattaaattggaaaacccttagctagactaagagaaaaaaaacaaaagaagactcaaaatcagaaatggaagaagagacattacaattgatgccacaaaaataaaaaacatcataaaagacgattgtgtacaattatatgccaacaaattggacaacctaaacagataaattcctagaaatgtataatctaccaaggctgaattaagaagaaatgaaaaggccaaaaagaccaataacaaatacggagattgaatctataatcaaaaaccaaacaacaaagaaaaggtcaagaccagatgacttcagggataaattctaccaaacatttaaagaattatcaccaattcttcttaaattatttcaaaaaaatgaaaacaaggaaatttgtaatcttcttttataaggacagcatcaacctgatatcaaagacagacaaagacacaagaaaactacaggccaaaatccctgaaaatagatgcaaaaatcttcaacaaaatattagcaaaccaaattcaacagcatgttaagatcataaaccatgaccaagtggtacttccctcctgggacgtaaacataggccaatatacataactcaagacaagtgattttttgtctttcttgcctgtgattttagtgtcatatccaagaaatcattgccaaggctaatatcaaacagcttcttccttatattttcttctatgagtttcatcgtttcaggtcttacatttaagtctttgagttgatttttgtttatggtgtaaggtaagggtccaatttcattgttttgcatatggatatccagttttcacaacaccatctgtgaacagactgttctttcctcattgtgtattcttggcacccttgtaaaagatcagttgagtatatgcatggatttgtttctaggtactctattctgctccaacagtctacaagtctgtttgataccagtcctgcactgttttgattgctgcagctttgtaatatattttaaaatcaggaagtgtgatgcctctagctttgttgttcttgctcaaaactgctttgggtatttgaatcttttttggtaccatacgaattttaggcatgtgttatcctgtttctgtaaaaaatgccaatgggattttgacaggaactacaccaaaactaaaaagcttctgaacatccaaggaaacaataaacaaaacacaaaggcaacctatggaagagagaaaatacctgcaaactatacaactgataaaagattaatatctaaaatatacaaggaatccctacaactcaatagcaaacaataacataatttaaaatgggcaggccaggggcggtggtgcatgcctgtaatcccagcactttgggaggccaaggggggtggatcacttgagctcagaagttcacgacagcctggacaacacagtgaaactctgtctctacaaacacaaaaaaattagctgggtgtggtggcacacgcaggtagtcctggccactcaggagactgaggtgggaggattgcttacaaccaggaggtcaaggccacagtgagccgagatcacaccactgtactccagcatgggcaacggagtgagaccctgtctcaaaaaaaaaaaaaaaaaaaattaaaatgggcaaactaattagatatttatccaaaaaagaaatacaaataaccaacaggtatatgaaaaagtggaaaacattactcataaaaatcaaaaccacatggaggcctggtgtgggagtgcatgcctgcaatcccatctactcaagaacccgagtcaggagaatgctgcttgattccaggagttccagactatagtgcacaatgaccttgccattgaatagccactgcactccagcctgggcaacacagcgggaccctatctataacaattttaaaacaaacaaaatgagatatcaccttatgtaagaatggctattattaaacaaaaaaaaagataagtaatgttggcaaggatgtggagaaaagtgaccctttgtatactgttggtgggactataaattggtgcagccactataagaaattatggaggcacctcaaaaaattaaaaatagaacaaccatatgagctagcaatctcacttccagatatatacccaaaagaactgaaatcaagatatcaaaaagatatctgcactcccatgctcactgcagcattaatcacaatactcaagacatggaaacaagctaaatgtccattgacagataaatggataagaaaaatgtgggatataaatacaatgaagtgttatttggccttcagaaaggtatcttgccatttgtgacaacatgggtaaatctgaaggacactacgctaagtgaaataagtcagacccagaaggacaaataccatttatagggggaatctataatagccaaactcacaaaagaacagtagaatggtggttaccatgagttgagggtggagaactggggaggtattagtcaaagggtataaagttacagttatacacgtgaataaatcctagagatctattgtccgacatactgcctatagttaacattatggtatacttaaaattatacaaagacactagatcttacgttgtgttcttatcacacacaaaaaaagaaagagtggggggaagcttttgaaggtcctggatatgtttatggcatacactgtagtgacgctttaaaaggtgtatacttattgccaaactcctcaatttgtatacattaaatatgcacaggtttcttttctttctttcttttttgtgtttttgagactgagtttcactcttgtcaccgaggtggagtgcaatggcgcaatttcggctcactgcaacctccgcctcccgggttcaagcaattctcctgcctcagcctcccgagtagctggggttacaagcgtttgccaccatgcccagctaattttggtatttttagtagacacggggtttcaccatgttggccaggctggtcttgaactccaacctcaggtgatctgcctgcctcagcctcccaaagtgttgggattacaggcaagagccaccacacccagttgatatgcacaggtttctgtcaataaaagacaatcatatgtcaattgatatatgataaaaagacaagcatatgtcaataaagaaattaaaactctgaaaaatactataaccattaaaaacaatgaatctaaaatctttccacaaacaaaactccaaatccagatggcttcaccacttaattataacaaacatttaagaaagaaataacactggccttgcatggtgggtcatgcctgtaatctcaccactttgggaggtcgaagcaggagaattgcttgagtccaggagttcaggaccagcctgggcaccatagtgagaccttgtctctacaaaaaatttacaaaagtagcccagcatggtgctgggcatggggcatacacctatagtctcagttacttgggaggctgaggcaggaagatcacttgagcccagatgttcgaagtaaaagtgtgctatgattataccactgtgctaggtgacataaataagaccctgtctttaaaaaagggaagacagaaatcacaccaatcttacataaactttcagtgaaagaaacattgggtggaatgtaacactttcccagccagcacattattaccaaaaaatgacatggaaaacacaagaaaagttacaagccaatgtgactcataaacacacatgcaaaactcctaaaaacattagcaaacgaaatcaagcaaactacacaaaggataatatagcaaagcaagttgcatttactaaaaatgtaaaataggcttaacatttgaaaatcagtctctgtcattcaccacaatttaggaatttaaaacaacaatcaggctgggcatagtggctcatacctgtaatgccagcattttgggaggccgaggtgggaagatcacttgaggtcaggagttcgagaccagcctggccaacatggtgaaaccccatctctactaaaaatacaaaaaaaaaaaaaaaaaattagccaggcgtggtggcagtcacctgaaatcccagctactcaaggaggctgaggcaggagaattgcttgaacccaggaggcagagattgcagtgagccaagatcgtgccactgtactccaggcctgggtgaaagagcaagactccattgcaaaaaaacaaatgaataaaataaaataacaatcaaaataggaggcaaagcaagatggctacatagaagcctacaacaatcatcctcctcacaggaacaccaaattgaacaactatccacagaagaaaacaccatcataaaaaacaaaaatcaggtgagcccttacagtacctgattttaacttcatattgttcaaagaggcactgaagagggtagaatgaacagtcttgaattgctgacaccaccccttcccagttttaaagattattggtaaaataaaaatgtcttcaaaagtgtaaacatttggtctaaattatgcaggtcagatattaagtttgttaaatggtctaaggtcataagctgcttctttgacttttaaaaattgttcaatttattttggagcattacattctagataaggcctggcgacctgtgaaattacccatgccccctagctaggcaaagaaggtattaaagaaaagagattttatatatgaaaggatcttgtataataaatgtttgtcctaaagctaaagtaaaatgactggtcatttaaaaagagggatgtttaggacaagtcaaaaagtctaagcatgttgtaggtggtctgtgttaagtcatgaaagaattggtgaaagggaatttatgcaagaaatgcagtacaatttaaaggtgattaggcctcttaaatgcttcataaaatgccactatgactcttaactgtactacttgcctgctttacagttaggtaaggcttgggacttgtggagtgagatgctggaaagagtcagaccttatcttcatttctgtctgggtcctaggctccatgcctagtacataattaaaatgctgaacttaccaaggtttttcaccaaaagtaaaaatgctaagggttaacagtgtaatgtatatttgaaactactgaaaaaacagttttacatgcaaggtgtgtaaagaaagttaaatgtgtttttggtaaaagattattaaaagtcatgggaatgtgaattttttgcctaactttagttaaaggattgttttaagtgaaataggaaaaatctaaaggtttaaacaacttgtggaaattctgtaaaaattaaccctgtaaaacaaattctaggccgggcgcggaggcttacgcctgtaatcctagggctttgggaggccgaggtgggcggatcacaaggtcaggagattgagaccatccaggctaacacagtgaaaccccgtcactactaaaaatacaaaaaaattagctgggggtggtggcgggagcctgtagtcccagctactcaggaggctgaggcaggagaatggcatgaacctggcaggcagagcttgtagtgagccgagatcgtgtcactgcactccagcctgggtgacagagcaagactccgtctcaacaaaaaaaaaaaagaaagaaattctatgtgtgaaaatattgactaaatttaaaggggtattatcttgtttttctgtaaattgaacatcaaaataaaagcacaacagggttttcttaaagcacgaatctgctctttaacaaaaaaaattgtaaagggttataaaaggtttataaaaatctctccttatggtcaaactgattaagattggacagatttgtctaatgaggctttattaaaaattggggttgacattaataatctactaatgtaagagtgaaatatggctttctcgaacaagattttcatgtaatattaaaagataatgaaaaatgtatttgccttttaaatacactatcaaagaaaaaaaagaagggaaagacaaaagattgtttgaaaagctaagtcttccctctatcaatgagtaaacattgttgcctttttaaaaatttttgtctcattattttggctaaatgaatgacttacagtaatgtggaattccagttcataatatcaagtgttttatacctttaacatatttaataagcttccccaaatcaaatttcagcttccaaatagtctcttctgacttctaactttggaatgctatgggggagtccatagcattggaatgctatgggggagtccatagcattggaatgctatgggggagtccatagcattggaatgctatgggggagtccatagcattggaatgctatgggggagtccatagcattggaatgctatgggggagtccatagcattggaatgctatgggggagtccatagcattggaatgcatatggaatccctgaagcatctaaaagagacgtaaagagaattatttaacatgttaagttacatgggaagcattgtcaaaataatgtttaatcttcaggttatattttagtgaatattaatatatgctccaaaattgtatgggatttctaaaattctaatacgtctgagtatatgctaccaatcataattatggttaagttttatacaccatagaaacaaccaaatatccttgggtaaaactgctaacccaagcagaaccaaaaagttaattaaataccaagaaaatactttgccagattttcatgttaaactagctgatactaaaattgtttagatatacaatttgaactccatggtctaagttaaactacctatgataacccattagttatctgcgctatgcacctaaattgtagaaacaagtggtattcaagaggatgtaagtccaacgctaagcatggactcagaaccaggacagctgccttgtccttcttgagtccttaaggctcttgttattaaagggtctgcattccatgactcatcatgggaaggataaaatgatccaaattgaatatacagatgtggtgacttataaattgtgaaaattagtttaaaaccaatgtttggttccatatttctgggaagacaatcaaaccttcagatacatttggctacctgatgggtcatttaaacatttataaagggatttcattcaattgtcattttcaatgcatgttttatgttataatagttaattattacgccacagtatattttcaccaggtaaagaaagtttttatggttcactaaggacaatcaactccttcacaatatagaacttgaagactggatgttctgagaacatcagagaaagactgcccttgccattcacactgcaacaaaacttgggaagcttgaaccttgggttaataatctcacaactgagaagggtccctccacactcttggaaactgtacacccactggaacccttaaggtaaaactaaccaggcaagtttctccccagaagaaaatggcatccttaatgtgaacagcttttcctaggatcatggatcaagacttctactatcattagactcttatcttcgaatattttttccttatttatgcctccatgaacaatagaaatgtaaagggggtctattacgtgcacttatagggtatacttttatttgtagaggattttgcagccagccttatacatgaataaccttatactttggtagataaaagatgaaggcccgatgtagatgcgaaaccttaatggtacatatgttgcctcataatcagtcaaaactctcttaacccacatcatgggccagaaagaatattgtcaggaagccttcactcttctagaaggacatcatttgttagatcctttttccatgatttagaataaaagaggcaataataaaaaatgtatccctcataatagactctatagcagattctactgtaaaggctatggttacacaacagactttacattttcttgtgaaagacatgctaaataatagaattggctaaacagaaaagtacctgtgcagctactgacacttgtggcctatggacaaatccatcaaatgtagattataaaatttcagttgtaggggattaatgaaaagactacttattcaagcgagtagactcctcatctagctccttctttaatctatttaatcttaggtggtttggtttatggggactctggataaggagcacactccaaactcctggcattatcctcccaatagtcatgataatagtctccctggtgcgctgtattctctcaaaggttttaaatgtttgcatgcagccatacctagaatgtcaaatggtctctcttcaactggaatgacaaaagttgaaagaaatatgcgactgtgaggacacagtaacctatgaatgatgtgcagagaccagaaacccaaaatgatagaaacagagagtggcactaaggtcctaggttttggtcactctctcacctaagggagaagctgaccaaaatggggaaatttttttaaacaaaattatgggaggctaaagtttggactaagctcatgcacgaggccccaacaggccaaaccaaactaaaatggagtcatcatgctaaatgtgacataatcaaacttaagacttcaaggaaacacctagatcctagaacagaccaggttctgtttgcctcctgtaaacaggatgttccagcataaggaggtaccctctactcagtccttgttcttgcttttgcaaaactcactgttctactatttcccagtgggtttcaagaccaaataagtacatttacaatggtgatagtgacatcaataactaaagttttggtcaatctctcaaaattgagaaaatgaccaaaagtgggaaattgttaaagcaaaccaaatatggcctgagaaggactctgtacttctatatttgagtccttgtggacgaactgcaacctagcttaatatgcagacaagactgaaaacctaacttaggagtatgtgtctgtaataatagctaaatcttggccaatcccatcggccatacttcaaccattcatagactgctgagtgttaaaactgtgttcaaataaggcaaacgctggccgggcgcggtggctcacgcctgtaatcccagcactttgggaggccaaggcgggcagatcacggatcacgaggtcaagagatcgagaccatcctgactaacacggtgaaaccccgtttctactaaaaatacaaaaaattagccgggcatggtggcaggcgcctgtagtcccagctacttgggaggctgaggcaggagaatggcgtgcacctgggaggcggagcttgcagcgagcttgcagcgagctgagatcgcgccactgcactccagcctgggcaaaaatgcgagactctgtctcaaaaaaaaaaaaatcaaaaaaaagaaaataaggcaaacactgagctgtaaccaatccagcagttctgtacctcacttccgatttctctatgtcatttcccattttttgtctataaatcttcttccaccacgtggctgcactggagtctctgtgaatctgctgtgattctgggatctgcccagttagcaaactgttcattgctcaattaaactcctttagatttaattcagcttaagttttaacatgggaaaaacatattgacagacaactagcaacctccacacaagaggtaaataccaaaaaaaaaaaaaaaaaaaaaaaatcagctttagaagtttcagaatttgcctctagagaaaagaaaaatgatagcaggaattagagcgtagtgttaaggaatactagtttctataatatgcttctacagatctgactttttaaactatgtgcatatataatataatgaaaataaaaagagttatgagagaaaggaaagcagaaatgagccacaacttgtttctgaaagcctgtctttttctttttgggaggagatgcaagagatagacgtaagaactatataaaatcaaaagtaaaccctgtctgcacattagtactctttaagacagtgattttaactgcttggaaacgcttttcttaatttctttttgttcctggatatatccctgattctgtggagaaacagaatattatggcaaagaatctctaaatcacagactctaccaatacaaaactacaatgattacttttgggaagtctgcattactttttgctaaaaggggcactttttctcataaaggaaaaatcaccgccctgatttttcaatttaatatctcaattgccctgagatattactataatgaatcacagtataatttagtttgtcagttattaataccataattcacacattaggaatctccaaatctccaaaaaaaaacaaaaaggccttctttgttcttctgcccccttatcacgctgatcccagataaaaagcctaggtaagcactgagtgaaaaataaatctggccacaagatacatgaaaaaatattcaacatcgataatagtatgggaaatgcaaattaaaaccacagtgaaatattacctcacatctgttaaatagttattatcaaaaagataaaaaatagcaagtgttggtgaggatatagagaaaagggaacccttacacactgttggaaggagtgtaaattagtacagttattatggaaaacagtacggaggttgctcaaacaattaaaaatactcaggtatggtggctcatgcctgtaatccccacactttgggaggcccaggagggaggatcacttgagcccaggagtttgagaccagcctgagcaacatagtaagactcctagctctacaaaaaataacaatattttaaaaattagctgggcatggtgctgtgtgactgtggtcccagctactcaagaggctgaggtagtaggactgcttgagctcaggaggtcgagactgcagtgacagtgcactccagcctgggcaacagagcgagaccctgtctcaaaagaaaaaaaaaaaaaagaactacctatatgatccaactatcccactactaggtatatatccaaagaaaagggaatcaatatctcaaagcgatatatgtgctcacatgttcattgcagcattattcacagtagtcaaagatatggaatcaacttaagtgtctatcaacagatgaatgaataaagaaaatgtggtatacatacacaattgaatactattcagcctttaaaaaaaaaaaaagaggatgggcaccgaggctcacgcctgtaatcccagcattataggaggctgaggcgggtgggtcacttgaggtcaggagttcaagaccagcctaaccagcatgatgaaatccctattaaatatattaaaaaagttagctgggcatggtggtgcatgcctgtagtcccagctactcaggaggctgaggcagaacagcttgaacccaagaggtggaggttgcagtgagctgagattgtgccattgcactccagcctgggtgacagagtgagactctgtctcaaaaaaaaaaaaaaaaaaaaaaaaaaaaaaaaaaaaaaatcctattattttcaaaaacatcaatgaacctggaagacatgatattaaattaaataagccaagaagagaatgatctcacttatacatggaatcttaaaaaactgaaactcacagaagcagagggtgaatggtggttatcagggactagcaggtgagaaggattgaggagatggtcaaaggacataaaacttcagttagccaaaagaaaaagttcaagagaactattgtatgtcatggggactatagttaaaaataatatactgtattcttgaaaagcactaaaagagtagattttaagtgttctcagtatacaaaatcagtaagttaatgtatatgttattcagctagattagctatttctcaatgtatacatatttcaaaacattatgttgtacatgataaacacacataaattttatttgtcaattaaaaataaaaatctttaaacaaaagaaaaacaaatctactggtttgtcaagttctttgggggaaatggttataaatatttgaaatataaataaaggagaaaaaacagaaacacatggtagcaaaagtaaataagttactgtcagttctgtgaagatacattatcctccagatattcgttttacataaacaaaagtggtagagcaacactgaacactattaggctttcctagtgcagctgcatcaatattttaatgtttacttagattgaccataatagttcctctttttctaactttttcacatttattatctctgaccatttctaaatactatgaacaatgacctaaaaaagcatttttgctgaatcaaaaagtcagtgtgactaattcaaattatagaaagaaaatggtcatccataaaattaagagttacctaagatcatacatagctaatgaatggcaaagatataaaaccaggtctctttaccccattactgaggaaactatgtcaaaacaggaaagaagcacaactttagtcatgtttccctggtcaacagcgccacaagcaaagtccctgttgctcccacctgtcaaatcagtcaacaccattcacatcaactaagtaaattattgtgctttacttacagggtgtattacacgagatgggctctttccaattgccaaactatatgcagactcatttgagctacttcataaagaaaatttagtataagaaaatgtgggggaatatgaaaatataagaaaaatctccacaatcaggcttcactgacaactgcagcactggccaggataaaataaaattggttcccaataggaaggaattctggttgattattgtcaaaatttagcttcccaactctgcccctattatgactgtagttttattttactctccacaataactactctctttctactacatgatttctactgtcctgcagcttctgcttactacattctctgatatctcacattgaaattccctaagaaagataagattgatttaattcatcatttacagagctattggacagagttcctgggccaggccaagctataagccactggcctacctatatatcactgatgccagttcctggtccaggtaattgtggcaaagaagaatggcttcataacaaagcataacaactgatacaagcccttgaagccgcattagtcagaaatgagctatggttgtagcttccactaagagcactgtttgcccatatacatttggattataaaccaaaatcctcattagataaattcagacttaaaaatctggcctaccctctccagggtatagtctcatactgtcacccctatacacaatactcctttcacagcagatccaaaacagcaatctcatctcacaccagcccccataatttctactcctgacctggaaaacgtaatagcatctctctcatcaaaatcttttctctaaattgaaattttcctttgacccagtatttatcccatatttatcctataacgaagtctgacacaagaattatgctagacgaaactattcagatgaaagataattatttattatagaagaatgattgtactaactggtacatccaaacacttcctagtaaaaatacaggtaaattttactgatcaccatttattaattattcaccacgtcaggcactgagctaagcacttgacaggaaacatcacgcattagcaaactcaggcccagaaaggttaagttcttatccaagatcacatctaataaatagcacaactgaaattcaaactctatctctgtgatgccaaagttcatgtttttaacaattatcccatactgtcaatgactgcaaagtacaatcatcaacaggattttatagcattgactaatcctacctctttccccacaaaaaaatcttccaatgtgctctaatgcaatgattcccaaaacactatgcagtgagatatcatacagtaagaaagttctatgaccaaataggcataagaaatgttacaggccaggctcagtggctcacgcctgcaatcccaacactttgagaggcctaagtgggaggaccacttgagctcagaagttcaggatcacctattatcagtagaaaccttgtatctactaaaaattaaaattaaaaaaataggcatggttgtgtgtgcctccactctcagctactcagaaggctaaggtgagaagatcacctgagcccaggaagtagaggctgcagtgaaatacgatagcatcactgcactccagcctgggtgacagagtgaggccttgcctcaaaaaaaaaaaaaaaaaaaaaaaaaagaaatgctgtactaaaaagagcttggtcaggcacagtggctcacgcctataatcccagcactttgggaggccgaggtgggtggatcacttgagcccaggaatacgagaccaacctgggcaacatggtgaaactctgtctctataaaaactagaaaaattagccaggagaggcaggaggactgcttgagcccaggaggcagaggttgcagtgaaacgagatcgcgccagtgcactccagcctgggtgatagagcaagactgtctcaaaaaaataaaaataagtaaaaataaatttaaaacagagctcaaacttctatattgtaggacatatcagaatttttaacatgccaatccaaactatgaatctctaagaggtataaatacacacacatacacacacacacacacacacacacacacttttttttttttttgagacaggatctccctctgtcacctgggctagaatgagtggtgcgatcaaacctcattgcatcctcaaactcctgggcttaagcaatcctcatgccccagcccccagagtagctaggactataggtatgcactaccacatctagctaattttttatttttattttttaaaggtagggtctctctatgttgcccagacaggtctgaagctcccagcctcaaacaaacctcccactgtggcttcccaaagtgctgggatttacaggcataagccattgtgcccagccaagaggtaaataagtaaagatattaagcagagtttctcataattatttagctgaagttaccactcttcacaggccattgcctggaactcatgttttgtggaatgcaccttagaaaatgcttatctagtaaaaaaaaaatttcacatgaccatctttttctttgataatttcaactaaactaggacagttactaatcagtaaatcttatgattactgctcatccatacaccacttctaggtgaaaatgtcatggccacgctgagggccagtgaccatgttttggatcatgtaactttactcccattctgagataactggacagaataggcaccaaaggaatatagcccattcactacatagtctgcctcaaaaagattagttgggcaaataagatatatctttaaaaatgggaaacaaacaataaagcagagggtccagaagagccatatagtgacaatagggcagcagatggaaatcacaaaggagtaagaaactactaataagcaaaggaacagagcaaaggccaacagaaaaaatgaggggcagggaacagagaaggcatagagaaaagtaagagatggactctgttcacatttggagctagttgtagctcctgggaacctagtccttggacttctatgagatctttattgtacccttataatattgtacccctttggatttaactagcttgagaagttgtcttttccttgcaaccaacactatttaaattcacacaaggagagtttaatttccttgtgtgaaatgaagtagtacaagtcaggtgttaagagcacaggttgtagagttagaatacttgtaattaagcccacatcttttattgttaagatgcaaaatttggggaaagttaactaaagcctccaattcccatgtataaaatggaaatgaaagtatctccacctcagtaaggctgcaaggattaaatgagctgtctgtaaagtgctctgtacatagaaagcactgaataaatgttagctattattactactaatttgcatgcatttcttttctctcactcaacaggaaaaccttgtccttagaacctaactaagaaaaaagaaaaatcctatttctagatgtaaacatctgataaatattgcttttcaaaaaatgtattagtacactgtagccacaaggccttagccacagggaatccctcaccctttgtactttttatagaactaataatattaaatactctgaaaatatgtttgatcttaacaaaataattcttccaaaacaggataaaaatgttacatcaacaccagatataccttatctaaagcatcaacatttttagagattccgaaacataacatattttaaagggcaacaaaataagcctactttataaaataaaaaataattttttattttgagattattatatttggaataaacatgcagacctactataataacaaaaaatttaaaagaaaaaatagtagcttctcttgaggacttttaataacacacaatttcaaatccaaaaacaagtgatctcactaccatttattagctgattttaacccaactaatgcctgaatcatattaatttcactccatatattcgaatagttatttgcttactaggaacaatttatacttaagaaatttatctacatcattctctgatttggatagtttgggttctcctgcctgacagcaaaatagttattcagatcagctttagaaataatataaaaaattttaaaaggccacaatagtttttaatttgcccccaacccataatgtgttaataaaattagaagtctgcattatttgtatttcaataagactattactcatctttcataagtaattatgtccactaagggcacattttggcatatgcaaagaagagccaatatctgcagagcacaatgccacacacctgtaatcccagcactttgggaggccaaggcaggaggatcacttgaggccaggagttcaagaccagcctgggcaacatagtaagaccccatctctacaaaaaaaatttacaggtcgggcacggtggctcacgcctgtaatcctagcactttgggaggccaaggcgggcagatcacgaggtcaggagatggagaccatcctggctaacaggatgaaaccccctctctactaaaaatacaaaaaattagctgggcgtggtggcgggcacctgtagtcccagctactcaggagaatggtgtgaacccaggaggcagagcttgcagtgagccgagattgcgccactgcactccagcctgggcaacagagcgagattccatctcaaaaaaaaaaaaaaaaaagattttaaaaattagatgggcgaggtggtgtgcacccgtagtcccatctactcaggaggttaagacaggaggattgcttgagcccaggagtctgacattgcagtagctgtgattgtgccactgcactccagcttaggcaacagagagaccctgcctcaaaaaagaaaagaaagaaggggagggagggagggagagagggagaaaagaaaaaaaaatagccaatatttaagcaccactacgtaagtagtaacaactctgtaataaaatggcaatccaattataaaataggcaaatgatctgaacagacccttcaccaaagagcagaagaaaaaaactgatcaacatcattaatcagcagagaaaactagaaattaaaatcacaatgagatactagtacatatacctcaaaatggctaaaatcaaaaagactgacgatgccaaatactgatgagattatagagtaactgaaattctctttttgttgtagttgttttgattttgaaacagtatctcactctgtcacccaggctggagtgcagtggtaccatctttgctcactgcaacctccacctcctgggctcaagcaatcctcccgtctcaacttaccgggtagtggggactacaagcacatgccaccatacccaacttatttttatattttttgtggagagcgggttttgccatgttgcccaagctggtctgaaactcctaggctcaggtgatctgcccaccttggccccccaaagtgctgggattacaggcgtgagccactgtgcccagccaactgcaattctcatacattgtcggtggagacataagatggtataccactttgggaaaagatgtggtcgtttcttataaaactaagcatacacccacctataacccaaaaattcaactgctaggtatttacccaaaagaaattaaaaactacactcacaaaaacacttataagaatattcatagcagtttattcattattgccaaacactggaaacagtccgggtattcatcaatagaatggatatgcaaacttgttgattcacataatggaatatcattcagcaaaaaagggaacaaacttctaacaaacataataatgtggatatacttcaaaaacatgctgagtgaaagaagccttacataaagaaatatgtgctatatgattccatttctatgatgttctagaataggaaaaattaatctatggcagacaaaaaaatcagaacagtgactgcctctgggaggacagggcaggaagtgactcagaaggggcataatatactgtatcttaatacatgtttaaattacaaagatgtgtaaaattccaggaatgtaaatttaagatttatttcattatatgtgaacattgcatcaaaagaaaaaaaaagtccccaaaattgcattatggttaattatatgcatgccaaactagtttgggggaagatactggtatcaataatttactgtgaaatacatccaaaaaaagatagattagtggatgatataggaatcaacagatggagtaatatatgataaaacaggtataataaaatgttaattgtacaaagtgtaggtagtactatacaggcgtttggtataaattctttcaacttcgttgtatttgaaatttttcataatcaaatgttgtagaggaaaaaaagcctcatccaatccttcaaagtgcaactcaaaataaactacttccatgagccctttcctgtcaccctcagccttctgaacctagtcttactgtctagagcactcacctggcaatatgataattatctttccacagacatctcatccttataaaatagactataagcctcttaggggctgctctctgatgcgagggtagaaaagagtttagtgatctgtttattatgctttctatgtatgtataaattattttattttataaaccgtaacttccaaaagacaactgtcagtcaactaaaatgtaaatacatagatgtatatgcatacactacacacacacattgaaagctaaaaacttttaaccaagtatccttgatttttttgagtccttgattaatgaaatatcctatacctgctgaattcaacttaatagttcatctatgcaaaaataattggttgatgctttctctaaatgttctgcaaagagctatgacaccagaggtctcagattctttacctgaggataaaaggatcctcagggagtctataattttactaccatataagacgaaaaaaaaacttgcattaacaagtaatgacattctttaaaattaataaatattttatcagtgttcaatacaacatttaatcctaaagaaattgtactacttccctgttttaaaaaattatatacaatatacatttagaatcttaaaatctcctccttatagataccttctttctatacctattgaaggccaattgataaatcattcaagaatcttctgttatccttttaaataaaaaaaatcagcacaataaatcaacatttcagacaaaagaaaataagcacattattcatattttatatggttttaataataattacacatttttatcccccaaagaaaaattatgaagctggaagtatcagatatagtaaaaattcaagtttttttttaatttgtgtgaattataatgacataatgctggaagaaaccacactttactttctgtttagaggggttgccctgacttccatgtatgaatgatcaagagaatgaattacagtcttcttaaaaccttaatgataactatggttaattcaagctacaataggttaattactagtatcaagagacatgcagtaacttctactagaataaactctgacctttaaataagtcagagactcttactactaataagtacctaattaaacattaggttccttatttataaagtgaagggtttgtataaaatctctgctgtacttaagaatagaagcctttggctacattagagaatactcaactccattcacccggaaaaatgacatagaagaatataccatatcaaatgaaaactttatcctggctgaaattaaactctctggaatatattaaacacatttgaacatccttacggaaaaggtgaggaaacacttgaacagtccaaattatccacttaaaaacgaaaaaacaacaatatccaaaaatcccatcattcaagcattatctgaggaaaattatccaaacaggtcttaacaataacctgataactacaaaaatattcatgatttataaagttaatattaaaaaataagaactacaagataatccaaggtgcttatgtgaatgtgcttctgccttaggtaaagcttactaaggaatatttgtcaacagcaggcagcttggagatcttcaagctttacatcatcaaattccaagatggttttactgccaaactgccctctttatagctcttgagtattccttataatggggaaggaatgctcagcaaccataatcttcctcccactcctatcagtaactggtacagtgatacttggtcaccttcttctctaatccaaatactcacaatacttcagggaaataaagctcagcttctcattagaaaaaatgttgagaataactgacagagttataataaagatctcacctatgtatactaaaaattcttttagggaagattatatagggagatgcatgcttgaaaagaaaatgggagcagaaggatagcatctaggctgccatcccatcttagtataattgctcattcaatattaattcaatatgtatttaccaagggtcttccatgtgccaggtattttgccaggtactacaaaaaaaatgagcagaaaacagttcctactttatttatttttttatttttgttaatttttaaaatttttattatactttaagttctgaggtacatgtgcagaacgtgcagttttgttacatagttatatacatgctacgatggtttgctgcacctatcaactcgtcacctacattaggtatttctcctaatactatccctcccctagccccccaccccccgacaggccctggtgtgtgatgctcccctccctatgtccatgtgttctcattgttcaacttccacttatgagtgagaacatgtggtgtttggttttctgttcttaggatagtttgctgagaatggtttccagcttcatccatgtccctgcaaaggacatgaacccaaccttttttaaggctgcatagtattccatggtgtctatgtgccacattttctttatccagtctattattgatggacatctgggtgggttccaattctttgctattgtgagtagtgtcgcagtaaacatacgtgtgcatgtgtctttacagcagaatgatttataatcctttgggtacatactcagtaacaggattgctaggtcaaatggtatttctagttctagatccttgaggaattgccactctgtcttccacaatggttgaactaattcaccctcccaccaacaatgtaaaagcattcctatttctccgcatcctctccagcattctgttgtttcttgactttttaatgactgccattctaactggtgtgagatggttatttcactgtggttttgatttgcatttctctaatgaccagtgatgatgagcatttttttcatatgcatgttggctgcataaatgtcttcttttgagaagtgtctgttcatatcctttgcccactttttgatggggttgtttttttcttgtaaatttaacagtttctatctttaaaagctcacagtcaagtgcagaaatcggggggggggagaggtgggggggtatcaacacagggtatctttttaaaatatgtcaatgaatatacaaacatacagtcaatataaaaaatctagagaactcaatgaaaaccacatgcagcttaaattctgtgaaacacgcctaaatattatggacttatgtgaagaacatatatgcacctatgtaaataataatagctgccttctttttgagacagggtctcgctctgttacccaggttggagtacaagtggtgcaatcatggctcaccacagcctcaacctcccaggctcaagcactcctccctcctgcctcagcctctcaagtagatgggatcacaggtgcacaccaccaggccaggctaattgtgtgtgtgtgtgtgtgcgcgcgcgcatgtgtgtgtgtgttttagagatgggggtctcattttgttgcccaggctggttttgaacttctagcctcaagtgatcctctcaccttggtctcccaaagtgctgggattacaggcatgagccatcatgcctggcagcccaacctgccattttttttagtactttttcggctaggcagaagaccttgcttatcagttcatttaatcctcataacaatcacatgaggcagctactactcatacttttatcccagatttacagaggataaactcagctctgtagttaaatgatttgtccacagccacattccaataggtggctaagcacaaactcaggttgtttgacgctagaacttaatgctacttgtgaccagtcaatcgccatgctacctcatacagaccctcactgcagaattacagaggagaggacactatttgtgcaattaaagacctctcggccaaggacagagcactgagactgtaaaggactaggagacactgatcactatggggaggggatatccctgcatgcaggacaacaggacccaggctagatacgggtaaatgcagatttcctctgctactgacactgtttagataccgtgagacattctgagtatgaagttgaagctagtagcaaactactcaaagattaaatacaaagtgacataaacattccttttaaaaaaaaattactctggtggcaatatggaactagctagagaagaatttaactgaaagcaaggaaataaagagatgtctacacttgattagttatttcctaacagctatgatgatgatgacagtgatgatgatggtgataacagaagctccaattttaacatgagggatatggaccacatttcccaggataagttttggccaaaggaaacgtagttgattttggcctttaaacggaagagggtccgggcgtggttgctcacgcctgtaatcccaacactttgggaagccgaggctggcagatggtttgaggtcaggagttcgagaccagcctggccaccacagtaaaaccccgtctctaccgaaaatataatacaaaaattagccaagtgtagtggcacatgcctttaatcccagctacttagaaggctgaggcaggagaatcgcttgaacctgggaggatgaagttgcaatgggccgagatcgtgccactgcactccagcctgggtgacagtgagactccatctcaaaaataaattaaattaaattaaattacattaaattaaattaaaaagggaagggggctatctcttcttccctacttcctccatcctcctacttggaatatagatgggatggagctgagatgctaagtacaaagctagaagcagcctggtccagatggctatacaaacccgaaactgtctacacccagactttaacttttaaagaaataagtttctatattgtttgagacacttaagtccctattactggaagccaaacctctatcctaacagagtgcactttatagtaatccgagtaagaactgataagggcctaaactatggcagtgactgtgaaaacagaggaaaaaaaagatgtgagaaaattttgagggaaaaaaaaacaacactttgaagtgaaggtgagagagaaaggagtgtggcaagtttctgacttgagcgaatggccaaggggaagaggtttgaatgagccagatatgcttgaacatgctgcattttcttttctttctttttttttgagacagggtcttactcctacttggaatatagatgggatggagctgagtggctaagtacaaagctagaagcagcctggtccagatggctatacaaacccgaaactgtctacacccagactttattcttctacaaccaaattcctcaaacacacaatctgaacagtagcagtgaaagggagtttaaggtgggggtgagggagaagggagtaatatggttttttagtaatatagtaatttacattttcaaaaatcttcagtgtttcactatcttaaatgaatatttattctgttgttcctctcatttctttcctcctgttaaaaaaatgacttttattaactccaatctcatgtggatttgggtttactcacgctaagatttggtaaaacatctgtctccaaagaaaaacaagtaacattcttttcaaattccctagaagaccgcgtaggacaagtatatgaagcatttataaaattcactccagtcccaactgctactttccactgtgaattaattttcatactattattgtccaagtttgttctgacacttgatttctctctgtaaatgttactagaattaacttaagctaggaaaaacaaaggacatagttttacctacaagcagatgtcattaactatacagatttttttttccacttaaaaacttgccacaaaaccacttattttctttaaacaagaatcttccattttaagttcttaaacctatattttaaattactataaggacagaatgtttgcttgaagaaaaaaaatagagagatgtcaagttcccaaacaatttgttttcttcaaatcatggtattagtgaaccttgtaaattattaatacagtacacaaaaagctacaatggatcaacgaaaaagatgacatttatagaatggtgtcatcagtggaaaatagccctttccagaaacaacacaaattctttctcctaactcagtctgttaggaaaatcaccaaaagcccttcaactgtctactcaataaacaatcagtaaataattgtttacttcccagtgtgtaaagcattctgctaaaaaagtagtagtctctctgttgaaaggacattttttccagtttcaaaagtttctctacggatagcatactgtgatatatttgggccatgctctcaaggaactctttttcagtctaaaaaaattagacaaatgtaaacggaaagaccttgaaattttcagaactccaattccttgtttcaaacatttctaggacacagtaaagaccaaagacaagcagcaaaatgtttcagagatgtaatctgaaggtctgatctctctgaaccagccccttagcatcttcgtcttcatgaagctatgcagtttcctctgttgtttcttaagcaatacctcattaagtgatttttttttcctaattaaaatctccctgaaggaagtaggtatactcccatactactactgagagtataaactgacacatctttctgcaaggcattttagcaatatacctcaaaactattcaaaatgttcttttggctttcagaaacagctggaaccagaagtttagataatgtttccagagctatgtctgtcttttcattttttgactatccttgcctcagcttgtgttcaatactcagagactctctaaacacagtaaggaaaacacacactggcagcctcaacttaatcacagtatcttaccttagtcatcctagtgggaaaagataggcgtgccagtttgttccaaaagaaaacacccaagctctaaccggtccagcttaaagtagagggtagggtaactaggactgaaactttccctggaaccgtagagaaaagaaggcatggttcccaaaggaagggatgccaggaagaaaattcacatatgtccatataaacatacatatccttgacccggcagttccatttctatgatgaaaatgtggcactattattgtgtaccagacactgttttactttacatgaaataactcatttaatcttcacaacatctctatgaggtagatactactatttactattatccaattttatgaatgcagaaactgagacagaaaaattaagtaacttgtctaaagccagaactactaggaggcaaaaccaagaatcaagctcagactatgtggctccatcccacactttatctatttttgtagaaatggggtcccactctgtcacctaggctagagtacagtagtgcaatcatagctcactggaacctcaaattcctggtttgaaatgatcctcccacctcagcctcccaacttgctgggattacaggagtgagccaccacatctagctcatcccacacttctaacttttctactactaaaatttactgcctctctatttgatcctgagaaattaaaaatcaatgcaaaaatctggctagaacaattcatcacagcactatttataacagcaaaaatttggaaataacaaaattatctaaccatgagattaactgataaatttatttactttaaattatatattaaaatgataaaaacattttgtagttaataaaaattgatgttatgttttatatatacaaagttgtccctggaataactcaagggttagatgcaccaacccctgtgcagtcaaaaatctacatataacttatgactccccaaaaaactttactactaatagcctactcttgaccagaagccttacagataacataaatggtagattaatacatattgttaatgtttatatgtattatataatgtattctacaataaagcagactagagaaaagaaaatgttattaataaaatcataagaaaacacagttactattaagtggaagcagatcatcacaaaggtcttcatccttattgtcctcatgttgagtaggctgaggaggaggaagaggaagggttattcttgctgtctcaagggtagcagaggcagaaaaaaatgtgtataagtggaccaacgcagttcaaatccatgttgttgaagagtcaactgtatatagaacatggaaagcttccaataacatgcagataagttttaaaaacacagcttatataaatggatagatgctataaacatgtttttaagaagtaaaatgaggacgggcgcggtggctcacgcctgtaatcccagcactttgggaggccgaggtaggcggatcacaagatcaggagattgagaccattgtggctaacacgctgaaaccccgtctctactaaaaaacggaaaaaagttagccaagcctggtggcgggggcctgtagtcccagctactggggaggctgaggcaggagaatggcgtgaacccgggaggcggaccttgcagtgagccaagattgtgccactgcactccagcctgggcgacagagcaagactctgtctcaaaaaaaaaaaaaaaaaaaaaaaaaaagtagtaaaattaattatacatatatacgtatatggatgcacacaaaaatctctggaaatacatatgttaaaatgtcagcagtatgccacttcttacccactggagtggttatgatcaaaaagacagaataacaagggagtagcaattgcaaaaccaaggacagcaatcttgattcttttttttttttttttttgaagttaagaattcttttaggttgtaatattttcatgttagtttttaatcatttacaatgttctgtgggtcacattttaaacatttttaaatatatgaaattctgtatttctttaagtacagccacaactacaaagcagagaaacgtaagaatacaaaaatcaaatctgcttcatttatatacacgatggggcagcctaatgcacatcataacattaacttttccaaagaagtttgctaagaatctgctcccataattagtgttaaaaataaagcaatcttcccatttagaaaaatcaagacatcagttgattaataaagcctattcttcctcccagcaatttgtactttctggtcttcatttaggaattataaattcatgagaaaagaacaaattttttatggaataaataacttccaggaacaacagtttataagtattcagttgtttaaataaacaaaactattttccttcctaaaatgtaaacatccagtaaatgaaacatacatgatattccaggtatagaaatcttagtaactcacttatgaaagaggtgcattttggtatgtttggtggtaaggtttttgtttatcttatgtataaaagtacttgcacaaaaaaacaagcagttattactatttaaaattctattccttcacccagttttctcactcaagtagaaactcatgaatatctgtgattttggctataggaccaggccacaggaaagggctgaaatatctctaaaagttaggtaaaagtgttttcttgagacttgaaggcagtcattcatcactttgtgcttgaaggcattcctcagcaaacttctctcgagtcttcagagtaaagcacaggatctaggctcccggaaggggttacttccagctggaacacccaccagcagggcatccttgcaggcattctgcatacagtactgttgaagctctgcagctgcctgagagaccttgatcctctccacgccagcctccaacttgagctgctctaccaagagctgcagggcgctcgcgctagccccggaggacatggcggcggcgctgggctcctaggggctgcagcaatcttgattctttaggagaatgacaagtcgttcactgtaactaaggcttacttacttgctagttaccagttactcacacaatttccttaagtcttgcaacaatttcttcaataacttcaaacctcatgagccacaagtacaaacaaccctgggcaaacacggtgatttcaccataccatttctttaaaattattcattaaaaataaaaaataccaggccaggcacactggcttacgcctgtaatcccagcactaccaaagtgcgaactcaccagttcaagaccagccagggcaacacggcaaaaccccgtctctactaaaaatacaaaaattagccaggcatggtggcatgtgcctgtagtcccagctacttggaaggctgagattggcttgagcctgggaagcagaggctgcagtgggctgtgatgataccactgcactccagcctgggcaacagagccagaccttgtcttaaaataataataataataataacatgccgggcgcggtggctcccgcctgtaatcccagcactttgggaggcccaggtggacagatcacctgaggtcaagagttcgagagagcctggccaacatggtaaaacctcatctctactaataatacaaaaattagccaggcatggtggcacatgcctgtaatcctagctactgtggaggctgaggcaggacaattacttgaacctgggagacagaggttgcagtgagccaagatcgcgccactgcactccagcctgggtgacagagtgagactccgtctccgaaaaaaaaaataaataaataaataaataaatgaataaataaatccctggagtgagcctttttgtaacatgtaaatagaagaccgtttttagtttttgaattatttgataactaattattctgtttaattattagtagaaagaacagacccattgtacaaaagggagtcaaatgaaagggataggacaagctttcagaaatcattacttcaacttaattgcacaagttaaatcagcccaggatctagatgtttttgaactcgaattactgttttttaaaaaattgcttcaacattcatgcttactaagtaataaaaattgtatcattatttgttcagattaaaatcaaacagaaaagactacaatgaatcaattaaaaataaatatgagcacatgcttctaaagaacttatttttcttttagaagaaacagaaaatataaagcttatttagctgtgctttgatttgtgtatgaatgttatgaccatgtttctaggtaacatcaaagttttgtcaatgctaggaccatgggtggcaaacaggtacaaaaacaaagatgtcccttcccacactgctgtatgtgtgtatctcttcttcttgtgctaaattataatgtagcagaccagttagtgctgtagtttaaggccttggataagaaatggaatatctcctgaagcatagccctgatatcaatcatacagaaaagaaacagacatttggatggaaaactggaaccaggaaaatggacctcattagatagacctgacaggaataggttgtctgtcttgccaccatctagggcctagacttaaggaaacatgctgaaaggcaagatgaccttcatcatatgatggcagaccacaaactaggcagggtggaatccctttaggagactacagactgaaaaggaggaaactataccttgcaaaccagactactgacttaaaagttattctctggtttcattatctttttatttttaacctttagaaaagttttatttcactgctgcagctttgcctcagcaaataaaagtatgaatgatttggcagtgggagttaggccagaatgttaagaaaaagtggcactccatgagatcactggagaaatagaagaactggagctttgagttcaagccaatccttcccatacagaggcaggcgctccttccgctgtcaaccttggaggactagggtttcattttattaagagaattttaaagtttctgttcaggtacctagaactaaattcatcgtgacaaaatctgaagagatatgtactacattcaagagtcagcaggtttctgtagtgtttaaaattacagggttttgttttattaagggtttcattttattaagagaattagaaagtttcattttattaagagaattataaagtttcagccagagtagtcgctcacgcctataatcccatcactttgggaggccgaggcagacggatcacctgaggtcaggagttcaagaccagcctggccaacatagtgaaacactgtctctactaataatacaaaaatgagctgggagtggtggtgggcacctgtaatcccagctactcaggaggctgaggcaggagaatcgcttgaacctaggaggtggagattgcagtgagccgagattgtgccactgcactccagcctgggtgacagagcaagactccatctcaaaaaaaaaaaaaaaaaagaaagaattagaaagtttctgttcaagtacctagaaacaaattcattgtgataagatctgtagagctatgtactacattcaagagtctgcaagtttctgtaatgcttaaaatttttaacaagtatgtattactactgtaagtaaaacagtttagcacaggcacgtcagtggaagcaatatgcaaatgaatatgcagaagcatgcaccagaaatatgcagcagaaccaccaccatcctggttatgaattaaaagtaaaaactgggtagaaaaatagatgagcagagtttccaaatcacatggacacctgaactcaatagccagggagaaaggatcagtccagaaactaagtccataaggaggtaaagtcaaatgtgagtaaaacaaaacacagtttatagagaaaggagaccgagaaaagagagagaagagaaaaaaaagaaagagagaacaccagacaatcaatctgaaagcaaaggcaattaacctggttcctttgagagccagaacttttcccaaggtgttacccccatttgtgcttgtaactataaaagcacaatatggctttaaaagtctttagtggcaaaactctaaattctaagaccaaagtatatttgattctctgttggagcatcttgacgggtatgacacccatctccgcatgacttcctacttacacaagataaaactaaaatattttaagttatttgtaggatgtactgaatactgttttactattcgtgttcttagtttctacagtaaaatacatgtataccttacaaaactaaaattgctttttacttacatgacttttcattaacttgtattctacggtttaacattctttcattaatttaaaaaaaaaaaaaaaagtatcccaatcctcctcatttccaaggctgcaacagaatcttaaaacaaaacaaaaaaaccaatacactagaaggagtaaaacaaaaactgcttcttggggaacaattcattgtttcaaaataaatattttaacaaaaaattctataggctctatccatttttaatcatacctaccagtgagagtctactaggtgacttcttaagtcaacatttaagagtggggaaaaaaatgtgatgtttcattgctgtctctaaatttatgtggtattcataacactacagattacaacatgctatacaggtttcaacatttgaaaattctctggagttgtaatcatagttaaaagcaaagcattaaattcaagaagcttgaaaaaaagcaatgttttctgagaatgatcttttaacagtggtcaatttgcatagttttttactttctacaaaatactttactgatgaggggaaaaattattttctaccataattaggaatctggacttaacctgttatgccaaaaacagcaaccatactttgcaacaaaaaaaattttcaaaagcattttcaatcttcctgactaccaaagtttccactaccaaaagtgaaaacacttttaaaccttcctgtgtaacaagttttaaattttcttttatttatttgtatcaattttctcacctgtggctgccaaaatatcaagaatttcaactccagagaaggaggacagaagaaacacaatgtaaagtggttggcctagtaaaatagttggaaaaaaaactgttttggctgctctaatataatcttcatttattactcattagttctcttcttatggtcccaatattccagccaaattgagaatctactcactgtttatcaattcagtgcctttgccactactcatctccacctcccagtccccacaatgtatttatagacaaaagttttgatttaaagccagaaaactgggttcaagtttcatttaatcccttttaattccattcatgatcagtatgaacatggacaaattattttacctttatgcaccttcaaggataactcagtgtaaccatgaagagtcaatgcaataatgtgaacacactcaatttttttaaatgaatgaagattcaatctgatagtctctgcttgtaaaacaagtgtatagagaaatgtaggctgtgacactagatcccaagaaagtatctactggttgttatcaatataataatatggagaaaacaggtggcactagtaatttaaagttagaacaaggaacacaacacaaatttaagcctttcttaaaactgtgtaaaacaggctcggtacaatggctcatgcctgtaatatcagcactttgggaggccaaggcaggaggattccttgaggccaggggttccaggccagcctggtgaacatagggagaccccatctctacaaaaaactttaaaaagatagtgccactgcactcctgcctgggcaacagagcgagaccccatctcaaaaaaaaaaaaaaaaaaaaaaaaggcctgtaatctcagcactttgggaggccaaggcgggcagatcgcttgagcccgggagtttgagaccagcctaggcatcacaaagactctgtctctaaacaaacaaacaaaaaatcatgcaaagctatgtatctgtcttccaaggaattctgaattttctacagcttatttttcaatgaagtatttagagtggatgctgatttaacttgtaatgttgtgggagtgattcctatttcatatgtttggctttttgaataattttgtttgttgcaaaattgtttttaaaaaattaagcctatttagcactgttctatccagatagatttcctaatatttacaaactactattattataataactgcatgaaccattgtgtttgtggtgagttgaatagcgttgtccaaaaattcacgtccatcagaatctcataatgtgactttatttggaaacagggtctttgcagatatagttaaggatcttctgatgaaaattatcatggatttagggtgagccctaaatccaatgattagcatctttataaaagaaaagaaagggagatttggacacagtaacagagaatgcggccatgtgatgacagagaaagagatcagagttatgctaccaccaatcaaggagcccctggggccaccagatgctggaagagggaaaggaaggatccttccctaaatccttcagagagactgaggccctcctgtcaccttaacttcagacttctagtctccagaattgtgagagaatggtgtttgttttaaatcacgagtttgtagtaatttgttatggcaaccccaagaaactagcagagtgttggagcttaactaagcactattgtttaaacattttaaagtgagaattctctgtacttccctgcaatagtattaattttcccaaaagacccaaacttttttatcttcttagttaacaatctttttgttcctatactctagatcaatctatactgtttgaaattcatttaaacttaagcagttatgtgaaatatttccctaggcaaaattagtttttaattttctttcaagtaaacaatgaaacctacagctataactaaaaacttatgaaaaattttatgatgaagacattgataagtatatgggaaaataaaattatcaacttataaaagttatatttgccttcgcaatgtaaattatggtaataacaattttaaataaataacttttactcaataaacaactgcataaccaaccccaaaaatttcgagagctcagcaataataggatattaaatcttataatatttaatgatctcagttctgaccataataatgttttaaaattaagaaatactggcagggcgcagaggctcatgtctgtaatcccagcactttgggaggccaaggcgggtggattacctgaggtcaggagtttgagatcagtccggccaacatggtgaaaccctgtctctactaaaaatacaaaaatattagccgggcatggtggcaggcgcctgtaatcccagctacttgggaggttgaggcaggagaatagcttgaatcggggaggcagaggttgcagtgagctgagaccgagccccattgcactccagcctgggcaacaagaacgaaactccatctcaataaaaaaaaaaaaaaaagaaatacaattccagcaacacaatgatttaatcaatgccttcactttcctaacagtttttaataaaaatgatctttatcatattgggcataacaacctataatatacaaattaacctacaattaggaaataaaactattcaaaaagttatttcaaggctgggcgcaatggcttaatctcagcgctttgggtggccgaggtgaaagaatggctgaggccatgagtttgaggctgcagtgagctatgatcgcacttctgcaggcattccagcctgggcaacagaacaagacccggtcttgtattaaaaaaaaaaaaaaaaaaaaaaaagccaggcgtggtggctcatgcctgtaatctcagcactttgggaggctgaagtgggtggatcacctgatgtcaggagtttaagaccaacctggccaacatggtgaaaccccatctctactaaaaatacaaaaacttagccgggcatggtggcaggtgcctgtaatcccagctactagggagactgaggcaggagaattgcttgaacccgggagacggaggttgtagtgagctgaggtcgcaccattgcactccagcctgggcaacaagagcgagactccatctcaaaaaaaaaaaaaaaagttatttcaagaggttaggtctcttggaattcattatttagatactagtacctaaaatttaaaagcttaccctgaaacttcttggcacatatcaccactatcttttcctaatacctccctgtctgttagtgctaagtttacctgtagatttccagttctattatatgcctacgtgacctgtcacctcccacagtgtccttacacctgatcagtgatatgtttttttgtgtttgtttttgagacagagtctccctctgtcacccaggctggggtgcaatggcacaatctcagctcactgcaagctccacctcccgggttcaagtgattctactgcctcagcctcctgagtagctggaattacaggcacgcaccaccacgcctggctaattttggtattgttagtagagacaggggtttcaccatgtttgtcaggctggtctcgaacttctgacctcatgatccgcccacctcggcctcccaaagtgctgggattacaggcgtgagccaccacgcctggccgatcagtgatgttttaatgtgcatcattatagaacacagttttcagtatcgtttatctgaaatgtttggcatcagaattgtttcaggattcttttggatttttaagtatttgcattatacttactggttgagcatccctaattcaaaaatccgaaatccaaaatgctctaatgagcatttcctttgaatgtcatatcagtgctcaaaaagtttcagatttcagagtatttcagattttcagattagggatactcaacctgtatctccaagattaacgaaatgacaattttagtttccaaagtacatactctttagaagggatgactaagagctggactgatatatttgtatcccaaatacatgtgcttgagacccccacaacataaggaactttattcctatacatactatccccactttctccagcatcaactgttctcattccattgatttccactcttctacctttaaaatggtcacatctattccatacatttttaaaaactctcactggatcttactaagtctgcaatttaattcaacaaacatgttactgagagcaataataagccaggcaactctgggatacaaaaaatagtctttttaccctgaagaataggcattcaaagttttccaaccagatactcttacctctcaaaatcagattactgaaacaaatcatcttaatatgctgcctctacttcttattctttatcctactaaaattctgcaatatggtttacaatacaacattccagctgaaacaatctgggctaaaactacccttgatacagcatggtgtactgcagtatgggcatgagaaaacttctattacaagatttgccactcaatagctgtgtaactactcacaggtaacaactggggattgggggtgggggaggcgggcagccttcactggtttctccttacccaaaaattggacagatatagattatgtgtacagttaactttcggccctaaagttttatgaaatgcaaagcttttcattaactccttatctcactgatcgctatctgccacacctgacactaagaaatattccttcactttctatgacttttctgatctcgccttcttctgtgtatctggattcagattacccacatgaagcaataaactcagatttataatggtttaaacatgtaagattatagcctttcatgtcaaaataaataaataatttaaaaattcatattaaaataataaaataaatccagagggtagctatccaggtctgctatgacaatcccactataagtcattagggactcaggttctttctagctttttgctctgatatacctagggtttgggccttacctacttggcccaagatggctgctggggctgcagccttcatatcagaatgccagtcttaggaaaaagaaaagctaggaaggcataccctcatcctttaagaacacttataggatactgcattcatcatttccacttacatccaactgaccagaacttattcacatgtttatagctgtcagaaacttgaaacagtctctcttatgcatgtccacatgattattcaaaaccatcaaggagaagaatcgccatggaggagaaccaaatgtctcttccaaactctccaaacccttctgtggttccttttcttttacatcctcttaccaatagtgttccccaaagcttggttctcggtactttattcttctgtctctatgccaacttcttgggaacacctacacaatttcacaactctatatactctaatgactctcaagtctttgtacccagtccctacctgtcccatcttttgaagtctccacttggatagctgcaaaataaacaccattctatgtcaatcccacaaacacaaatgagtaactttaaaagaaaaacattctcaatcttccaatttaagtcataacatcacaagtacccccagacctccaggtctgcaattttgaagttgcctctgactcctctttccattttcaacaagccatgagttgcaggtcatattgaacttctaaaaagaaatgaaacaaactagactacatgaggtttatacagcatatgacttggggcatgtattcatcaaaatgactatggcccccacaactctactataatgttcgaaagttatcctaattattaaatccataagcctatttttagtccttattatacatgacattttcagcacatttgacatttgttatttcctcctccttgaaattctatatacccagggttttccatgataccatatcatgctatcttggttcttttgcaatacctctgactactcctatttagtttccaggctgccactgctttatctaccttttgaatattgatttttctctgagtacaattctgaggccactctttttttcactcttgcacatttcctaggcaatctcacatttttcttcatatttgacaatcagctggctactgacaattgccaagttaaatctcacttttctccttacctcctgactcacatgtctaaacacctaaatgacatctctaccttgattatagaccatcacctttcactcagcatttccttccctcatccaaattcatttcttctcctgaattccctatttgtatccatagcatcatgacacatattacctctcatccactctttctactttacccctcacattcattcattactaaattttactaatctgaactttcaaatttctctagcatccataccttccttgccatttccaccataaaaacgtttgagctttctcatactggtctttctcccttcagttcattgccatttgagtcacatttctatgttgtttcttgctttttaagagctaccatttttcaacagaccccaccatctatagagtcaaggctcaccatctatagagtcaaggctaaattctatagcctgatatacagagcttttcacaattgtcaacccactcaagcatcaaagcctacctcagtttccatctactttcacttctctccattcctgtaacaagacattcacatacacacatttttcctctatgcctataatctcctctatcctctttttcacatagcaaatgtttatgcataccatacaaattggtttaaatatcacctctcataagaagtcttctctttttccctcagtaaaatggatccatcctcttgaaataagcaatttatcattacttatttcaagaccttatccactaatgactaggttagggatagagttttaatctttactcatttgtatctagcctagcacttagcacaatgcctggaaagcaataaataactgtcaaatcagtgaatcccaaatggttcttgacaggtggcaacaaacagcaactagaaaataccaactacttcaggggagaaaactcaggctatgtattacaatggtttaacaataatcaattatcaatttttacaatgtctcaaaatgtggtatttcaggtgttatacataaatttacattctagcttgtctctctcatagtgcttaaataaaactgattaaatgcctaagaaacatgtcgaatgttctctaacatacttaaacagactgatatgaaaaaaaacaagaacttcaaataattaacataattgactccagatgaaataccaccaagatacatgaattataaatgtattaatggacagaagaaataaaaaaaagtaaaggcatataaaattaacacaggtagtcattatcaatttttctggacaaatctcagtaaaagaaagtaaaaacaataagaaaaatatagttggctaaataacttcacatattagaagctaatgatatttcttaattattctgccatagttcacaggcaaagtcagaaaaataaagtcttaatttcaaattatcaaaatcaaactatcataaaaatcagtggttttcaagctatgttctcctcagcataacagcactataagaacacaaaactggaaacaaggtccaatagtaaagtgactaagttaaaatgaaacactcaaatgatataataatacagccactggacattatgtttttctaaaattttataaaataacttatgtcattaatagcttttaaaaagatagtaagggtatctttctatcttccttatagctttttaaattaaacttttaattttgagatagttgcagatttacacacaattgtaagaattaatacagaaaccatataccctttacccagttccctccactggtgacgtcttgcaaaattaaattacaaaatcaccaccaggatatcatacaatccaccaatctcattcacatttcctcagttttacctatactcatttgtggttgtatgtgtgtatttagttctatgcaattttatcacacatgaagatatatgtatccaccacccagtcaaaatataaaacaattttatcaccacaaaaattcctcccaattacccttttataaccacatccacctcccaccctccttttttatagctttttcccccatattttcaacaactgtgtgttcattccatgtatcttccttaactacctatgatgtaccaggcacccttctttctatataattcaaatagcatgcattaactcttttttccagtttgtaaaagaaatttttcaaaagacaaggggtttttgcttttgtttttgagacgggatcttgttccattacccaggctggagtttgttccgttacccaggctggagtacaatggcaaaaacacagctcactgcagcctcgacctcctgggctcaagtaatgctcccacctcaacctcccaagcagctgggactacaggcatgcatcatcacacctggctaattcatttttatgtttttttaatttttagtagagacaaggtctcactatgttgcctagactggtctcaaattcctgggcacaagtgataacccacctcagcctcccaattacaggtgtgagccaactgcacccagctgacaagagttttttttttttaatccaattataaaatataaatatttaaaaattcaactgcaagtattgttaattgaaaagacactttaggaacaaaaataaagagtgtatcatttggccagtgaggtgactcacggctgtaatcccagtgctttgggaagttcaggcaaaaggactgcttgaggccaggagttcaacaccagcctgggtaacatggtgaaaccccatctctacaaaaaataagaaaattagccaggcatggtggcgtgcacctgtagtcccagctactcggcaggctgaggtgggaagatgaactgagcctgggagatcaaggcttcagtaaactgtgattgtgcgactgccttcctgcctggtcaacagagtgagacgaaaggaaaggaaaaagagaagggaaggcaagagaaggaagagaggggagaggggaggaaaaagggagggagggacagactttctagaattagaaaaaaaaaaaatctcaataatactgaggcaggagaataggacctggtggcagggaacctaaggacttcctagaactaaatcaaacagaaaaaccccaactttctacatccaagtaaataattgtgtaatttcccttcagctatgtcaggaaacatcctctttatttgcatagggtgtacaccaagtaaataactttgtaacttcacttcatcctcttcatttacataaggcatacactgcataaccaatgggaatcctctagagggtatttaaaccccagaaaattctgtaaccagcactctcaagctgcttgctcaagcccattcccaccctgtggagtgtactttcatttcaataaatctgtaattttctgtcattgctttgtttgtgcattttgtccaattctttcttcaaaacaccaagaacctggacaccctccaccaataacagtaagaagtcaaacaacccaataaaaaagagcacaaatttgatcagacactttacaaaaaaatacacaaatggcaacaagcacccgaaaaggtgttcagcattattagtcaccaggaaaacgcaaattaaaaccacaaatgaggtatgttaagagagtagatcttttttttggagaaaaaagcctgttgcccaggctggtctcaaactcctggactcaagcaatccacccacctcagcctcccatagtgatgggattacaggcgtgagctaccacgcccagccaaaagagattttaaatttcttcacataaacacgcacacgcacacacacacacacacacacacacacacggtaactatgtgaagtgatggatatgttaattaccttgactgtggtaatcatttcacaatgtatacataaaacatcacgctgtccaccataaatatatatgatttttatttgtaaattatatctcaataaagctagaggaagtttttgttctttggtttttttttttttgagacagtcttgctctgtcgccaggctgtagtgcagttgtgcgatctcggctcactgcgatctcggctcactgcaatctctgcctcctgagttcaagccattctcctgcctcagcctcccacgtagctgggattacaggtgcacgccaccacactcagctaatttttgtatttttaggagagacggggtttcaccatgttggccaggatggtctcgttctcctgacctcgtgatccacccaccttggcctcccaaagtggtgagattataagtgtgagccacggcacccagcctgtttttgttttttgtttttttgtctttttagtgaaggcaagtttattagagaagttaacaaaaaatggctactccacaggcagagcaaccaaaaatatttttaagtaataaattaaatttaaaaagaataactgaaactctcatacattgctagtgaaaatgtaaaatggcacagccaattagaaaagtttgtcagtctcacacaaataagacacttatgacctagcaattcttctcctacgtatttacccaagagaaataaaaacatgaacatgaaaacattcaaagatctgtatgcaaatgttcagaacaattatgttcaccatagcccaaaactagaaattcaagtgtccttcaactggtgaatggataaatcgtatcatactaagcaataaaaaggaacaactgccaataaattcaacatagataaatctcaactgtatgatcctaagtgaaaaaagttagacacaaaaaactgtatactatttatatgacattctagaaaagacaaaaacatacagacagaaaacagatcagtgactgccagatgctagaaagggaactgactacaaagaggcatgagagaactttttggaagcatgaaaatgttccctatctatctatctatctacctatttttagaaacagagtctcaatctgtcactcaggctggaatacagtagagtgatcatgactcactgcagcttcgaactcctaggttcaagcagtcctcccatcttagcatccgaagtagctggaactacagacatgtgtcaccacgccaggctatttttttttttcaaagatggggctcaccatgtggcacaggctggtctcaaactcctggtctaaagcaatcctccagcctcagcctcccaaagcattgccattatagatatgagccacagcggccagccctatatctatatcttgattgcagtagtggctacactaatgtatgtatttgtcaaaactcactgaaatgttcacttaaaagagtaaattttattgcatgtaatttatactttattagatattgttatgggatctttagggtgtcacttttctggccagaaacctgtggctggtggcacctctgcctgagttttgctcagacctgctagcctcattcccacccactcggccttgtaggctacactcagctcacgctaccagcctggatcccatgcctccaagaaagactggagtcaggcgtggagtggtgaggggtgtgtaagcgagcgtacagtctggccattgcccagtcagacatgtcagctgctgccacagggtgggcagctccaggtgctggcataagtgccagctctctgcgaggctgtggctggaccagttgcaccacaaacagcttccccggccggcaccggggaatgtagtggcactcagaagcttgaagatgccaggaaccacagggccccaaagaaggagtcacagccctagcttggggagctcccaggtctgggctcccagaagggccacagctcttatctcccttccttcacctgcaacatggtgagcaaggggcatgtttcagctctgcttgtgttagagctcttttaccctcaccattcaagggtcccaagttcttgttctgtgaccaggaagaatgaggtcctcagacaacaaatggagggtgagcaagacaaagaggaactttactgagcaatagaacagctcaaagacccacagtggacagctcttctctgtagcaagggtatcctgatgagtgttcagctcctagcagagagggtagctcctttatgcaggcaggtcaccccagcaagtattttctcagcagtgagagtggctcctctctgcagctggtcatcccaacaggtgttcagctatcagcagagagggcagctcctctctgcagctggttgtcctgctgtctgcagctctcagcagagaggtcctagactagaatgggtggctcctctctgcaggcagattgtcccatcatctcttcagctctcagcagagaggaggccctacagtgggaagctcctctctttaggcaggttgtcccatcatctctgcatctatcagcagagagggtaactcctctctgtaactggttgtcccatcatctctccatcctctgctctgctctgggctgagcctgcaacttttatgggcctcagaggggacaaagtgcacaccaattgtccataggtgggcccagaaaaggtaccacaagtcctcgctctagtccataggactggcagctgggcccccagtcttcaagccctccccggcctgaaggtggggcctcaccagagacctgcccccttccgccatccacgacgcccaggcttctcgcttcaaggggtacctgcaggccagcaccaaacctccctcaaacccctcccacggtgcttgtcagggcccaaagtccagagggggctgaggaggcaggggcccagtgtgtcagcgctgacctaagtgtgtacacacccgggggcgctgtgacagcaccctggcttggccccaaccccgctccgagattggagcaggcgcctccaagcctacaagggcaggagggatgccttccctggcccctgagagtgcaaagaggccttggtccacagccccagcttgggcagctgcagctgtgtggggtgggggggcctcctgctcgtggccccttagaacacagggagaactgggtccacagctctgacttgggtggctgcagcacacccaggagggcggggctgctgcctgctccagccaggtccgtggagtgtgcagccctagccatgccccctcgtagcctggagcaggggctccaggtcctcgctgggcccaggccagtatctagggcagaggtaacatctctacgagctccccctcacccagcttgtggccctgcctaggggggtgcctccaggagcagactgtgggccctgggcccagcccttgggagtgtcaggcctggcaatcaccctgatgcagggtggaccccagggatgcggccctaggcggccctgctcagagcctacccctgaggcacaggaacccggtgccctcggcagggtgggtgtggtgaccacgctgctggctgggtccctgaagcaggcactgctcccacttccggccccagacccccatatcacacctccagctccgcctcctcctcacaccctccccgcagcattggtgggcaagagtggtgacacagggccagggtcaggagctggggaggctccgggcctgagggcaggtcctgcccagaggcacaagggcgggggcagtacagtcggctgcctcagggatgcagggcacaggggacccaccagcatcattgctgctcccatagccgctcctgacaccaccgcccgcacctcttcgctgccatcaacatgacaaaagaagaattatcccaagttaaaaagttatacatttcactgttgacattctacaatttatacaagcttctggattgtattacttaaaaaattaatcttccttctccttcccttttcctgctgtgagaagagcagttgtcatggtacccctggggtggaggtggatccctggggtggagcttgtcatattgtcatagaccaagagagctagggaaggagtctgtgtggtaggggaagaggcaaacattttgcttcagagcccaagcattaaggcaggagggggaaactggcaaagggcactggggtacaacagagtgagaaggatatcttccaatggaagcaactcactggggtgtgtcagagtctgagtggggtacgaagtgtgtccaccgacagtggggagaccaacatgaggagtcataaccagagtgctggggagggtgtccctgtatggaagcatgctggtatggactcttagatccagactggggtagggggatggaggagatggaatgaagaatccaagtcccagcagggagaggagtagatggtagtgaagatgggagactgaacaataagtaaatacattcaggataacagaagccagatttctcactgtcagagaagaacgttacaatatgaaaaaggagaacactagaatagatcctggactatttgactgaaattggaggtatcagtatgaattcatagttttcaatatacagagataataaataaatatagatataaatgcatatgtatgtttatgcatacatacctatacttaccagccctgaccattaacaggacctggaaggagtaacagcccaacagcaataaacacactagccttgagatcttagcttctaaatgtcattctccactaaaaggaaccagggatccctaaatggctgattacagaaccaaggcatggaaagtacaagatgagccaggaacaggttcttgtgccaaaaagtacaaagttgttctcaaagagtgatggggatgtaccataagaacacagaagccagcttgtacaactctcattggccatataaagaacaatttgaacatcaaaataaataatgctatagtctgaatgtgtatgtcccctcccaaaattcgtatgttaaaatcctaacacccaaagtgatggtattatgaggtgaggcctttaggaagtgatcaggtcatggtggtggagtccttgtgaatgggattagttccctttttaaagagaccccagagagctcatttgacccttaagccatatgaggttaaagtgagaacatggctatgaggaagcatgtcctcaccagacactgaatctgtcagagtcttcatcttggatttctctgcctccagactgtgaaaaataaatttctattgtttataagccacccagtttgaggtatttttgttataacagcccgaatggactaaggcaaatagtaacagaatataatccgcgagctcccctttctggtctcacttcggctggatgtgcttagactctcctatttcccactcaagccagtgcttcgggcaggtgggctagtgactttttccgaatagactaaggcaaatagtaacagaatataatccactaaacacacacacacacacacacacacacacacacacacacacagactccatgtagatgtcaataaatgattaagagtttagtgaggaacaagatatttacatagtttcaaagtacatggcaaaaacaattaagtattaactttacagtggagaagcctcgcagatattacttatatcaagtaatcaaagtaaaaataaccaacaatgaaacaaagtgaaattgtgcaccacctgacaggatgcagtgagcatcacttctgtgatatccttcccacgtgcatattcgtatgtatctaatcatgaaggaacagacaatcccaaattgagggggcagcctacaaagtgactgacctgtaattgttaaatatgttaaggtcatgaaagtcaggagaagataaaggaaatgttccagattgagggagacaaaagagacataacatgaatgcaacacatattgctaaactggatccttttgccagtaaagagattactagcacaatcaacaaaacttgaaccagtctgagaactagatggagtactgtatcacaatccatttcctgttttggttattacactgtgatcatgtaggagaacattcttgtttgcagaaaatgcacattaaagtattctgggatgacagggcatcaggtcaacagcttcctctcaaattgttggggggcgggtagaattttttgtaccattcttgcaacttttttgcaagtctgttattgtttcaacattgttggccgggcgtggtggctcaagcctgtaatcccagcactttgggaggccgaggccggtggatcacgagatcaggagttcaagaccagcctggccaggatggtgaaatcccgtctctactacaaatacaaaaattagcgggcgtgttggcgggcgcctgtaaatcccagctactccggaggctgaggcagagaattgcttcaacccgggagacagaggttgcagtgagccaagatcgcaccactgcactccagcgtgggcaacagagcaaaactccgtctcaaaaaaaaaaaaaaaaaaaattgtttaaaagtggggagggggggaggcggaacaatgtcactaaaaactaaaggttaaaaaactgatttcccacacttaatcttgatagaaaagaaacatcagactatgccaaattactaggaaataaaattttggatccagaagtttaaacatttaaactttctctttaacaattgacctcaatcaggtcatgactggtgaaagagaaaagaacatgaaaggttcccactaaaggagaggaagttcttaggagaggaataatgaaagagagagtggaccaagagtgggtagaacaatggtattctgagctaccaatggctgtaaccatcaggaaaacacaatctcagcatctctgaaaaatgaaggggctgtagagctgatatctcaaattccttgcaaatgtgggactagaattgccctaaaatagaagtggtttcccagctcaatttgttattacattatgcttagctacatagtaatacaagagaatacaaatacagaaataaacgtgcatgaaccctgaattctcttaagttgtggaagtccgtcaattaaagtgtaaaatacaatgcatttgcccaattgttccttacgacgaaaattctgtgacaaataaaaagaacaatgaaaacacattaaagtgaaacaagatcaccttcagcggtcagctggctgtccttagttaaaagacaagtcatgtcactgtgaagtgaccgtcacatttgtcctgaaagaatagggagcatttcctagaaaggggtaaaagtgcaaagaatcctgtccccttccctggtaccacgcgttccttggggaggtcactaggcccccaacagcacaggggtgagttagcactggactctcagcacttcctttcggagaggacaaccccctgcgtcactggttactcactcaggatgcagggcagaagtttatccccgaggaacttagcacagttggctcccgccctcccagccttgcggtcctgggcccaatctcagggctctctctgccccgggtaccctgcagcctccagcgggagggtcgcgagaccccaactcgcctccggcccgcccagcgggtgcgcccaggggctgggcagacgcggcgtcttccctccccctaccgtcgtgccggcccccccacgcccaccgccaggctcagcccagccgagaaggccggacgccgaccgcccgctcctccgagactcggcctggccctccccgacgcccgtccccgacgcccggccccgcggagcccactggacagcggccggggggcggggaggcccgggggcggtgccgccccacacccttacctggcttctcgtggtcatagcctaccacgatgaagtagtcagccagccgggccatggccgccgccgccgcgctcgggaagcgggtccccgtcgccgccctcgccgccgccgcccacccggcccgggagggctcagcattttccctgcagcggcagtagcggcagcggcagcgcttcagccatgtttgacaaccgaggcgcgctctgcgcttgcgcggcgcctagtgcccgctcctcccccgcccccacccgcgctggctcggctgccccaagcccgggcggcgagcccacctccaccctccgcgggcctcgcggactgctgcgctgggggagtgggcggtcgggcgtgttcccgccacgcgccgccaccgcggcccctggaggtggttcactttgaggcctggatgctgcttcacggccccctctgcctccctatttttcctaaagcagggggtccttccttccgccttctctattctgtttggatttggaagaagggatgtggagagttgaggggtcacttggaaagctggctgcttcctctgctccccaccaccaccaaagatgaaattctcccgccctcggttggaagcaaggaatttgcatcgacagggcttttgctgcacgtttcctgtttatgttgtgtagatgggaattttagaaacatgccaccgagcagacgggggagggagaggcttttacgcaatcctccaaggagcctcgggtttcaatgccgggtgggccgggggcggtcggcctgggcttcccccggagcgcccgggagagccagattccaccgaggaacgcggcatccccgggatcctcccgaactgggctggcctctccctggggagccccgcacgcctcggcttgcttccctcgcagcggtcccagggctctcgcagcccgagcaggtggacttccaacttccctgctcaaacatgcacaaaaatgaatagatggtcccgtccttccgtctcgggattatcaaagtcgcttgcttttttgttgaacctcctattgaccatttcgaatttggctggtgtgacattcaggtgaactcactttgtcatttgttaatatctcacgaagttttagtagaatttgtacaagtggtagaccaaagttttggaaatctccgtggtttagaagttgtctttgtggttgcttatcactgctcactattaattgagggtttgatccttcatatttacacataagacaaggcctcttagcaaagcgtctagtatatagtaggtgcctacaaaatattttaaatgagtaaatgtgcgattttccccaacgaccagcaggaagccgcaatggctccaactctgaactgagagagttgacatctcagctcctgaagatttactctgctgtaatttactatttcccctttctctgccacacttgtttcatctacaaattgggagggttgggctgcactagaactgaaactgaaggaatactttaactccaggacctctatgtcagttgctaatggtaaaactgaatcagctgaatttgcaaacgtggagggaagatagtttgatcctgaaaataattaaaccaaaaaaaaaaaaacctcagtcataccccgtgcagcaatcctctctgtaacttccctgagagctcatcatccaacttgatcactttcagtaaaaagtaatcttacttccttgggaggcagcgcattccactgtttaacagccctattgttagaaagttcttccttattatttcagagttgtcttactgtaacttcccctgattctgctctccggaactatccagaaaaaaaaaatctatcttcatatgatagatttttaaggcagctatcatattccttcccaacttttctaaaaatagggcaaaattcacatattgtaaaattagccacttgaaaatgtagaattcagtggcaattaagtacattcccaatgctgtacaactaccatgtctatctagttacaaaacattttcatcacccaaaagaaaacctcacaaccattaagcagtcattctcattctcccctcccacagcccctggcaatcaccattttgctttctgtctctatggatttacctattatgaatatttcatattcatatcatacaatatgtgggttttttgtgtcttggtttttctcacttagtatattgttctcagcttgtttacgggcagatacagtacaaggttgtagcatcacattgaagtatcaatacttcattattttttatgactcaataatattccattgtatattgtgttagactgttctcacggtgctaataaagacatacccgagactaggtaatttataaagagaagaggtttaattgactcacagttccacatggcggaaggcaaggagagcaaagcggcagacaagagagcttatgcagaactctcctttataccatcaaatctcataaaacttattcactatcaccacaacagcaggagaaagacccgcccccatgattcaattaccttccaccggatccctcccatgacaggtgggaattatggggtacaattcaagatgaaatttgggtgaggacacagccaaaccatatcatatgtatataccatattttgtttatctggaacaacccatatggacatatgggttgtttccaccttttggcattgtgaatagtgctgcttcaaacatgcatgtacatgtatttgagtacctgttttcaattttggggatatattcttgggattggaattactggattaagtagttctgttactactgttttccacagtggctgcatcattttacattttcaccagcaatgcactagggttctgatttctctgcatctttgtcaactcttgttttcctgttgtttatgttttgttatagctatcttagtgtgaagtgatatctcattgtggtcctgttttgcctttccctaaagactaatgatgttgaggatcttttcatgtgtttattggccattgctaaatcttctttggagaaatgtctattcaagtcctttgcccattttttaattgattctttgtctttttgaggttgagttgtaagagttctttatatattctggatactagtccttgtcagatatatgatttgcagatattttcccattctgtacgttgtcttttcattttctttttaaaattgttatgccctattcccccccccaaatatttcctatttttattttatttttcattttatttttatgtagagatgttgtatcatgatgttgcccaggctggtcttaacctcctgtcctcaggcaatcctcccacctagccctcccaaggtactaggattagaggcatgagcttccacacccagacttcattttcttgataatgtcctttggctcaaaaaagtttttaattttgataaagtccacttttttagtttgtttctatgcttttagtgttatatctaaaaaattattgccatattaaaggtgagatgaagatttactggtttccttcatagttttagctctttagtactttgacccattttgagttaattttgtagtggtaaggggtcttgttttaccttttaaatgtcttggcttttatttcatttgcaagtactcatttaaattattttaattttttaaaatcaaagtttattgtttttaagcctagaatcaaatgctattctgcttttaggcatatttcatctgttactgtcataagtagacttccagtccatttgcaaatgcccattttgtcacacagagattttaacatatcctaggtacatgtagaaaggcactgtgtgtttgtatatacatgtgaacatattttgtatacactaaagctgtgctttgcttctcagccaacagctgccagcctgttgaaactgataagccctgacaaggcagcctgattactgaggttggctgaaagccagaccatcccctacaataaccaccatcacctttcaccaaagagagagagagtaaagcaagcccagatttgttttcctgaaggctgatgggagcaggaagggaagaagggtatgtaacactatcatgatgtgtatgtggcagatacctttcttttttgctttagaagacgaaatagatggaatgcggtggctcacacctgtaatcccagcactttgggaggccgaggcaggtggatcacctaaggtcaggagttcaagaccagcctgaccaacatggtgaaaccctgtctctactaaaaacacaaaaattagctgggcatggtggcaggtgcctgtaatcccagctacttgggaggctgaggcaagagaattgcttgaacccaggaggcagaggttgcagtgagccaagatcgcgccattgcactccagcctgggcaacaagagtgaaactcccgttcaaaaaattaaaataaaaaattttaaaaaagacaaaatagagctaattatcagtgagcaaggcttatcagcccattgcccctagtgggctattgcggagtaagtggtttgatctgtacagtcatttcaagtgcttgctgtggttagccacagtagttcaaggaggcagtatgagagtcagacttgagcaaacatcaccaggcagggctgaggcctcttcagatcgtctctaccaaagcataacaaaggagactatgcagctgtggtggaaaattccctgatccattgctatattttcaaccatttagttccctaagcaagaaatttaatgaatcttacccttgacagctgcctctcagccccacattcatcactcagtcctattgttcctacttcccaaatatgtccgcttctctccaccctcactgccaccccactagtttgagccgttatcaccttctacctttattattgcaataggttcttaactgttttcccagcttcaccgatggtttcaaactttctatataggtaaaagttaaggacagtaagcaggttattgaacctgtctcaaaattaaatttgtatagcaaacacaccatttctaccttgagtgtgtgtttggggtgcaaagaaaaggcttcatagatgacgtagaaagtgtcctggccaggtgtggtggctcacgcctgtaatcgcagcactttgggaggccaagttgggcggatcatgaggtcagcagatcgagatcatcctggctaacacggtgaaaccctgtctctactaaaaatacaaaaaattagccaggagtggtggcgggcacctgtagtcccagctactcaggaggctgaggcaaaagaatggcgtgaacccaggaggcagagcttgcagtgggtcgagatggcaccactgcactccagcctgggcaacagagcaagagtccatctcaaaaaaaaaaaaaaaaaaaaaggaagtgtcctgcagttgcggtccatgtgtgatgagatgaatggttgaatcttaacattcatttgaagtacccctgacattagcagctacagtatatataggtactgtaagagtttacaagctacttttacttagatcacatgtttgatgagcaggactggctacataatatgtggagtccagtgcaaaatgaaaatgtaggactgcctgttcagaaatgttggagaatttcaaaacagcttcagcagagcattccaccaagtgtgggctcttctgagagcaggccgtgtgctactgaacagagtgtatgtcagtgaagctggtgaactttaggatggaatgagtatgtgtatgtggggagggggtataataaatgttatggggggactagactctctgcagtctctccagagtaccaccaccgtgctgcttcctttcttgcacctttctaatctatctaccacattccatagccaaaacgattgtttaaataaatgtatatcagatcatgtctctcctgtcttcaaacctgtcaatagttttccatgtcaccataaataaagtgcaaaatcttcatgtcggaaagggtcctatttactctgaccctgatgacctctttaatctcatttcaggcctcttttctctatcattctatgcattcctatcaaacaggactcctttcattttttctaatgtaccaagttctttcccatctctgagtgtttgcacatgctgtttcctccatttcgaatattagatccccctagtcttgctttttcttcagaatacttaacacagtttataatcatgtaaatacataattctgataaggatttgtttatatctggctacgtcactaggctgtaagctcgttgagggtaagtttgttgatgactgcattggtgattactgtatgttgagaacttagcacagtgctgggtatataatatataatcagtaaatatttgttgaaagaatgaaaaaactatcaattcattcaggcttataaatcagaattgcttcttggctgagcacagtggctcatacctgtaatcctagcactttggtaggccaaggcgagtggatctcttgagatcaggagttcaagaccagcgtgggcaacatgatgaaaccacatctctataaaaagaaaaaaatatatataaatatatatacatatataaaataattgcttctttccaggtgcttctaatctgatatcacaggatccctatctggagacaagtagcatgatggttgctttcattaacaccattctctttggctatggatgattcaaatggcctaatcatctcttttatcatccattcattaatgccatttattgtgccctctgtagcaaatttctcttgaagtaatttcattttgtcctgttacaggtattattgtaacaagcttctttaggtttactactttctcttctctctctctctttttttttttttttctttgtagggatggatttttgccatgttgccaggctggtcttgaactcctgagctcaagagatccacttgcctcagcctcccaaagtgctaggattacaggcacgagccactgtactggaccatctcttctctttcatttgttctgcagtaatttaccttatttaagcttcagggaggtttgccttctggctttaccatgtacaagaactgactgttactctctgcctgttttgtacaggagcacaaaaatgaggcagcaaacgcattacttttctttatgctgatgctctggaaaatattatgccctaaagagggaggttaactgtcctccttgcccttaccactataaaccagacagaaatttaaaatatggaaacagtgttttttattctgtgtcagggttttaaacttggtcaacctcccggaactgtatgcctattttatactttaatcggtttatgtacatgttcatttttctggaaaggatctatatttttattaggtccttagagaagtcagagatcccaaaaaagtgccctgggctttgtatcctgctttacttctccttgtaagtgatcaaatccacaaggctgattgtgttctttctctaaatcactttgtgttatgacttcaggatgcatcttgaactttgttttcaagtgaactttgtaaacaagtcctcagcttaaaagacattttgaactatattaataataaatgcatcataaaatttcctgtttgataaaggaggcatctgagataattatgcaatgcacttagctactcacattttagttattcttattaatatcattgatatttattatttttcaatgcttctctgaaagacctgagtatggccactctggctttaagaactgtgtccacagtgctagctgagaaaccactaccacatatttttttaaactccaaactttactaagaatcaggcttggatatagggcctaaaaatcattcaattggaatgtgaagaagttgaaacaccattacgcaaaaaccctttagcatatgtgtatgtgtgtctccctaatgtcaggatgtacacatttattacagtggtttggaggtttatttgtaatctgaccttttgaaattctggagcacacaaaaaaagtagatcttcattaacaaggatttttttttctttttcttttctcttttcttgccagaaatttaaagatgtttcttccttcacttccttccttccttgtactgtccttgctcaacgtgaatctacaatcactgccacttgaatggatgcaacttatgttaataaattgccaggatcagaactcccactgcagcatttccttctccatagaaccactgaaccagaaatgcattctagtgatttttttttgtcgttaacgatgattaattaaacaaactcgagatttcacgagaaaaaacatagatgcccagatttaacaaactccttatcttttttcgacttaaacccacgaagctttggggagcactctagcccctgctactcacccatgcaagcggggtgcgcgctcgcgcacacactcactcactccaagataggggctttctaggaaaatactttgagctgccaatccaagattttacttaaagaattgacttggttctcaagtgacagatctctaagtgccagagcggcaaagtgcaccaggctgataaagtgcatgccaagactctcaggtgggaattcttgtcacagccaagaggttgctggcataggcacccgaggctggcagagcctagcctctgagtctccctacactcctgggcttgctttcctttttgaagctgcctgcagctcaaagaggagtttgaaccaagggcacttgcttcgcgatcctcctggcagagccacagctcaagtttcccccacggaatcacgagcttttgtaaagggcagcgaggaggcagcgaggtggcagcgaggtacagtcgcagagttctctggagaacgaacacccccgccgcgccccaccccccaggactggtggagactggaaggaacgagtccagaccacgggaccttccctggccgtgggccgacgcctagctgtccttgacctccccagcagtcggaggcgcgcgcgggagaaatgaaagtaaaacctgtcctggcgcggaaccaagtggaagctggcgacaagtaggtcgcatcctcagagcgactgatagccagtcctggatctgcgcgaagagcttgactcgcagaggataaagtgaaaggaaaaggaaatgggagacaagggagaagaacaatagttaggctggggaggctcctggtcaccgagcaggcgttcagtaatagctgctgtctgcggtgcagacggactagtcgcccggccaggccacttcggtgactgccctgcgcccagccgggcggccggatccagaccagtgcgccgcgctgcactcctctaaccctccgcgtcccaaccccttaccagggccagggtcagggcccggaatctgtcctccgtcctcagatggaattcaggtccgctcaggtgactccttccaggaagagtccttaaataacttccgcgcggccatttcttccccaggtgcaatgtccactgttgagtcccgagagtgaaaaggcagctaagccagcagtgcgcggcccagacagaccactctgggcaaggtccgcgcgacccactgcccagccgcctttgcaccggagctcagagccatatggcagagtaggaaggaagcttaaaggtctgctggggaccggctctaagatggggactcgagagatgggacatgactcgcccaccttcacacagcgaattgccgggaggtgaggactagaagcctgtttggctagtggtctcgcacctttggcctctccgtcgagtcgctgggcttcaggacattcgattagaggagtggttagtaggaccccagaaacccacaagcacgaagcaggaagccccgtggcttagcctttccttcccagtttggcccccaggagagaagtaagaaagagaagaagctgtgatgaaagagcacaaacgggtgacaaacgtgtctagcgtgattcatcatgaacaggcacaaattctttgggcgggggctaggactctcctttgccccttgagaagttggtgaccccagcctagaggaatccacgccgcgccccagtcggccgtgctagcgtgtcgggccgagtagggactctgctgcttcctacctgcagggtgacttcccctctctgcagatacctcccctctctgagcttgaattttctacctgctgaaatgggaaaaggaatgttaccttccttgcctgactcaagggtggctgtgaagctcaaagtagactgggatgtggccgtgcttggtaaactgtaaaatgattagcatacgtgaagcgttagtgtgctccctggcagtcagtcctcacgtttacgatggattaatgaaggcagccaggcacaatctcaggttatgaccttataaggcataataggattacaaggaggcaaaatgaaacagtatatttcctcctaattttggttattcctatgtttccaaatagaaatgaaaattctgaaatttcagataattcccccctccaaatcccaattctcaatttagcttttctgagccttgtccctaccgtgaaatcttactagctcaccccgaaacgccggggtcttggtcctctgggggactagtgagtcctgctcctctcggctttgctccgtccctgccccggcccctccgcgggagtctggggtcgcggcccggtcaggcgccaagccggcaggggggcgcggtccacttgaggccacagctccccaggtccagggctcgggccatccgcgctgtcccttccgcgggctcttgctgttcttcgccaggaggctttgcactccgggccgcatgggtcctggataaggacctcaagaggttgtagtggcgccccttcgctccggcgtactgtctgaaccctgtgcccaaagagggctgtggcagttcctgcaccaaccgcctggagcccatacctaagccctctgggcacgagggacctcctctcccccgctcccccctccccccatcccaactccagccccaaaggaagcaatgcgcgcgtccgagagcaggagcgcgcgtggctgaggaaagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcaggtaggtgccgcagaccctgcgggttaagaggtggggtggggggcagtgcttgccaaggccctaaactgggagcgctgggtgaggggaacaacccactttggagggttctctgagagatagatacaccccatatcctgggcccagctcgtgcacacagctggaggtccagagacccagtcccctctgctccgtcagccaagttccaagaagttgagcagagaccctctgggagcctggcggggtgcagcggcctcccctgcggggcctgtcacccggccggcgcgtgcaaacgcctctggcgcctctctgcgcggagggagataagcgtctgagccagggaaagcgcgggctaaacccgcctcgccggggcccctgcccgccctccgtgccccgcccgggcggtgcagctggcccgggtgctcacgctcgactctctttcttcttttccagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgattcattctctcggctcggctctcacgtctaggaagggagggtgccctggtcccggcccgcccaggagccttggggtcccgccgccgggcttgggaaggtgggacagcggcgcgtgcaggtgctggccctactctgagcgggctgagctgtcacgagctctgttctctgtgtggggcgcgcagaacacgtgtcctgggtgcgaatcagggcttcgcggagacgcccgaggtcaccgcctggcgtggcggccggcggggggtgggtagggggagccctagtgggttggcgagcctggactctcgggttgcgcaacggagtcctagatttatagggttgctcacagaacccggcgcgaaagcgagcttcgaagagttggggtggtctctgaggccttctaagagaggcgttccccctgcctgccgcggttgttaaagttccaagccgccctagcaatgcgtggggacacctccggaaaacccagtaacccctagtaaccccgggtctgcccgggcctgagcgcccgcgggccgctggctcatgggcgaggctgtagcgccccctgcaggcagctgagacaggcccagcgccgccaagcagtacgtgcggtttaataagttctcctacgtgggagtcagcacacagccttaatgaaagaggaaagaaagaaaaaaaaaaagagagaaagaaacagtttgcagatgccaaccagggccgtcctcctacaccccccagacctgcaccgcggctccctgttctgggacagtgactcagcgcccacacgctgcgctgcgtgcagctgccggctggaggcgggcaggacggacgtgccggcggaaccgtgagcctccgacggcctgagaccttcattgttccgcctcccctagccgctcacctcttccttcctccttcccaagccttttttcatttttttcttcacttttctccagccttcctctctctctctccttccttcctccttgctttctttatatgccttatcttctgagaaggttgaccccagttccggcgatagacggacactaagccccccttgagtgactagaaaggcaggggacataggaacagttaggacataagggaagagtaaagagagggacccctgattttgatttcagggtgccctgtttgtctcatccaatatcctgaagacccaagatggagaccagctacttgtcccttccaaaaagcttccctggccttaatgtcagtgcttgtaggtgatctcagaaacctccctggtgaagaaaacctgaaggtgagtttggagaatggaaatgtttccagggtagcctacggccttctggggcttttgcacattacagggtcccctccgaggggctaggatgtttagtttcttgcagaagaggactgcatacccactgagagagaggggccctactctggggtccagagatacctcattccaaagcagtttcaatttagaagaaagtaaactcgagtacatagaatttccttaagaccatacaaaacctcagtttgggcacctggctgttgacaatgccaatctcatatagtttattgtcctgtttgatcttaataattgtgtgaggtgtgccagaattgaggaggttagaaatgcagctacagaccattcttgtcctcaagggcctttcagaaaaagattcactttgtgggaactctgtgccaggcactgagaaggtaccaggcatgtatgaatgaaagagtgactcaagattcctgtcatggaatttctgtgccagtgagtgggttctgggtggtctgaaggggctacagaaactgcagagagcagcaaacacttaagcctcgcagacagtggcgcaagattactcctttccttgagccaaggttgtcctgtagccacaaagcactccagccaaacctcaccttggcacagcgtcagccagcaaacaaagctgccaaaggcaggttgggcacaagcttcgggcggttgtgagcagggaacaggcgtctagccttgtgctgaggaagtcttatgacttgagggaatccaaggcaagtgaaggagatggttcagccctaagacaaaagaggcagctgctcagctggagtccttcccgctgagaatcctgtgactggagacatgtgcgaggagacagagaccctcctaagaccagtttggtatgagttcaggattaaccaaaggtcaccatcaaaccccgggctcttctctttgaggtgctgaagcttatcaggatagggactattgatgccaagaacacattgtttatcaacagtgatgagtcatttgtgagctgattcgacctgtccacagctgaggagtagtcacagcttttatctttagctactgttgcttgctgtgggaatgataccatacatttgtaatcaaacacggggtatcaggcaatttcttgaaaagccaacaccttggctgaacagccaagggtgaaggggagtgatggggaggaatggaaacagattccttttttagcacttgcttggtgtcagatattctctttgccactttatacaccttatctcatttaattcttacaacagccttgtgaagtaggtgttatctgtttattgataaggaaacaacctcagagacataaagtaactcagccaaggttacacagtgaataataagcggtggagcctggatttgtacccaaatgctacaggctattttgatcctctaaaggcatatggagtaaagtgggataattttaacgtttagattctccagccaaatgtccccaaatgtcctctaaaacagggatagcttgtataggtgattcacacctgtggttctgaaagatttacatgagggctggtagaatagggaaggagagctgcttcaagcagtaagctcaatgagtgcaaaataaataaatgaactgagttttaaattcttggtcttggtttgaagaagggattataaatcaacctttttcctctcctgagctaagccactgacctctttggtttgaattgccaaatatagttaaaatatacactgaagcttcaagagctggtttcgggggggaaggccttctgagctattcctggccaaatacagccccacactgtaggtcttaagtcgcctggaagaacacctgtgtctacaaaactgcaaatagagtttccacccttgaggtgggatcttttgtcttggcaactgctgctcaaggcacctttttagaggatgttctgaactgactcagagagagagagagagagagagacagagagagagagagagagagagagagagagagcgctatgacataaggcccctcctttccccagctgagaaggagaaggccttgttatcctgagtctcacagaggtttctgccaaagccaggctggaggcttggtcttcatgtgcatgggaagaagggtgaggctagatagctatctggtggtcccactggtcttgttccagagctattttggaacattctggaaaaacaataaaatgactgtggccacacaggcagctgaatttagtaggtttttgtacatttatccaacattaggaaagtagttttgagtattaagatacaattttagagcataaaaaatgcattttacttatttacaatatttattcagtgtagaagaaaaagattcacctgcaatactactttcagagataaccactattaatattttagacattttaatcttttatttatttatttatttttttagagacagggttttgctcagttgcccaggctggagtgcagtggtttgatcaagctcactgcctcagactcccaggcccaagcaatcctcctgcctcagcctcctgagtaggggtgactataggcatgatgcctggctaacttccttttagacatttttatgtattatacctatacacactttaaaaaattgaattcagtggagagagctgaattaaacctactcagtttaaggcaaattgtcattaccaatctgcgcaaggcttctctctttttaaaattattttattttttcttctttaatttccatatcccttcacatctcctttataggaacctctttaatgtgtttgatatctgtgcttattatagtacgcaatcttgtaaaatctgctgtgttatttcacaactttacatgtttttaacctgcaaacacattgtgttaaaatatttattgtttcctaatctcactcaacactttaaaaaaattatccaggtagatttgtttcctcttactgctgaatattacttattttatggatctgccacattttacttttcttgtcttttaatgagggacacttgggttgcccccagtaaccctctgccacaaacaatatgtaaattaaccttccatttcatgtcctcttatgggtctaaatggaaatttcttggagatatatacccagaaatggcatcatttagttaaaaggcttctacatacagattacgctaaattgtatgagattgctttccaaaatgcctgtaccagtattcatttccaccagcagtacctgagagttctcatctccccatgtcattgcaatatttgtatgtatgatggttaatttcatatgtcaacttgactgggctaagggatgcccagatagatggtaaaaaattatttctgggtatgtctgtgaggatgtctccagaggagattagctttggaaccggtagactgagtaaagaagctctctcaccaatgtggacaggcattatctaatctgttgagacctggaatagaacaaaaaaggcaggggaagggcaaattctccctctgttttcttgtgctgggacatccatcttctcctgcccttggacatcagacctcttggttcttgaggtttccaacttacaccagtggcctcactccatactgagactgggagttataccatcagtttccccggttttcagtcctttggactcggactgaattacacccccagttttcctggttctccagtttgcagacggcatatcttgagacttaccagcatccataattgcataagccagttcccataataaacaaaccaacaaatctatacatatcctactgattgtgtttctctagaaaaccctgagaaatatagcatggattgtcttctgatgtttgccatgctgatgggtataaaagtaatattgttttactttccattactggttgctggtgaattttggcatatcttcatttatttattggtcatttgaacttttcctagtgggctacacaattaaaaagaagtgagatcatatttgtccatgatctgctgatgtgttttttttttttttttacttctcagtatatttgggcatcttttgatgccaataaatatatctatgcaacatcattttaatatcctgcacagtatttcattttattaaaatgaaatgaaacaaattatgaaacaaatcataatttgtttaaccattctttgctgttggatgttaaggttattttggttttggggtgtgtgtgtgtgtgtgtgtgtgtgtgtttctcactctgtcccaggttggagtgcagtggcacaatcatagcttactgtaacctgaatacccgggcccgaccaatccttctgactcagcctcttgagtagctgggactacaggtgtgcaccaccatgcccagctaattttaaaaatattttgtagactggggtctcactatgttgcccaggctggtcttgaactcctggcctcaagtgatcctcctgtcttggcctcccaaagtgttgggattacaggcatgagccactactcctggctgagtgctaagattttccctctgtgtttttaccattaaaaatggccccaatatagctgggtgctgtggcttgcacctgtattcccagctacaaggaggccgaggtgggaggatcacttgaagccaggagttcgagaccagcttgggcaacatagggggatcccatctctaaacaattttttaaagccctcaatgaacatttttatgtgcattcaactcatctttgagtaatttaatgactattttttaggataaattattacaaataaaattattgggtcattgggtctgtactcttttttgttaaagcatttgagccagattgccttctggaaggatcaatttttacttctactaacagtataaaaaagtcaatttctggccaggtgcagtggctcatgcctgtaatctcagcactgtgggaggccaagatgggtggatcacctgaggtcaggagttcgagaccagcctgaccaacatggtgaaaccccgtctctactaaaaatacaaaaaattagccgagtgtggtggcaggtgcctgtagtctcaactactcaggaggctggggcaggagaatcgcttgaacctgggaggcagaggttgcagtgagccacgattgcgccattgcactccagcctgagtgacaagagtgaaactctgtctcaaaaaaaaaaaaaaagtcaatttcctatttcctttgaaacactgaacattattcttcttttcaattaataatattatgtcatgtaataggtaaacatggtgtttcctattgctctttaaaaagttttattcttttctcatgtttttgagactgtattttatatccttaataatttaaaacatttagtttatagtttcgttctaataactctgctacctttatctgctgactcttattcattgtgatgtatttcttcctatttcctgtaatttggggttccgagctcatcttattaaagcttagttgatggtaattctgtgtggactgggttgagtcccttcagagagatttatgtttgcttctgccaattgtcccaaggttattacccatctgagaccattctttatattaatttcttaattttatgtttatgaaccacgcaaaagtgcatctgtgctggtgatgtggggtgtagcattttgagagtccttggatttacttgagtatctcagttccttttcttctgtccctaaacaaatctctgttaccaaagggaggaaaccccttccgcaaagcccaggcaactgcttttcagctcaagttttctactctggattttagttaccttggtttagttttctgtggctttcctgtattttcatggggttcagctatgcatttaaaaggatattaagtgtattttacttagcatttctagatgttttatagtagcaggattttcaacttagtctgctatatcaccagaaagaggaatcagcattgtttaaaaaacaaaactttagacaaattaaatttaacatagtttaactgcgtaaagaaggattcatgaatcaggcagcccccgagagccagagtaagttcagagcatctctggtgctgccacgtggttggagaggatttatggacagaaaaacaaaagtgacattgagaaaatggaagtgagggacagaaacagccagactggttacagctctgtgtctgcctttttaaaacaaggtttaaacacttagcaacctgtgagtagttgaagtatggcttctgtgattggctgagacttggctgcttgttgcaagagtaggttacagtgtgttttcacatcgttaggttaccgttcactacgtatgcaaaaagcttttggccaaacttaaaatatttaaggaagcagatttagactaaatttaatttaacagcatcaactcttctcactactttaacttatttccatgattattagtgtagcttgagtatttttgatgtcttcatgatcatttatatttccccttatatatatattattattgtttatttatttacttatttattttatttattattaacagacagggtctcgctttgtcacccaggctggagtgcagtggcatgatcatagctcattgcagcctccagcttctgggttcaagtgatcctcctgcctcagcctcctgaatagctatgactataggcgtgtaccaccctggttaatgtttaaatgttttgtagagaggaggtctcactatgttgcccaggctggtcttgaactcctgggctcgagtggttctcctgcctcgaccttccaaagtgccggaattataggactgtaattataggattataaatgagctaccacgccctgccattttttttttgagttcttgattcattcattctgttggaatatttgtttttttcctgttgatctgaaatactttaatattcttattgattaagaatactaaagttttgtcacatagagacacaccttttttctttttgtagagagagtgtggcttattttttgccatataaaacttataaatatttatataatcaaagataccgatgttttcctttataatttctgtctttactggcttgcttacgaagtctttctctgcctcaatattttagaatagccatctctttttttctaatatttttatgattttgttttatactttaaacattttattttatttatttttttgagacaaggtctcactctgttgcccaggctggagtgcagtggcgtgattgtggctcactgtagcctcgacctcctgggctcaggtgatcctctcacctcagcctccctagtagctgggactacaggtgcacaccaccacgcctggctaatttttaaattttttgtagagatggggtttcaccatattatccaggctaaacattttaaagcaaatggaatttattttggcatctgatgaggtagggatttaacttttattttcccctaaattgttagccaattgtccagtatttatactgagtaatgcatattttctgtaggacctgagggtcttccttcatcatatgcaccagaggtttttaaactgtgttccacagagagttttcctgagttacttctgaagttttctggggagaaaaaggggaagaaaaaaatgctagtctctctctccagcttctagtggaacatctctattccttttttgttttattcctttttgttggtgctcctcgtcagattttatttgaagattttatttgaagaaagaattcatcttcctgcaaatcagtaatataataattcttaaatagtaaatatttaaatttgtttctggcccttttaatctcttccattgctcagtctgtctttttctgcaccagttttacaacttaaaaaattatgaaagctttcaaacgcacaaaaacagagaaataataatataatgaccccccatatgctcatcattaaaattcaataattatcatgatattgccacatttgattcatctatccttttttcttttttgtttttaaaaaatttttttgccaaagtatgttttttcttttctttcctgcctatccttctcttttctcttcttcctctttcttttcttcttttcttaataactttttccttttcttcaattttcttttgtccagtcatcctatcatatcacccacacatacttcagtatgcatctgttttaaaaaaatgaaaataatgttttcttatgtagccaaaatgctattgtcacacttaacattaaaaataattctgcagtatcatctcatagccaggccataatcaactttgcccgattgcctcaaaaaatgtcttttgacaatggtttgttcaaaatagaatccagacaaatttgttctatctctagtgtttctttaatctagagcaagctcctcccaccttttgtttttggccattggcttgttaaagaaaacaatgatttaataattgtgatttagaactgttattatcaagaaaaatcttggttctcctcttcactctgcctgtgtggactcagccagaacatcctggcctgctcacttgtgggggcttgcctgaggggaggtgtggagtggccagtgttgcagtatttcttacatagagaaagggtatcttgaaatgttattgttcatgcttttctttgctacactttttccacttgaccttttccctagtaaatcagaggcattgccttgaggagaattaggattggtacaaccggaatgctaacagaaagaaacagtcagaatgaaacagtaaatgttcagttttctgactttaaaatagcctcttgaagcccacatcaaaaacaatagttttgaaagccaaagccttttgtttgcagagaaccaggttttgttgagagaagaaaaggctcttgagaatcaaaagggaaggcccggaagcatcagggattgggctttacccacactggaaagagactagagggagagctggactaagccgccttcatcctgggcggggggagagcagggacctatgaggttgcagggaggccttgggaaagagcccacagagaggaggacatcagcatggagagactgcagatcagtcccagcaaacctgtggaggccagttaaatgcctggagctcatcccctgccattcaagtgagtcccactgttgcctgagccaaagagccatgttagttgctctttttactactgctggagatctttcatcaatagcagcctgcaagtcacgctcagatggcccagcagatgtgatacttgcctaagtctggagtcattgctgaaccttaccctacccacattgccctacatggcagaggacactaataagccacccccaacttcttagaccaaagggcagagcaattaacaccaaaggggtgctagagctgaaggaagagtcacccacccctgtgtttgggagggactggactctggggaggcgtactccactacattcacaagtcacagatgcgggggaatcccccagccttgttttgctcctatgttcagctagttggtaaccttttgtctcaatttaataggtttgttccaccagatagagcagtgatccttaacctcttctgcctattaaagtcatgtgggggaagcttcaaaaaaaaaaaaaaaactgacaccgagccttatccctaaccaattgaactggattgtctgtgggtggggcctgatgtcattgtgtgattgtgagtaacattttatctttgtgaagccacttaactttgttcggcctacacattgtccccatacagctatttcaaaaatgcaccctggtggtgctaacagactgagaccaacagtttatttatttattcatttgttgtagattgagggttgtttccagtcaaacagccagaaatagaagggttaactgcagccagtggggcaggtgtttggagagaagacaagctgcaggtgatgggaaggaggccagccccagccgagggcagagtaacagacaacaggtggttgtgctgtagggtgttggcatcaaggaggaacagcaggaaatgacagggcatcaggcatgtcagggagcacagcagcgcgcattctaggagcaaactataggcaggcccaagagaggtccagctggaggcagcagacaggactggaattattccttctgatgggcctgattgtgtcccctatccccatacaccaaattcatatgctaaacccctaaccctcagtacctcagaatgtgactgtgtttggagatagggcctttaaagaggaaatcaaggaaaaataaggtcatatgtgtggtcctcaatctaatatgacttgcgtctttataagaagactatgggaggacacagagagaaggcagccacgtgccagacaactagagaggttcccaaagaaaccaaacctgctgactccttgtccttggatttccagcttccagaagtatgggaaaataaatgtctgctgtttaagccacagtctgtggtattttgttatgacggtcctcacaaatgaatgtacttctgtcaaagggattgatgagaacaggaccaggcgacaggcctagaaacgtggtatcgtggctggatttcagcaccagacacgcaacaagagttagggaatcaggacagggtaactgagtcagggcaaacaggatttcatttactcattcaatcaatgatattttagatcaacagtctactccacgcagggccctgttctagacactgggtagcctgccattgcagcagtccagataaaaaaattatgttcatttagattaggagaatgtcagtggctagggtgatctgacactcaaacaacccaatgtggagatgatgtcctttaagtcttcctgatcaggcaagtacctatttgcagagggttccagtaacttcattttcagagagggaactgtgggagcagagaccaggcaggttatttataactaacccaggtatatgaattttctctttgagggaaagaaattttcagtttacagttttcactggcacctaggttagcaaacttaagatgtttgccagatgtcttcatctcatgctgttaaatttaacacataacattccaacttgatcttaactttgttagtttttctaaaacatcagtttcttcccaaaccatgtttccatggaaaacacaagcatttccaggcaataaccccatcatctgtgccactatagacaatcatcagataaacttccttaattcataccacatctgctctttcagccctgtacgaccttgagcatgcacgcacacgcacacgcacacacacatacacacacacacacacacacgcacagagaaaacaaaactcctaattattttttcccaaaataagcatctgacccaaattgcccttccaattttctattaaatgaaagacaaattgtcaggaccaaatcagccaactttattaaaaactgggaagtctttcaaaagctttcagggtgaactgtcatgttaaacatgacaagtagttaataggggagaattgcatctatatggtccctgtttatctcttggcacattctggtaagtgaagactgcttgggcacaggcatctctctccactttatcactatggaggactctttcttcaccccactacttgaaaaattaaagcaatgtgagagcccaagatatgccaactgatttctagtctggccttgtttcatttggcaggcaggatgggggcagggaagtggtatagtcgaggacataggctttgaagttagacaaccttgagtttacacagactctccctcctcctagccctgtaattatgggcacatctcttaacccaagtcttagtttcattagctataaaatggggataataatatttaccttataggcttgttgtaaggatgaatgatataacatggatgaaagcaacaacccctgcctggcagtatagtataagctcattaaatggcaattctgtttaagagtaacgactaaggatgctgtggtttaaaaaataaagaaaaaaaaagcacctgctctttctcaatgccagaacacaaaggtaaagcagtgaatataccatttctctttagattaatcatctctaaaataaggacatggcatcaaggatctcaaagattcttcctctatgactctagccttctgaggtcttatattcagggagaaatgaacattgaaaagcgggagaaattaaaccacctttctgactagttccttgggagacccaagctgtgcttcatcagtactttcagttccaaagcgtataggatcaagtcagttccagagagcagggtttggatgaggaggcctgggtggatagtaccggttaactccatagctgcaaaaacaattctttcttcacagtaatacaatgatagcaaaggggacatttgaccttttcaagatttttaaaatgcaaaatacaaggtatgcacataatcttgtttactgactgatcctttaaaaaatctggcatattaataattccacttaaaatactgaagatgggagccagaaggaaacttgttctttctatacaatgactgagaagggaattctaatgaatattttggcacacatatctcattttctggctgctttaggacccaagagccagtaggtcataattaaagccaataatggcaactccagacagcccaaatattttcctggtgctgtcaattcactgcattaaatgttttaacatcattttttggggagtgtagaacatacgcacagagggggaattaaatgttgatgtgaaatttggaacatttgctgcaggttgctccaaaagatattgtttattacattcaaaggaattatacaatgttttccttattagataatcttaaatgaccctttctgggctgagagctgtgaagtgtgtccttaagttgtcagaacaaaatcatattttctgcagaaaaagaaaacaaaaaacatgtttggggctgaggctgcatgtcatgtaaataaatgaacgtcttctacctccactggatcttcaggaatgttctctttggtcaccaggagttgtgttgctacagagttaaagctactcacttttctgtcaactctacttccaaaaagaaaacccacaaatatatgtttgcaaaatctgtttgggatcctggagacaaggtccttaactttatctttttcctgaacaagtttcatacttaaaaaaaataataacaattaaaattcctccagccctacccccaccttcttccatccttccatttctactttaaatgataagaaagtttcctcttggatggaaattaaacatctcagcctgggtgaggcagctcaggcctgtaatcccagcattttggtaggctgaggcaggagccttgcttgaggtcaagggttcaagaccagcctgggcaacataaggaaatcctccttctctaatctaaggggaaaaaaaaaaaagtatctcagtctaaggtgtgtctgagagagttctgaatcaccattttgggatggaacaaactgaccagtcacttcttttttttttttgagacggaatctcgctctgtcacccaggctggagtgcagtggcgcaatctcggctcactgcaagctccgcctcccgggttcacgccattctcctgcctcagcctcctgagtagctgggactacaggcgcctgccaccacgcccagctaattttttgtatttttagtagagacagggtttcaccatgttagccaggatggtcttgatctccttacctcgtgatctgcctgcctcggcctcccaaagtgctgggattacaggcgtgagccactgctcccggctgaccagtcacttcttaaaggcaaaactggatttgctctgcaaaacaattcagcaaaaacttgggttccaactctggtgctacactgtgacaatggaaactttccagctacaacttggaagttgggagccaagcacaatactaagtcaaggaaggtatttgaggccaaagcagacagtggtcttggcactgcctgctcctgagcccaagctgcagcagctgtggggtggtgatgcagctttcagagatctctaaatctctaagtacaccagaaaccagattttattaactccccttttccacttttttttgcccctacatttctgccatggattatatcataatagatggtgaaaatgctgtgaggtgtatactcaattcctaggcattcttccacttaatcatactcagttttctttgagggcctccacattgtaaatgagcaacaccttgatactgggaaaatgaatatgaaactcagggccacagcctctgtgatctggtcattctggggcagtcattttcctacttggcctacagaaccaggcaggtctctggcctgggggtggcgggtgatgttgtattctcttgtcaaagtgcacagagcccactctgagaagatgctatactcttcacgttacaagacggcaatatgcccgtttctgggccaattggctgactcagagatgaggagattattccgtgacactttgttttcattccagtccaaagggcaaaaaaaaaaaaaaaaaatgtaaaactctgctgccacctgctgtttctttaggaataaattcttgaaacggttctaggttgattgtatattggttatcttagccaagtgccttggtggtgaatttgggggattttggaatataagtttatgtagttgtgtaccaactggactgtcatttcctaggatgaactgttggaccacatgggtggcttctctctttcagtccattaagtcctgcctccctcatcccttgctgagactcaagggcagactccttgatcccagacaactttccaagggagttcacgcaaggctctgaccagtgaggctccagagcaaaacccaggaggcttataggtttaagtgtcttttctttatgggccaatgatgtctgaaaactgtagcagtaggtaaattccccaagcacagactattctctgctgggtgtcagtgggtggtattggaagtgcctctcagaagtgctcttctcagcttgaggttcatttgtgatgaggttcatttgtggtgtctccagatgttttatctttgtcttccttgaggaaactgaggcagattaaggaagacgagtgtccaggaaagtaaaggctagctccatttgaatcacacccaggtgagaatacttgagctcaggttagatgatgagagggatgaggaaaacagtggctcctcggagctcaaataaagagcactggagcattaatatagtcataagcttagatgggcttgataaagcccttagtcatcttattggaggcatccagaggacagaggctgccttgccttgactatattagtggcttgttgctgctccaaatcagaaagtgggattttcctttttgccttctttgggaagatccatttgtatgtaaatgagttctttttgattgcagtcattgttgtagctgagaattctttcaaccaagatctttttcttggcagagattactgagtctattaagtgtgttttcatataattctaagtgactttttagatggacacagaaagaagtgttaaggaaatgacccttggtcttttctcctatcaaagagaaaaggcatttgagtggtatcgataagcattgaaggtaactgatggcttatcactgtgtctggcattatagctggcacatttattgactgaatggtcaaacttatcacccgttgttcttcccagaaggttcgtgagacctgttggggagggacggggatagaaaggaacagaaggaagagtctcagagttaatcaggtggaaagtctgtaagtggagtgaaccatgggagctagaatgctatggtaggaccaaaattaatactgtatatgtcaaaataaatgtgtattacttataaagtatatacagttcctaaaaattatcaaacaaggttattatgtacaacatttctcccttctgtgtctcattccctaaatattatgattgttaacatattgcacaagcttgaccatgtttatgcttcatgtattttcttgtttatgtccccgttgttctccctcagtattttgtaaaggctttggaaaagttccagcctatctcagctatgtgaagaagagttcagggaaggagtttgtataacactaaagaaatgtcagtatctcctcacaggtaggggctgacatgatgccacggcaatgggaaatgaagtgggaaacccgaagcaggaaggaaaactcaggagaactgggttgggatagtggtttcagcttctcctcgcctcctaaagagtctcttgatagttctcaggccttgaaggttctgcctgcccccaggttccccaccccaggaaaataagcaacttctcaggagaataatgaggttggtgtttacctttgtgcttcatttgagtagcatgagagcaccccattcctcacatctgttcattcttctccccttagaaatcttgtctcagctgaaaggtcagagctagaagccccaatctgcttctagctctgaccttctggctttgtcaggaatccctatgaatttgtgctgttgattttctttgaactaaatacagaaatgtgtctgcactctgggatagagaagagagtatagtaattgccaggagaactgaagatgaccttaaggcaggccaggtgactggtaaaccatacccttcacaaggctaccagagctctagcctgaccaatattattttgaaagggaatacattagaatccctggtgactagatgaacatggccatcactatttctacaaacctgtcttctgatgaacatatactcctgctggatggtgtcaagacatgcttgtttcttgagtggtttagataccagttattgcccctcctgttatgcctggtaactaggatgctgtcaagaaaatacagcaggacttcattgagcttaaaaagagcgtttcaaaaatattgcattagccttttgtcctttcagtctgtttttcatagaacaaatgtaatcttagtcgctacaaatttgtttaaaatagctcttctggtgagtcacctaaagttaactgcagatatggtattgttttagccatgtcaagcttgaaatgttatccaagtcctaggaactactcactatgggaagctgatgatgtatgtgccctcacacgtgttttgagggtgatcctataatgtccggagagaaagaaatgcctgagatgaactggtcagcattacatttctcagaacgggctgcaagagcttcagaagcaaaaggagtgttctctgtaggctcagatgctcacatgacccaagacacgtgaagggtctgcccatcattcacccctctatccccacaagtggtcagaaagttaggaaaatctccaagagaccatgcagaagggtcaaaggatcttgcagatgttctgagcaaaaaaatgaaaactttaaacagaacattgtgccatgacttgaaaaggtcattatctagttcacacttacatcagactataaatattgtcagaaaaatggatatgtttgccaggaccatgaacagtaaaattgcttaaaataggccacagaaaccctcaaggccagtggggccatggcaggccatgacactcaaacctgatgctgccttgtgagagacctcagcaggaacaaaagccaacagctgcttattggaaaatttatactcagtggccctcaaaaattgcaaaagcctttcaagtcatgtaagttaattttgtctcactcttccaccaggtagaagtgagacagggagactcatgctccttaaatgaggtcccttgtcaaagactagctgtcttatggcctttgaatactctgcccttcccccttcctatggtatagctttgtgtccagttagcactgagcagaagctgctctcctgctgtccccacccactgttggctaaagccaggtcacctcctgccaggcagcggctgggtgaaagtccagagaagctctcctgaataaacaagtcaaacaaaggcagttcccagcagtggatggggctgtactccagaagtctatttgcaaatctgtcctttagaactcggaagacattccccaggaggagcaatgttatgcagtgtggcaaggttcccaggctagcccacacctctgatttaacccagaatgggctggggaaacagtgctctagaactcatcattatgggtaatacctttgtagtctctgctcttcagtttacaaatagttgctgagctaggcatggttccaggtgatgtgaaggttcaaagctgcctcagctttgtggagtaggtagattcagtagctcctgggtgcacagtggctgagattttcccagtctcatgaaatccctgcttctctttcctatctacatgttttaggctgaaagtgaagggatgaccattccggcttttctttggtttgtttcttcaagataacctggtgtagggaagggtgagagtcctggctctatcattacacacagcagcatctccaagcttcagtttctcctctgaaaaataggataatatgtagctaagagagccttggagttgcctccccagcccttgttcttctcttggtaactaccatgacttttgttagggtatccacatctcccccaatagaccactccactcctgaagactcaggcctagtgcaattccattttaaggccactattacaggacccagtgatgggtgctggcctaattcaggccagtgagcttgcataagtttattggcttatttccagaaaaacaaatttcctttttcctgctagataagaatgggacacatatgtggtctcactagcaattcaggccaatgagtttgcataagtttactggcttatttccagaaaaacaagttccctttctcctgctagataaaagtgggagacatatgcagtctcagcagcaatagaaagccactctgagactaaaacaggggcaagccctagatggaagctctcattgtgaatggcagagtggagtgatggaaaatagaactccctgataaagttgttgaactcctaaatggacccatcctcaatcctgtcatacttctattgtataaaccaatcatctccttcacttagtaacccatagtgagttgagctttctgctccttttaatggaagccatcttaattaatacattatagcacaggatttactatgggcattaaatgggatatagcattcacagtatctgtctcatgctgaaaaaagaaaaaaaattcatagtatttagcacagaatttatatatgacccctgcccttccagtccaagggcattaatggaaaagaccatagtttctcaggcctttgttggatagggaagaagagggcatgtgtggactccaacacgaccttaacctggtttgaggcttgaatatcttgcctgggctagaaaggtggcccctctggactggctttaattttaggatcagtccctttagagggagtagatcttgtaagctggggtttccctagcccttggcaagtatacatgttgaagagggttgggagacaaagagggaagaaaggagagaaccatgacttgctggtgtaataacaaaaggtcctacctatctttgggatcgagattaatctctcctgtctttcttctttttcctcctttcttccttacattttttcgcactcccagttctcattagggctgaagaagaaagggaagtcaaagctgggatggcaaaggagtggaagtatatgccagagggagaaaggggaacttgtgtaagctaattctgatgactttgcattcaagtgtagcacagatctcagttttcagactaaatggtagctttagactcctatcggaggttggcaaggctggtttcttggagtttttgcatgaagaacaggaaactaggcagagcagcctggttcaaggacaaagggttatgttatgactaataggaaggaggaatcatttggagtacacacagtggctgtaagtcagatttcggtcatttcattacccccagatttagcctaagtcaccagggagaggagactgcaataaaagaaaaattaacaaaaagctgacatgactgaaatctgaaggaacttgattcacatgacattactgctttgcagttgtgctgtattacaagggtagagctcatttgtcctagtgttagcatactgcacttgagagtatgctagaacacaggatggaaaaggagtgtgagaaaacattacttcacaaaagtgggtcaagggtgccatgttccaactgtgaaatggatgcttagaaatgaaaatagaactccagtgtggtctgaccagaacaggattgagctgccaccctcttatcgggacactagatttatggctgtggtcaagaattgccctaatcttgtttttatcagtcacattccaataatgcctcataatgaatccatggtcaattaaaagcccagttgttttttacatgaactgctgccaagtcaggaatccctgtgaatttgtgttgttgattttctttgaaccaaatacagaactttacaatgattcttcttgaaagtcatgctggtcagattattttgcatcttgcttattttgtctattagctattactctaaactttgtgcttaccttcttcatcatttaagacacgtataaaaatattgactagggccaggtgcagtggttcatgcctgtaatcccagcagttctgaaggctgaggtgggaggattgcttgaagccaggagtttaagaccagcctgggaaaaaaagtgagacccccatctctacaaaaaattagaaataaaatcagttgggtctggtgatatgtgcttgtagtcccagctacttgggaggctgaggtagaaggattgcctgagcccaggagcttggggctgcagtgagctgtgatcactctactgcccttgttccagcctgggtgacagagtgagtgtgtgtatagctattcagtcagtggccaaaccatatatatatatatatatatatatatatattttttttttttttttttttttttttaggcaggatctcactctgttgcccaggttggagtgccgtggcatgatctcggattactgtagcctcaaccttcagggctcaggtgatcctcccacctcagcttcctaagtagctaggactacaggcacactccaccatgcctgtataatttctgtacttttagtagagatggggttttgccatattgtccaggctggtcttgaactcctgggttcaagtgaaccacctgcctcgacctcccaaagtgctgggattacagatgtgagctaccatgcctggcctcatggtacttttataccactttccctctccaccttatccatcactggatcatgagatgcattatgtattttctttatgaaatcaagttacactgactctagcatttccaccctggtggcctggcacttacccagtatcttgcacgtaataggctctcaataaatgtttgtggaattaaactgaattctgtgaatcatcagcataataaaatttaaaagaaggaaatgaggcatgattcactgatgaaccacttgggatctcagtgctctttatattccttttcgttgttttaagtgaaaatgtcacacattacaggaaaataaaatgtcaactatgattgacaatatacattatgccaactatcatcattatcaatacccaaaattatatttttttcttttacaaaaaacataatcatgtgcaacttcattttttaatttaatctattttggctacctttctatttttcagtagaatttcattgcatgaaccttagtctcttctaagtgtttaacacattatctgtttaaattcattagattctgacataagaatcatttgttttcaaattatggagttaatctattcttcttttttttttttctagacggggtcttgctctgttgcctggctggagtgcagtggtgctaacatgactcactgcacccttgacctcctggactcaagtgatcctcccacctcagcctcccaagtagctgggactccaagtgggtgccactacagccagtaagtttttgtactttttgtagaaatagtgtcttactatgttgcccaggctgatctcaaactcctgagctcaagcaatcctcccaccttggcctcccaaagtgctgggattataggtatgagccatcatgcccagcctaatccattcttcctaatgtatattaaacacccaccatatgccagaccttgcgtcagaacattgaggaattaaaaagaaaaactgggcaagggcctggccctccagagacttggaatctgatagaggtcacaaaataagcacatttatggtgttggaacaaggttctctgtgttagagtctactacaggggagtgtgccatgtgctctggggccttgattaaatacaaaggactataattttctctcctgtggggctccctggagcttggagcagcagccaagagatgttcaggcagctgagactctcatcacaaccaaagttcttctgccactcttggacctaggataggaaaattgatgggctctctgccttcaggcagctcctgctcgggcagtgtgtgatagaagaggaacttactttgggtgagggtccactgccccttcctttcttccatggccatcaggtaggccatgtggtctgaccacagagaccctgacagagggagaaagaggaaaaggccaaaaaacagaaaccatgaagaagcagaaagactcttaaggtgaccttcatgaaacctcacctctggaattcataccttggtataatcccctctccttgagtgtggatgtggcctgtgccttttctacctagcagaatatagtaaagacggtgaattgtatgtgattattgattatgctgcgtatgatatgaatattagtgctgtcttactgaactgctctcttggcttggaggaagcagatggctatgttgggagccccatgtgccaaagaactgtgggcagcctctaagagttgagggtggccactggttgacagccaccatgagactgaatccctgagtcttattaatgcaaccacaggaaacagaattctgccaaatgaattctgagtgtgtttggagcagatctttccctagaccagcctcagatgagatcacagccttggctgacaccttgattacaaccttgtaagaccctaagcagaaaatccagctaagtcaaacctgtactcctgaaccacagaaactgagataataaacttgcgctcttttaagcagttaagcttgtggtaatatggctaagcagcaatagttaattaatatcctaacagttaatctcttttgccttccataagaactgcaggagaaaaaaatgacgtagggaagggagattggaagggaattccagcaacctctatgaagagaagaaattgactagggaaaggacttttgctgtgaagctctaccacatttgttcattcattcattcattcattcattcattcgtttgttaaagatgttgaagtagagatatgtgtatcagccttcaagaaaggctattggcatggactgaattgtgtctccctgtattagtccgttttcacgctgctttaaagaactacctgagactaggtgatttatagagaaaagaaggtttaattgactcacagttctgcatggctggggaggcctcaggaaacttacagtcatggtggaaagggaagcagtcacatctgacatggtggcaggagatggagggtgggggaaattgccaaacactttcaaaccaccagatcttatgagaattcactatcataagaacagcatgggtgaaactgcccccatgatccattcactcctacgaggtccctcccgcaacatgtaggggttacaattcgagatgagatttgggtagggatacagagccaaaccatatcagtccccaaattcatacgttgaaaccttaactcctaacacctcagaatgtgatagggcccttagtggttgtggtggcatatgcctaaaaccccagctacttgggaggctaatatggttaggctttgtgtccccactcaaatttcatcttgaattgtaattctcaggtgtttagggagagacctggtgggaagtgattggattacagggacagtttcctccatgctggtctcaaggtagtgagtgaattctcatgagatctgatagttttataaatggtagcttttcctgtgctgacacatgctgtctctcgcctactggcatgtcagacgtgcttgcttctcctcccaccaggattgtaagtttcctgaagcctccccagccatgtagaattgtgagtcaattaaaccccctttgtttataaattaccgagtctcaagcagttgtgttttttttttttttggagatggagtctctgtcacccagactggagtacagtggcgcagtctcagctcactgcaacctccatctcctgggttcaagcgattctcctgcctcagcctcccaagtagctgggactacaggtgtgtgccaccacatctggctaatttttttgtatttttagtagaaatggggtttcagcatgtagccaggatggtctcggtctcctgacctcgtgatctgcctgccttggcctcccaaagtgctgatattacagccatgagcctcctcacctggcccaggcagttctttatagcagcgtgaaaatggactaatacggaggctgaggtgggaggatcacttgagcccatgagctggaggctgcagtgagctatgatcatgccactgcactccagccgaggtgacagaatgagatcctatctctaaacaaacaaacaaaaacaaaaatcttgatagggcctttaaagaagaaatttagttaaaatgaggtcattaggataggccctaatccaatctgactagggtccttataagaagaggagattaggacatacagaaagataacaagaatgcacccacacagggaaaggccatatgaggacggcacaaaggcaaccatctgcaagccaaggagagaggtctcaggagaaccaaatctgctgacaccttattcttggacttctggcctccagaactgtgacaaaataaatttctggtgttttagccacccagtctgtggaattttgttatggcatctctagcaaactaacacaagtataaaaactactgtagatattttaagcagagaaagattgaatatagaaagttaggtgctttcaaaatcattggaagagctggagtagctggagttggggctgccactagaactaatgtatttaagaatgcactgcctgtggtctggggactgtgaagctgatgcctcttctgttggctctgccatggccatcatagctgcctcgtcacaattgagtcagcgaaaagctgaggtcaactgcccacctcaggtgcccatgatctcaaccgccaggaggaaatggtagcagggcgatggcctccatcccagttataccttccaaatctcatgtgagggcacttaactgaatctagtatcctagctgcaaaggatctgaagtttttaaccttccagcctctgtagcacaggaaggtacaaagaaaggagcgggaaaggacactgaagcacgcagacatatccagcacagtatgctagatatcagatgaaagcaagtgcccaatctgtaggtattcagagtagacacctgaaactgacatgattcattaaacttctctcctatagcaaaggtatcagatgcattaaaaaggagaggatttgtaaagaggatttatttggaaaagttgtgcagtgagttgtatttgcatcaaccctgaggaataaggctgagtgcttttcctagcatctcaggtcaagagagaagggattaaacaggaccaccctgagaacttgttatgtatctcctgccatcgtgtggtgggagggtccatattggactttcgtctggcttctgcctggaaaatttaaaagatggagatggtttgactagatgcttgaaccttgggaataaagggaagatggttgacctgggcagcttgctcttctagagtttgttgtgagcagagagtgtgtgaatgtttaagagctgtaggatgacacaggagaagtcaactgggagaggtggggaagcactgagttgaataattgaaatgttagctaaggtgagaagggcagagtatggcattctaggtagagggaccagcatatgaaaaggctcagaggcataaaagggtctagaatgtccaaggaaaagtaaaatgttcagtgtgactagggtgtaatttggaggcatgagaagaataagaaattcacttgggaaaatgtcctaagcaaatgctgtttgtcctttgtcctttgggaactagggaattactgtagagttttttttttaattaatatactttatttttagagtagttttggaaatatagaaaaactaagcaaatagtatagagagttcccacacagcctcctactttcccctattattaatctcttacattagcatggtccatttgtcacaattaatgaatctatattgatacgctttttgttgttgttgtttaagacagagtctcactctgtcatgtaggctggagcacagtggcgtgatcatggttcactgcagccttgacctctctggcccaagcgatactcccacctcagcctcctgagtagctgggaccacaggtatgcactaccaaacccagctaattttcaaattttttatagagactgggtcttgctatgttgcccaggctggtcttcaactcctgggcttaagtgattctcctgccttggcctcccgaagtgttgggattataggcatgagccaccgtgcctggccttatattgatatgctattattaactaaagtccatcatttattcatatttccttagtttttgcctaatgttctttttctgttccagaatcctatctggatactacatttttcacgtctcctttggcttctcttggctgtgacagtttctcagactttcttttctttttttgataaatttgaaagttttgagaagtactggccaggcattttgtaggatgcccctttattggaatttttctgatgtttttcacgtgacaagattggggttgtgggtactatgggttttaaagaccatttgatctgtgttttacaaaagcgatatggggccaatgtggaaggtgaactagttcaaatttattaagtcagtaccctttcattttgaagccctgcaatgtcttaccttcaccattattaaagaaacaaaacaaaataactcactccttaatgtggctcacacagctttccaggatctggacccagtctgcctctctgacttcatccgctgacactcttttccctgctctttacgccaaacttatgagcttctgtttctttctcttctttttttttggttaagagatggagtctcatccctgttgttcaggctggagtgcagtggcatgattgtagctcacagcaacctctaactcctgggttcaagcaatcctcctgccccagcttcctgagtagctgggtagctgggaccacagatgcatgccaccatgcccagctaattaaaaaaaaaaattcttttttttttttgagacagggaatcttgctatgttgcccaggcttgtcttcaacttctggcctcaagtaattctcctggccaggtgtggtgcctcatgcctgtaatctcagcactttgggagactgaggcaggtggatcacttgagctcaggattcgagaccagcctgagcaacatggtgaaaccttgcctataaaaaaagtttttggcttggttctaagtctttgctattgtgaatagtgccgcaataaacatacgtgtgcatgtgtctttataggaacatgatttataatcctttgggtatatacccagtaatgggattgctgggtcaaatggtaattctaattctagatccctgaggaatcgccacactgacttccacaatgcttgaactagtttatagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatatgtcttttggctgcataaatgtcttcttttgagacgtgcctgttcatatcctgtgcccactttttgatggggctgtttgtttttttcttgcaaatttgtctgagtttattgcagattctggatattagccctttgtcagatgagtagattgcaaaaattttctcccattctgtaggttgcctgttcactctgatggtagtttcttttgctgtgcagaagctctttagtttagttagatcccatttgtcaattttggcttttgttgccattgcttttggtgttttagtcatgaagtcattgcccatgcctatgtcctgaatggtattgcccaggttttcttctagggtttttatggttttaggtctaacatttaagtctttaatccatcttgaattaatttttgtataaggtgtaaggaagggatccagtttcagctttctacatacgactagccagttttcccagcaccatttattaaatagggaatcatttccccatttcttgtttttgtcaggtttgtcaaagatcaggtagttgtagatatgcggcattatttctgagggctctgttctgttccattggtctatatctctgttttggtaccagtaccatgctgttttggttactgtagccttgtagtatagtttgatagactggattaagaaaatgtggcacatatacaccatggaatgctatgcagccataaaaaatgatgagttcgtgtcctttgtagggacatggatgaagctggaaaccatcattctcagcaaactatcacaaggacaaaaagccaaacaccgcatattctcacttataggtgggaattgaacaatgagaacacatggacacaggaaggggaacatcacacaccggggcctgttgtggggtggggagaggtgggagggatagcattaggagatatacctaatgttaaatgatgagttaatgggtgcagcacaccaacatggcacatgtatacatgcgcaactaacctgcacgttgtgcacatgtaccctaaaacttaaagtataataaaaaaaatttttaaattagcctggtgtggtggcctttatttccagctacttgaggggctgagatggaagaatcacctgagcccaggaggctgaggctgcggtgagctgtgatctggtcactgcactccagcctgaatgatggtgtgagaccctgtcacaaaaacaaaaatgaaacaaaacaaaacaaaagattctcctgccttggcctcccaaagtgctgggattacagtgagccatggcatccagccctctgtttctatttcttgaagatgctaatagtccaggtagaagatgattaggttagaggaggaggaacagattagaaaatatatatgtggtagaattgacaggattttgctgattggatctatgatattaaaaagagagagaatttgagcacagttctgagatttgtagttcaaatgacttgatcaacagttgtgccatttactgagatggggaatacaggagtttggagggggaacataatgagatcaccatgacatactgagtttgatttgtctatggggtattgaggtgttcttgtccagcaggaagttggaaatcatgagtcttaagttcaggagggatgttggaataagtgtaattggcaaacaagagattgtggcaggggctgtgattattaattcaactgggataaacccaagggccatatttgcagtaattcaaacccttggcagtaaacagttgaatgtgaacttcaggtcagcagagaaattaaatttattttggagactatcaggcaagaggaggccaggactttggggaggattttgtggtctttctactctccaggcttaaaactaaatgctgcttcttttctaccagaatgaaactctgagacttaaaaaggctgctatattaaacaattaacatagcctcagaaaaagtaacagagagatttggggcttgggcagaatgacataaacagaaaatagagtattagataggccaggttatgatgaaattattcccaggtatgttgtttctgtaaggccttttcttttcttttttaaagacagggtcttactctgttgcccaggcttcaatgcagttgtacaatcatagctcactgcagcttcaaactcctgggctcaagcaatcctgccccaccttcccaaagtgatgggattacagacatgagccaccatgcttaggcagtttccttatgctgtagtccttatgccactatatttacattttttggttttttttgagacaaggtctgtcacccaggctggagtgcagtggttctggtgctatctcagctcaccacaacctccgcctcccaggcttaagtgatcctcccacctcagcctcctgtgtagctagaactacaggtgtgcaccactgcacccagctagttcttttatttttttgtggaaatggggtgttactatgttgcccaggctggtttcaaactcctgggctcaaccaatccacctgccttgtcctccaaaagtgctgggattataggtgtgagccactgcgtccagcctatatttacattaaaaaaaattacaaaagtagtacattcatggatggcagatgctgtggactggctcactcaataaccgtcccaactgccttctctgttgactttttctattatagaggctgtaaacaacacacacaaattcccagacttcatcacaatctaagacagctgtgtaatatagtgtggtaagtaagcagatgtccctgaggtgggcttccatttctgaataaaaaggcaaagacttggggtttcttccaagatggctgaataggaacagctccagtgtgcagctcccagcaagatcgatgcagaagacgggtgatttctgcatttccaactgaggtagctggttaatttcattgggactggttagacagtgggtgcagcctatggagggagagccaaaccagggtgggacgttgcctcacccaggaagcacaaggggtcgggggatttccttttcctagccaagggaagccgtgacagactgtacctggaaaactggtacactctgcccaaatactgcgcttttcccacggtcttagcaactgacagaccaggagattccctcctgttcctggcttggcaggtcccatgcccacagagccttgctcactgctagtgcagcagtctgagatcgacctgcaaggctgaagcctggtggggataggggtgtccaccatcgctgaggcttgagtaggtaaacaaagtggctgggaagcttgaactgggtggagcccactgcagctcagcaaggcctactgcctctataaactccacctctgtgggcagggcatagctgaacaaaaggcagcagacaacttctgcagacttaaacatccctgtctgacagctctgaagagagcagtggttctcccagcgtggtgttcgagctctgagaacagacagactgcctcctcaagtggctccctgaccccatgtagcctgacctcccagtaagggctgacagacacctcatacaggtgggtgcccttctgggatgaagcttccagaggaaggatcaggcagcaatatttgctgttctgcaatatttgctgttctgtagcctccactggtgatactcaggaaaacagggtctggagtagacctccagcaaactcgaacatacctgcagctgagggtcctgactgttagaagaaaaactaacaaacagaaagaaacagcatcaacatcaacaaaaaggacatccacaccaaaatcccatctgtaggtcaccaacatcaaagaccaaaggtagataaaaccacaaagatggggagaaacagagcagaaaagctgaaaattccaaaaaccagaatgcctctactcttccaaaggatcacagctcctcaccaacaacataacaaaactggatggagaatgaccttgatgaggtgacagaagtaggcttcggaaggtcggtaataacaaacctctccgagctaaagaagcttgttctaacccattgcaaggaatctaaaaaccttgaagaaaggttagatgaatggctaactagaataaacagtgtagagaagaccttaaatgatctgatggagctgaaaaccacagcatgagaacttcgtgatgcatgcacaagctttaatagctgattcaatcaagtggaagaaaggatatcagtgattgaagatcagattaatgaaataaagcgagaagacaagattagagaaaaaagagtaaaaagaaacgaacaaagccaccaagaaatatgggactaggtgaaaagaccaaatctatgtttgactggtgtacctgaaagtgacggggagaatggaaccaagttagaaaacactcttcaggttattatccaggagaacttccccaacctagcaaggcaggccatcattcaaattcaggaaatacagagaacaccacaaacatactccatgagaagagcaaccccaagacacataatcatcagattcatcaagattgaaatgaaggaaaaaatgttaagggcagccagagagaaaggtcgggttacccacaaaacgaagcccatcagactaacagcagatctctcagcagaaacactacaagccagaagagagagggggccaatattcaaccttcttaagaaaggaattttcaacccagaatttcatatccagccaaactaagcttcgttaagtgaaggagaaataaaatcctttacagacaagcaaatgctgagagattttgtcaccaccaggcctgccttacaagaggtcctgaaagaagcactaaacatggaaaggaacaaccggtaccagccactgcaaaaacatgccaaattgtaaagaccatcgatgctatgaagaaactgcatcaattaatgcgcaaaataaccaggtagcatcataatgacaggatcaaattcacacataacaatattaactttaaatgtaaatgggtaaatgtgccaattaaaagacacagacaggcaaattggataaagagtcaagacccatcagtgtgctctattcaggagacctatctcacgtgcagagacacacataggctcaaaataaagggatggaggaagatctaccaagcaaatgaaaagcaaaaaataaaaaataaaaaaataaaaaaataaaaaagcaggggttgcaatcctagtctctgatgaaacagacttcaaaccaacaaagatcaaaagagacaaagaaggccattacataatggaaaaaggatcaattcaacaaaaagagttaactgtcctaaatatagatgcacccaatacaggagcacccagattcataaagcaagtccttagagacctacaaagagacttagactcccacacaataataatgggagactttaacacccaactgtcaacattagacagatcaacaagacagaaagttaacaaggatatccaggacttgaactcagctctgcaccaagtggacctaatagacatccacagaactctccactctaaatcaacagaatatacattcttctcagcattacatcacacttattctaaaattgaccacatagttgaaggtaaagcactgctcaccaaatgtaaaagaacagaaatgacaacaaactgtctttcagaccacagcgcaatcaaattagaactcaggattaagaaagtcactcaaaaccacatgactacatggaaactgagcaacctgctcctgaatgactactgggtacataacgaaatgaaggcagaaataaagatgttctttgaaaccaatgagaacaaagacacaatgtgccagaatctctgggacacatttaaagcagtgtgtagagggaaacttatagcactaaatgcccacaagagaaggcaggaaagatctaaaattgacaccctaacatcacaattaaatgaactagagaagcaaggcaaacaaattcaaaagctagcagaaggcaagaaataactaagatcagagcagaactgaaggagatagagacacaaaatcccttcaaaaaatcaatgaatccaggagctggttttttgaaaagatcaacaaaatagactgctagcaagactagttaagaaaagagagaagaataaaacagacacaataaaaaatgacaaaggggatatcgccaccaatcccacagaaatacaaactaccatcagagaatgctataaacacctctatgcaaataaactagaaaatctagaagaaatggataaattcctcgacacgtacaccctcccaagactaaaccaggaagaagctgaatctctgaatagaccaataacaggctctgaaattgaggcaataattaatagcttaccaaccagaaaaagtccaggaccagaaggattcacagccaaattctaccagacgtacaaagaaaagctggtaccattccttctgaaactacttcaatcaatagaaaaagagggaatcctccctaacttattttatgaggccagcatcatcctgattaccaaagcctggcagagacacaataaaaaaagagaatttttgacaaacatccctgatgaacgtcaatgtgaaaatcctcaataaaatactggcaaactgaatccagcagcacgtcaaaaagcttatccaccatgatcaagtcggcttcacacctgggatgcaaggctggttcaacatgtgcaaatcaataaacataatccatcacataaacgaaccaacctcaaaaaccacatgattatctcaatagatgcagaaaaggcctttgacaaaattcaacagcccttcatgctaaaaactctcaataaactaggtattgatggaacgtatctcaaaataataagagctatttatgacaaacccacaggcaatatcacactgaatgggcaaaaactggaagcgttccctttgaaaaccggcacgagacaaggatgccctctctcaccactcctactcaacatagtgttggagttctggccagggcaatcaggcaatagaaggaaataaaaggtattcaatcaggaaaagaggaagtcaaattgtccctgtttgtagatgacatgattgtttatttagaaaaccccatcatctcagcacaaaatctccttaagctgataaacaactggagcagtctcaggatacaaaaccattgtgcaaaaatcacaagcattctttacaccaataacagacaaacagagagccaaatcatgagtgaactcccattcgcaattgctacaaagagaatagaatagctaggaatccaacttagaagggatgtgaaggacttcttcaaggagaactacaaaccactgctgaatgaaataaaagaagacacaaacaaatggaagaatattccatgcgtatgggtaggaagaatcaatatcatgaaaatggccatgctgcccaaggtaatttatagattcaatgccattcccatcaagctaccaatgactttcttcacagaattggaaaaaaactactttaaagttcatatggaaccaaaaaagagcccacatagccaagagaatcctaaggaaaaagaacaaaactggaggcatcacgctacctgacttcaaattatactatcatgctgcagtaaccaaaacagcatggtactggtaccaacacatagaaatatatatatatatatctgtgttgttatatatatatgtgtatatatacgtatatatacatatgtgtatatatatgtatatatacatatgtgtatatatatgtatatatacatatgtgtatatatgtatatatacatatgtgtatatatatgtgtgtatatatatgtgtgtatatatgtatatatatatgtgtgtatatatgtatgtatgtatgcatgtatacaccagtggaacagaacagaggcctcagaaataacaccacacatctacaaccaactgatgtttgacaaacctgacaaaagcaagaaatggggaaaggattccctatttaatatatggtgctgggaatatatatatatgtatgtatgtatgtatgtatatatgtatgtatacaccaatggaacagaacagaggcctcagaaataacaccacacatctacaaccaactgatgtttgacaaacctgacaaaagcaagaaatgagggaaggattccctatttaatatatggtgctgggaaaactggctagccatatgtagaaagctgaaactggatcccttccttacaccttatacaaaaattaactcagatggattaaatacttaaatgtaacacctaaaaccatacaagccctagaagaaaacctaggcaataccatttaggacataggcatgggcaaagacttcatgactaaaacaccaaaagcaatggcaacaaaagccaaaatagacaaaagagatctaattaaactaaagagcttctgcatagcaaaagaaactaccatgagagtaaacagtcaagctatagaatgggagaaaaattttgcaatctacccatctgacaaagggctaatatccagaatctacaaagaacttaaacaaatttacaagaaaaaaacaaacaaccccatcaaaaagtgggcacaggatatgaacttctcaaaagaagacatttatgcagccaaaagacatgaaaaaaatgctcatccttactggtcatcagagaaatccaaatcaaaaccacaatgagataccatctcatgccagttagaatggtgatcattaaaaagtcaggaaacaacagatgctggagaggatgtggagaaatagaaacacttttacactgttggtgggagggtaaattagttcaaccattgtggaagacagtgtggtgattcctcagggatccagaactagaaataccatttgacccagccatcccattactgggtatatacccaaaggattataaatcatgctactataatgacacatgcacatgtaggtttattgcagcactattcacaatagcaaagacttggaaccaacccaaatgtccatcaatgatagactggattaagaaaatgtggcacatatacatcatggaatactatgcagccataaaaaaggatgagttcatgtcctttgcagggacatggatgaagttggaaaccattctcagcaaattatcacaaggacagaaaaccaaataccgcatgttctcattcataggtgggaattgaacaatgagaacacatgaacacagggtggggagcatcacacacccgggcctgtcaggggtcgggggctagaggagggatagcattaggagaaatacgtaatgtagatgatgggttgatgggtgcagcaaaccaacatagcacatgtatacctatgtaacaaacctgtgtgttgtgcacatgtaccctagaacttaaagtataataaaaaataaaataaaaaaataaaatcaggaacatagtatcaaccaaaaagaattagttacttcagaggattgaaattaaaagaaaattatgaaaatgttaaaaaaaaaaaaaaaaaggcaaagacttgtgaggaggagtgtttttgcccttctccctctccctgtctggagctttgatccaatgcggtagcagcagccatttatttaccaagacaatgaaagctgagagctaagtatggtggagcagaaagatggaaagatcctgattccttgatgacaacctttagcaactatgctggttttggtccacccacttctggattttgtgttatgtttaaaaaaagcctttactttttgttttgttttttgattcagggtcttgctctgtcacccaggtgggagtgcagtagtgcaatcaccgctcattgcagcctcaacttcctgggctcaagtgatcctcccacctcagcctcctgagtagctggggctacaggtgcatgtcaccacacctggctaagcctttacttttttgaactagttagtaaagtggccctcaaacttagctacccattaaaatcacctgtggagtcttaaagttcccagttttaagatctccctatacacccccaaatgaataggaatttttggtggtaggatctaagcctcaataattggaagcaggatttcattctgtctcccaggccagagggcagtggcacaaccatagcccattacagccttgaactcctggtctcaaacgattctgctgccttagcctcccaaagtgctgggattacaggtgtgaaccactgcacccagccctagcttcaataatttaaaaaactctccagcagattccaatgtgtagcccagattaagaaccagtggtttaaaccacctgttttggtttttaatattttttgttattcccagctggatacatttgtaattaatacatgttttgaagctatattcaaaaaattgaagcacgtaagttctcccatttccaaccagcttcatctctactcccatccctagcagaatcataatcctcagattgctgtacctctttcttcaaaatttcttctctgcatctacaaatgcatattagttttctattacaaaaatccttccaggggctattcaagtgaggccagagaggtgacattgccatataagttagaaaaaccaggacagtgctgacttcaagttttctatctccataagccaccagaacacctggaaaatatcaatgttttagcatccaaactataacttccagcctgccttttgtagtctgaaatatcaggaaaataatatttcattgatacagtttaattttccacttcaggtgttttaaaccgtgtatacaactttttgtctatgattatttaactgtgagagacagaggatgttgaaaatgatgtttctgggcttcaacatgtggaaactctcaatttttttgtagtgaagttctcttctttgagttcttgccttaagtttcagttgtttgaaggtagtttctgttgaagagacattatctttgaataacaagcatcatattttttgtcctgtgttgtttcattttaagttgaaaatcacattgagatctaagagccgttgaaattggcacatcataacatttccagcagccctattgcacctgttatcatatctaaaaatgtgtattaaaataaccctctgttgaaaagacacagctccagggttaggattcctatggcaatcaaagtattaattttgggagtttacagtgtaacttgcaaaaacatatgcaaatttgttttatcatgggaggcagaattgcatgacaggttttagaatgagaaggtatgggttctaatcccaactctgccacctaatgactatgtgatttggagcaggttactaaatctctgtgcctcactttgtcatctataaaatgggaatgttattgtgagaattaaggagataatacatgtaaagcatctagaactgtgtctggtacacattacatattaagtaaatgttatctattattattatctgtatcaatttgaaatctatgttaattaatttctcttccctctcaacctgcatctgtgtctttttgggtagttccctgtaacaagttggttgaagaggaaaaattccaggccttgtttaaagatggttctgtccaatatgctggcactacccaaaagtaggtggttgtaccgttgcagttccaccacagcatggccttgaaagacagggtgaaggaaaatcttcccagtggacagtatgaatctatattgacttagggtagcggctaatggtttggctggatggtcaaaccttaaaaggatcatgattaaaaacctggtggcagggagagctgagaaagaggtttgtaggtagaatgttacgaatttgcacggaatgggaagatagtatatcccatgtgaatgctcaccaaacagcaatcttatcagaagaagatcttaataagtaggtggatgagattgctggttttgtgaacatttgttaccctctttccccaggttccccttttttgttctatggaagccacataaaatggtccatagggctatctgggggctcagcaacatggactttgaatcaccgctgctgagtgtccaacctgccaacagcagacatcaacacagcatttatttggcaccattccctgggagtaccagtttagccacctggtgaaaagttgattataaaggatcactttcatcatggaagggacagaactttgttctcactggaatgaatagacacttactctggataaagatttgtttttcctgctcacaatgcttcttccaaaaccaccatccagggatttacagaatgtgttattcacatggtgtttcacagagcattgcttttgaccagggaactcacagcaaatgaagtgtggtaatgggctcacgctcatggaattcactagtcttgcaaaataccccattacctcgaagcagctgtcctgataaagtggtagaatgaccttttgaaggcatagttacagggccagctgggtggaaacaccttgtagagctggggcagtgtcccctagtatgtagcgtatgtcctaaattagtgaccaacatatgttgctgtttctcctatagccaatttttctgggttcaggaatgaaggagtggaaatgagagagtttcttcttattattaaatttagtcatccactatgaaattttatcttcctatctctagaactttaggctctgctggtttagaagtcttggttttcagaggaataatatttcctccagggagcacagcaactgtatcattaacctggaagtgaagatgaccacctggccacatgggctcatcatgccagtgaatcaacaggaaaaagagagggctactaaactggcttgggataactgatcctgactattaaggagaaattgaatttctcttcagagaagttctcttagaggctggtatgacccatatatcaaggccaagtctgctggattagacctgtagttagttaagactcattaatggcaaggcataatgtcctaaatcaaaccagcttgagaaaaatgaggtatttacttacagaattgtctcttggaactcaatgaagtggaaccagccctcaaatgctggtacagctccccatatcctgtctccacttctatctatttgcacaccaatttcattctttgttcttactgcagactgatttctgctcctcagttcatgtggctgaaaacatggctgctagtagtaacagctttagctacctggagactaatttctttcctattccagtggcaagctttctgggaaaggactctgatatgtcaagcttgcttcaagtgcctgggggagaggtcatattgtaccaacatgtggcttccatggagacgtcatggatagagttggttgatcaggaggttggggatgggtggggaggtgattgtgagaaagtctgttcccagaaaaagaagggagctgggctgacaaattatggggctctattactaagtagacccatttttatacctaataataattacaaatataaataaataagtggtaactaatatttacagcatttactctgttagaccacatacacatatatgatgtttagcacaacatagggttctgagaatttaatgattgtgtctgtgtatatatatacacagtgtgtatacatgtaatcacagtctttaaggtaagtttaatttttgtccccattttatagatgagaaaactaagacttggagagaattaagtaactagtccaagtaagtagctaagcttgaacttgaacccaatgtatttgtttccaagggctgtccttgtaacatgacacttgagtcccttcccctcattctccaggctctaggcacccagtctcaccaccagattccagagtgctgactgggcccctgaagccctcattgggtcctgctaaatgctttctctgggctggaatttgcccctgggccccaagtgtctgactctgttggataaattgagtccaaacctctgtttttttaatatgtaaaaatggattgctataaggattatggaagctacatgagggcagatatttttgtctatcatgttcactgctaatctcctgcacccaaaacagtgctgggcacttgacaactatttgttaaatgaatgaatgagacaaactgaggctcacaaggattttgcttaaggagtaattggatattcttgccttttggctatgattaggcttttgtgtgcggggttaggcaagtgacaggggaagacgtggaggggattttgaagaagctgtgtatatggggaggcagagagagaaatagggagagagagaaagagagagagaggaaactgtcacagggaagttagagagaatggaaagggagagaagggagaagacaatggaggtgttaaactaagtatttttttcaaatttatctatgtatttaattgacaaataaaattgtatgtatttattgtgtacaacatgatttttgaaatttgtatacattgtggagtggctaaattgagttaattaacatatgcgttacctcatgtactttttttttgtggtgggaacacttgaaatctactctcttagcaatattcaagaatgcaagacattgttattaactatagtcaccgtgttgtacaatagatctcttgaagattaatatttacctgtggtctgcaatataaatgtcccttctatgtccccatggagtcagtggtagaatctgcattattcactattgctttaaaggtatctttgtgaagtgctggccttaaggcaggtccagagtaaggccatggggctgagcatacttggggtataattaaatgagataaggtaagttaaatctccacccagcacctggcccacggaagctaatcagtaaatatttccttgggagcccatgaccttggctgacctcgtgtgtgtcccttcccacagcacggggctctttgcatgccgggaagtctcagaatgtctgcctccttgctaagccgattttgcaaggagtcttcttgatggtatcaccaagctctgagatatggagactttgtgccacttcactctaggcagagttccttcatgctgtgtgaggtaggagcacacacgctcaccaaagaaaacaccctttagcctggttgggagactcccgggttaggcgctgatgtaatttgttttcacaaaaactgtagcagccttctgagttaagcatttgctcagctggtctttgccagacgacagatgctttgtgtcattgcctgttgacagtggccttagtcacacattgtacctcaaaggctgaaacatcccagggtaaaatgattatgaggaaggcgagctgctccagagatctggagggatcacgttgggtacccagccgggctggccccagggattctactccaggtgtaagagaattggttaaacaaaggaaatgacaatcagttcaggcccttactgtgattgggcacgaatgttctcagagctgccatagatattttaatcaggatgtccttttcacttgaatgagaggaatgcaggttctatatttacttgtttgtcccttctatcagattgtgaggcccaagggggcaggcgcctctaactgattcatcagcctgtgcctgctgcgtagcacaaagccaagcacaaagccgggcacaaaggactcacttggcgaaagtttgtgggatggaagaatgaatgcggtgtcttcctcggagtcccctcttttcaggctccgctttataccctttctctggcgcaggtccctgctcactgcaggtgtctcctaagagcttatgtccctatgtttccttctcatcctggaaacggaagtttattttgaagcctgctctattgttcgtccggcttgtaatcccaaactgaatgggactgatttgttgtatgcttggctggtcttcacaacgcatgtttttgtgatatgtaacatttccttttagatcaagtgtggcctggtatagttgcaagggccagagcgtccagggcagctggtgttctgaatttcagccttcccattttctattgttttatttttttaattattattattatattttatagagatggggtctccctgtgttacccaggctgatctctaactcctgggctcaagtgattctccctccttggcctcccaaaggcatgagccaccattcccagccccattttctaattgtgtaattcagtaaattggatttcatagaacctcagcttcctttgtccataaagtggatataacaaggtgaacttggctgagattagacccaaatatttttggatcacttgagaagtaagtagagactgaaaaagaactgtcatttgtaatccgtacacatttttgtgtttctaaaaagaggaaacgtctcagaaaatgcttcttataggccgtatgcaaatatagagaaaaaaatcttaccttgggatgggggaagttctgctactatgactccaataactaaaatgtttggcaaaattgtgtaaaatgtcaacatattaggcagagttgatctcttcaaaaggttttatttggagcattttatctttctttctctttctttttctttgtctgtctccttcccttctctgccttccctccttttcttttctttttcttttcttttttctttttctttccttttcttttctttttctttcctttttctttttctttttcttttcttttcttttcttttcttttcttttcttttcttttcttttcttttcttttcttttcttttcagatagggtccggctctgtcacccaagctggagtgcagtgacacaatcatggctcactgcagccttgacctcctgggcgcaagcagtcctcccatctcagtctcctgagtagctaggtgtatagttatgtgccaccatgcctggctattttttttatttttatttttttgcagagatggagtctcactatgttgcccaggctggtctcaaactcctgggctcaaatgatcctcccacgtcagcctcccaaaatgctggctttataggtgagagccaccatgcccagcctaaaatttcctatgtatttacaatgccatttgtcactttattattgcttgctcttgaaaattttttaacggataagccatttttctttttttctgagacagagtcttgttctgttgccctggctggagtgcagtggcatgatctctgcttaccgcagcctcaatctcctgggctcaagcgatcctctcacctcagcttcctgagtagctgggactataggggcaccatgactagctaatttttgtattttttgtagagatgaggttttgccatgttgcccaggctggtcttgaactcctgggctcaagcaattggcccactttagcctcccaaagtgctgggattacaagcgtgagccactatgccaggccgaataagccattttccaactagacaatcatagaaactcaagagctgagacactgaagatggctagacaactgtataaccatgatcatagactcatgctagaggagagaatggggaaaagaacttaactgggctttatgggactcagcattgactgggctgttattatcacacacagtgttctatggttagaatgcttgttatgttattgtttagaagttggagttttccacgaaatagacacattaattctcaggcctcctggaacacgatcaatcctaaggcaggaaataaagactaaggacatggagcttaggttgaagtgtgagggaaataactgcctccttgatctgaacctcaaggatttgtagaatgaagtatcttcccactgtggggaggcaggctggcccttcctccatggcagcagtagagagcaatgtagaagtcaaacccagagactggggaatctgggcaaaggtactgagtttcaagtttctctctgttgtaattctcttttctctccaagcctttggtaatgtcttgttaaaagtttcagcctagtctgctttatcacaacagggaaatggtggaggagtctgtacagcccatgctggggcacaacagtggagttaggaaagttgtaccctgaaggaagcaggtgttcagacataggagtcccccatgtggggccaggcagctggcagagatgaaaagtacagaggaaatgggtggaccacgtaagtgttccccagcggaattggataaaatcctgatttcacgaagtcaagtaggatgaggctcaagctacaatgatggtgcattaaatagaagcatgagtttacaaactggtgaagtctgacatacttgagttctattagacactaatgtctacttcattcagctataaaggacatactattatagtcagatctcactaaataaataaattcaattcatagctatgatcgtagctacatttccagtataaatttaattgatcgatctttgagattccttcgtgttcagaagttctgtgagtttatggggtactggaaataccactggagtcagccccgcccgagtgtccattagatcccccaaccacatccccctcattcactgtcttctttcccctcaactggcatggagtgtggggcaatacaggaatgtttcagaacgtgtagccagggcatgttgtaatttattaggagtcactcttaagtggagaggatcttattcttcagatagtcattcacattcttggaaattatggttctgaggtctccttggttgcaggaggggaaactcccattaatcttgtgacgtgctgatgaattgcttgagaatttcttaaaagcagaggagacatgtcaggaggaacataaacaaaacctcaatttcaaaatagcaaaacaacataaatcttccttgaaattttcacatgagtagatcaggccatgctacaggtcaaggccaaagagccacaaggcagactgtgttccccaaagatggccacagcagcatctctcctcccacatgttcttcctatgatgacatgttggcacttgtacaaccctccttgtgagagatgtggtctatattccatctgcttgaatctgtacaggcttgtgaatttgggggaaattatgctatgtaatttctgagcctaggtcataaaagctatggtttctgcctggttcttgtgagatatttgctcttggaacttatagtagatatctattgctatgtaacaaccccaaaacttagtagtttaagacaatacacatttattatccatcccacagtgtttctgagttaggaactcaaccacagtttaactgtgtcttctgcttcagaatctttcacaaggctataatcaagattttggtcagggctggggtctcatctgaatgtttgaatggagaagaatctacttccaaagtcacttacgtggtttattcgtggtttttggcaggattcacttctttagggattgttggactgaagaccattagttttgtatagctattggccagggtaacactcaattccttaccatgtgagcttcttcattgtggcagtttccttcatcaaagccagagaaagagagagattatcttgtgacctaatcatagcagaaatattccttcaatgttgccatattctatgagttagaagcaatttaatcaaggggatgagattacacaaggctgtgaataccagcaggtggaactcattggggaccattttagaggcttcttaccacagaatttaaccagcaaactatgaagaagcccagatgaggaggtcatatgcagactttctgacctcaagcaccaagacacatgagtgaaagagccttcagataattccagctcccagctattcagtaatcctcagccttgagactttccagctgaggttctagatgttgtagagcaaatacaagctgtccttgtcatgtccttcccaaactcctgacccatataatccttgagaataataaactggttgttgttttacaccattaggtagcaagtggaacaagccacatatcttgaagtttcattgttcagctagtcacctgatttgaccatatgaaatgaccattgcatttttgctcatgccaatttttgcaactgaattgatatcacagttcagctaaaattttgcgagctgaaaataccttaagagtccacacaggtctgaaaaacctcgaaactttctggttgccataggtacctttttgtcttatctaataaaagcagcaccccattttgggtatcttgcctgtagcagcagtttgtaaaattctttcaaagggcacaagacaaatcaagttttcccaggctcagttctgggattcagctgagcttttatggtcaagggcatactcctaaatcagacaggatgctctaaacattctcattagtccattttgaataggactatcatagtgcttggtctggcatgaactatccatcagaataactctgcatactttttgtttacacatgtgtattgagtaattttttgaattaccttaataaacatctggcactagaattcttgatgggaaggaagtgtttttgcttggaaaaaaaaagagtttaataatgaagcaaacgaggtataattcctccttcccccactagagcctctctgcatgagataaggaaaggaatttatgtctgactttggagagattggatggagaagaaagaacagaggaaagagaagacagaaggaagacagaagaaccagaggagcatgtgaggatgggtgcagtgaggtgagggtgggtgtagtgttgaagccaatagagaaaaccatcttaagtgggtggctgacaaggactgcagggagcaagaatgtgcaatgatgaatgagacttttaggttgtccagggtacagtgaatgagcagactcactttctgtgaaacccctcccaacattttcagcaaagtctattaaattcatatatggtatattaagatttttttctgtgaaagagctaaatttatgctttgattgatgtagcacagagcaaagactactcaaagaacattatccctgagagactaggacaggagaatgtatgtgtcctgggtatttacagaaatttcggagaaagctgtagacttccataggccatggggatgtgtattttaagtcaattgttacccaagacttatgaagcagagaggtctcaactgacatgtgggctacttgaacatctctgtgtcaggtccagcctggttcctcacccccatatccttcctcaattttctaccctgtctcttctcacctatgagcccagccctactccaggttcctggtacattcttgagatgtaagaagcatcttaagatgactagatccagactgatggtctagggctccacataaaatcagtcctgctgctcaggactttcctgattcatgcccctcttttgaaaagtagaactaattttattctcaaacactggggtcttctctcctcctccatcctgtgggtctcaggccttgtaattgggcttctgctttggaatattttctaaatttctaggcataaactaggaggaaagcagtttaccctagaatggggctaagtctgcctatggaggggactagattgcaaaaaccttgagttctaggcctaatatgatacaaacttgctatttgactgtcacaaagtcatatttattctgtagaccttggggtcctcacctttagaacactgtacttattattaataacttagcaggcttggacataagttgtatagggttctcagcaccatggactattcccacaagtcaactggtctgctgcttgagagcagcagctaaaactggagggagtttgtccacttcaaacacacagactcaaccagtggagcagggtcagccccgacgtgaaaggatgctggccagggaaggcagggactcagaaccacaaccagaacccaagccaagaggacctgggttcaggacaagtctcagttttcggggtgggggggcactgaaaagacagactgagggaaactgaggctggaagtcaaggatatggactgaatcaatatagctgttaggatgtggctaggagaccctggggttacttctagcttaccagttctggagacagaagtatcaagatgatatcggggcaactggatcagctggtgcagttgaggttgcttaggctctccctttcctgctcgggcctgccctaccatggtaccaagcctgtctatggaatgggctagattgctaataccagatctgtccaggcaagagattccagggttccacgaacaatctcagacatgttggaaggggtgcaggaactctggcgaggacaagctccaatacctttcatagtcctcagagaggataggccagggcacatctggattgggtctctttaaattctgtgtattagattcacttctgggattcattgcagtgtggcagagagaaatcatagtgcctgatacatagtaggctcctaataaaggttggttaaatgaatgatgaaaattgaataaaataaataggaaaggctgatggctggagaaaagatagattggcagtgatcctgggctaatgggctcagggaaacaggcctgttttcctcatgtgatccttaccaccaacaactgagcttcaacctttcccctataataagagaaataattctcaaaacacattttcagattatagattgccagaaccagggagatgtttctactcttgacccaataatcctactcttgggattttatcataagaaaataattcagcaacaacaaaaagccaagtgcataaagatatttatgacagcatcatctgaggcagcagaaaaatggaaacagctcacaaatccaccaataagggacaggctgagtaaattttggtatggaatattctgtaaccataaaaacgatcactgtgaagattaggtaccaaatgcagaaaacacagaataaataatttagacaaaagaagtataccaaatgctatatatgttattagtgcaaatgtgttgagtgtttcttcatctcaagcaattaatttttctgagttcctatcactgtagttaaatcccaaaaataatataagatttacttcaaatctgcactccagcctgggtgacagagcaagactccatctcaaaaaaaaaaaaaaaaaaaaaaaaaagaaatcatggaactagcagaaaataactttaaaacagttattataaatatgctcaagtatttaatagtaatatgaacataataaggaaggaaatgatagatattaaaaagaatgaaatggaaattccagagctgacaaatggaatacataaaatgaaaaattcactcatgggcctaataatgcattggacactgcagaaaagatcagtgaacttgaaaacagagcaatagactatcccaactaaaatgcagagcaggggaaaagactgaaaaagatgttcagagcctctgtaacttattggacaatataacaagaggtataacagatgtgtaactggagtcctaaaaggaaggggaagatggaataatggcagaaaaagttctcatatttgataaaaactataaatccacagacctaagaagttcaataaaccccaagcaagataaatacaaagtaagtcataccaaggtaaaacataatcaaattgctgaaagccaatgacaaagagaaaaatctgaaactcagccagagaaaaagagataccttacttatagggacacacagataaaaatgaatgcaaaaataagcccttgtttctagcaacaccttcaaagtacatattaaaacaaaaaaatctgccaacctagagttctctgcccaggaaaaatatcctttaaaaatgaaggtaaaataaagacttttttagacagatagaagctgagaatttgtgactatcacctggactacaaaaatgttaaaggaaatctttttttttttttccagatatgctcttgcttatttttgtaaaaacattttgtagagacagagtctctctatgttgcccagtctggtcttgaactcttggcttccagtgatcctcccaccttggcaccccccaaagctctgggattacaggcatgagccatcacacctggctatgaaattcttgagactaaagaaatatgatactacgtgggaacttggagctacataaaggaaagcagagtggaggaaatgataaatgtatttatggaatttttaaaaatttaaacattttattaaaagataattcactatttaaagataacaacttttcatgatgcttataacattatgaccacaatagcacaaaagatggaagggtaaatagaagcatgttgttgtaagatcttatacatgaagtggtgtaatattgtctgaatgtaggctgtggtagggtaaatatgcatatgcaaaacaagaagcaacagaacaaaacatgtccaaataagtgcagtaaaaaacctcaaataacaggaggtaaaatggaatactgaaaaagcaatcaaataattcaaaagaagtcaggaaaaagaaaaaaaggaacaatgaagaacaacaacaaaaaaagaaaaaatggaggctgggcaccagtggctcacacctgtaatcccagcactatgggaggctgaggtgggtggatcacctgaagtcaggagttcaagaccagtctggccaacatggtgaaaccccatctcaaaaaaaaaaaaaaaaaaagaaaaaaggccagatgtgggggctcacgcctgtaatcccagcactttgggaggctgaggtgggcagatcatgaggtcaggagttcaagaccagcctgaccaatatggcaaaaccccgtctttactaaaaatgcaaaaaaaatttagccaggcgtggtgacgtatgcctgtagtcccagctactcaggaggcagaggtagaagaatcacttgaaccttggaggtggaggttgcagtgagccaagatcacgccactgcactccagcgtgggtaacagagtgagactccgtctcaaaaaaataaaataaggaaaaaaaaaagcaaaacaaacaaacaaaaaaaaaaaagaaaaaatgagacacgtagaaaacaaacagcaagacgataaacataatctaaccatatagataattacattaagtataaatggtccagatagtctggtaaaaacagagattaactttgtgctatctatggaagcccactttaaatatagaggcacagacggtttaaaattaaaaggacagtagctgggcatggtgattcacacctgtattcctagcactttgggaggctgaagtgagaagatcacttgagcccaggagtttgagaccagcctgggcaacatggcaaaaccacatatctacaaaaaatacaaaaaattagctggacatggtggcacacacctgtagtcccagagagtgaggaggctgaggtgggaggatcacctgagcctaggaggttgaggcttcagtgagcaatgatcacaccactgcactccagcctgggtgacagagtgagaccctgtctcatttatttataattaaaaaaaaggatagaaaaagataagacatcacaaacacttatcaaaaaagtgcagtggctatattaatattaaacaaagtagacttcagggcaagaaatattaccaaggataatgagggacattttctaatgatgaaaagatcaattaatcagaagattttaagtatatatatatatacccagtaacagcgcttccaaatatatgaattgcaattagacaaaaataaagaaaaaagaaaaaaatgaataaaaagtaacaaaaatgaaaggagaaatggaaatattcacaattatggttggagatatgaacactgcgttcttagtaattggtaaaacagacagataatcagtaagaataaagaaggctagaacattatctacccactgatctaattgataggtagagtgttaacacccagtgacaacagaacacacattcttttcaagtgcatgtggaacattgaacaagataaaacacattctgggccataaaacaaatctcaataaaatgaaaagaactgaaattacactgagtaggttctctgtttaaaaataaaattaaattagaaatcaacgacaaaaacataactggaaaattcacaaatatttggaaatgaaatgacattgttctaaacaactcataggtcaaagaagggaaattatattttggagtgaaggaaaatgaaaacaaaacaaattagaattggtggtatgggctgagcgcagtggctcatgcctgtaatctcagcactttgggaggccaaggtgggtggatcacttgaggccaggagttcgagaccagaccacccaacacagtaaaccatgtctctactaaaaatacaaaaattagctgggtgtggtggcccgtgcctgtaatcccagctactagggaggctgaggcatgagaattgtttgaacccaggaggtggaggttgcagtgagccaagatcatgccactggactccagcctggacgacagagagagactctgtctaaaacaaaacaaaacaaaacaaaatgtaaaaaaacaacaaccgcccccctccccccacagaattggttgtatgaagctaaagcagtacttccaaataaattttagcattaaatgtttttattagagaaaaaaaggtctaaaaaaaaatcaatgatctaatcttccaccttaaaacaaaaactagaaaaaaagcaattgaacacaaaataagtagatgtagaaacaattaagaatgtaaggaaatgagagtgaaaataaatgaaatagaacacagaaaaataatagagaaagtaaataaaaccaaaagctgttctttgaaaaaaaaaaaaaaaaaaggcaataataaacctctcaccaggctaacagagaaagagagagaagagaagagagagaaattgccagcattacgaatgaaagaatgaaagaggggacattattatagatcctatagatatttaaaaaacaaaggaatattatgaacaactttatgtttaacgggtgaattctagtatacattagaatggaataataccaattctatacaaactcacttaaaaaatagaggagaaacatcgcccaacttgttttaggagattagcattatcttggtaccacaaacaaaactgaagaccaacatgtctcatgaatagaggtaacagattaaaaccaatggtaatactttggcaaattaaaaccaataatatttgaaaaagaaaatatatcatgacctagtggggtttatcccaggaatggaaggtagacttaacatttgaaacagaaaatcatcaacatctaaagatcagttaactacttacatatatttcacctagtttttatatagttctattttgtacatttaaaattttaaataatctgaaattaattttggtatatggggctagggtaagaatataaattattgccaaagtgttattttttacaatatcatttggtgagtgaataacttgatatttctccattaatttctcatgtttcctttgtcttttaagtaactaatttacatgttgtgtcagtacttctgccagtattatagttgtatagtgtttaataatagtagttttaaaatatattttttatctggcaaagcaaaggatgtcccatacttttgtgaacattttccccagttctttcttaaaattaaatatatttaataacaggtaatatatatacttagttttaaactcaaattatagaatacggtatacatatttaataaatgttactagtttcttgtatatccatccatagatattttatacataaactagtaaatatgatttttcctgtttttaaaatgtatatatacaaatggtagcaaactatgcatggtcttatgtatgttgctttttcacttaactttatatcttagagctcattccattttaatatataaaaagcttcctcgttcttttttacaactgcatagtataccaatgaatgaataccgcaatttattgaacagttttctgttgatgtttatttaggtcatttccattttcttacgtcataacaataaataaaaaataattttgtacatatatttttaacatagatacaggaatatctgtcagattaattcctaaacaggaactgctagtctaaaaggcaagtgcatttataatttttaaatattgccaaattgctctccatagaggctgtaccaatatataatactgtgaaacaataagaaatacatatatgtatatactggtctctgaccctggttcctgacatggagctcctaaaacccttgtaatttctgaagtgaaagggtactaggagcatctttgttctaataaaatgactctcggtgggctcttagatgggggctgttctcgaggaagaccaagccatgattagaagcttggaacttctggagattgagttaataatgaatcatgcctacatgatgaagcctccataaaagtccctgaagtacagggtttggagaacttctgggtgggtgaacacatccgcgtgatgggagggtggtgcaccccaactccacagggacagaagttcctatgcctgttctgctttcggaccttgccctatgtacctcttcctctggctgtccatctgtatccttatcatatcctttattatataataaactggtaaacgtaagtgtttccatgagttctatgagtcatcgtagcaaattatcaaacttggggagggggttgtgacagccctcaatttggtaacctggggatctactccttgtacttggtgtctgaagttgggggcagtcctgtggcactgagcccttaacctgtggggtctgccgtaactcaggaaagttagtgtcagaattgagttaaattataggatacccagttggtgcctacagagaattggagaattggttggtatgggaaaagctcatacacatttagtggccagaaacattatgagagtatagagaagaaacgtttttttccccctatgcaaaataccatcagcaacgtttgagggtgcctgtttacccaaactcttatcaacattgttttcaaactttttgaccataacattctaggtggtaaacagcttatattgcctattgttttattcacattacttttattattgatttttaagttcttgtttactattattttatttctggaagttgtcttggaattttaaaatatagcttttataactaaggtatagcactgataagaaatgataattttgtcttcttgccacatctagtttttgttttattccttcatttattgcattgaccttaacttctagaacaatattaagtaataataataacattgatctttttgtttggttactgattttaatgaaacaatctgtagtatttcaattttaagtaagatattgccaccattcattatgttaagggatttttctgctctccctaaaaatttgaaagttaaaaaaaacccaccagaaatggatgtggaactttatcaagtgcttttcagaatataggtttgggtgatttattttcttaaggatgaactgtataattttaatacatttcctaatgtcaaaccatccttacgttgttaaaccctccttgactatcatggatgattttttgatgtgctttaattaaatttgctaatttttttccagatgtttttctgtccccattcaaaagtgagactggtctttgtgtgtgtgtgtgtgtgtgtgtgtgtgtgtgtgtgtgtgtgtgtgtgtgtgtgtgtatgtgctgttcttgacaggttttgttatcagggttatgataacctcataaaatgaactgggcagcttttcttctttgcttttttgcccaaattcttctctgctctcctggcctggggagaacaaggctggcctgtgttcagacctgctccaggacctctggtgacctccagcatgttcccagctctcttcttgactcttagtggtgttgtctctggcatctctctgcttctcctccggtctggcttcccaatgtgatcccctaacatctatggctcaacctgaactggcctctgtgtgaactcaagggaggggatttccttggcagatggaggttctccatgtgccccccatccccccacttcctccaagagctctcccagctgtgatctttagctcctccttgcgcttctgcctctagctctctgctgccctctagccacaacatctgtccttgtcgtggctttccgcaggcagaggcattgagaatggaactctgttcaacagatccagttgaactctgttcaacagatgtctcgaagcccttggaagttctccaaagtgactggtttgaagggggtgctgcaatgaggcaatgggttgttttggctgcctctgaagaaaaggggtgccagaatagacccaaagcctggactctgccctcagtggggaacatgaattacattgctgccaaaggacaactctgagaaggcctggtgccgctgggcagggcagctctgcaaagtccggagtagggaagggatcatattcagtatggacctttgctcagcatgcttctttcctgtccttccctgctaactgagacaacatgtatgtccagcctttctgttcagctgtcaactgtgaatgacacccgatagtgactcttgagctatgcttggaattgtctggctttaggctgacaccttccttgccatccccctgatgccatctaaggccacggccatggagagggacttttgtaagtatgctgttcatcaccatttaatatcatctagtggttctagaatcaggcagatttgggtttgaattctgtgcatgccacttactagctctgtgattttaggcaagtaactcagcatctctgagccaagttttctcgtctttaaaacagaaaaataatagatatacttgttaagctggtgtgagataacaatgcatataaagcacttggcctaatgctcaacctagtaaatattctatagatgttagttgatatggttttgctgtgtccccacccaaatctcatcttgaattgtagtttccataatccccacgtgtcgtgggaggaacctggtgggaggtacttgaatcatgggggcaggttttttctgtgctattctcgtgatagtgaataagtctcatgagatctgatggttttatgaagagcagttcccctgcacacgctctcttgcctgccgccatgtaagatgtgactttgttcctccttcaccttctgccgtgattgtgaggggccttccctgccatgtggaactgtgagtccattaaatctctttttcttttaaattacccagtctcaggtacttcttcatagcagtatgaaaatggactaattggttaagattattctttatcctgattgttctgtatctctcttgagaatcagtgtaacctcttcactgatattcaaggctctcttgaggttggggtcagtttatgagctgtctttccagtcttatctccactactctgttacacatactatattagtcagctaaattttcatctctttgcctttgtatatgctgttctctctgcactcagagtaacctcctcagcatccttgactgagaatcttcccaactgtcgaggcccaagttaaaatatgacctaccccatgaagagttcctggctgccccttgagaggtttttctctgcctcctgtagcagcacagccattgtaactattttcagtcaagaactggatgagattgtcccctgagaatgaatttaatgtcaaagtttgtcctaagtttttgtggacatccccccaacctcaccccaatagttgatttctgagtgcctgaacctgagaggtgctattggctccagcatttcttttatttttattttattttcttgagactgagtcttgctctgttgcccaggctggagtgcagtggcatgatctctgctcactgcaacctctgcttcctgggttcaagtgattctcctgtttcagcctcctgagtagctgggattacaggcacatgccaccatgcccagctaatttttgtatttttagtagagatggggtttcaccatgttggccaggctggtctcgaactcctgacctcaggtgattcacccgccttggcctctgaaaatgttgggattataggtgtgagccagcacgccctgccagctccagcatttctatgttggaggggttaggaggcattgcagtggaaggggaagctagaagtcttgtatggaaaacacactgatttcacttacattgtatactttttagggatggcttaggggatgggggtaagaggttggggtcaggtggcattggccctgctgatgaaccatggatattcctaatctgtgagtgagccaatggagtccttaagaatggccgataactaaatcagctctaacctaagcagttgttggatgtgagactatgaacaaaagtgtgaggtcacatggagtctgcagagagacaagccaggccgctaccatgcgttgccttatagccacctccagatctttctctgaaaagcctgctagggagatgagatatttggcctggttgggtaggctgggccagctagtatgggtgaaaacttgagattcttaggagttgagcttctggtcaaaagagagagaatgggtttaggcaagaaagggctttacttctccagggacctctcaggttgatgggagcttggcccagctctatctaccaagaaccacggtcaggtggtcagattagggctagaggtatacccatctctgggaagtgagttgagggctgcccccacggatcccatgacttgggccttactttgaaacctgtgacctggtgtctgggcatcctcccgctggatcaatgggctgggtgagggaggaaaacagtgtaaggtgagggtcagggaatgacccaggcctgaaacagagtccccaagagatgcttgctcctttggcctgttgtgtgaggcagcaaaggatgagctgagcccaaggtgggggcagggtcacaggcagaggaccttctagagcacagctctggaaaagcctcgtttgcgagactccagtctagtccccagtacccagccctagtcccttccctacctttctctctgagaagtttattcttctcttagacctggaggagtcatgagtgcttttgccaaatatttcgttttcccctcttccaggaacatgataggattgcactttttggctccttggtgaccctttgtggccaaagggttgtgaatggaagaggtgtgaatcatttctgggccagagcatttcattgccagtacaagaccctccagagtgctctttccacccacatgcaggtgatattcaaatgatggctgctttatcagcctgggctcccaggtgagatgcggagtgaactcccaaccatggacaggtagcacaagagggaaatgcacctctgctgttataaagtactgacctctgtcagtctacccccctgaggatcgaggtcttctgtctattttcagttttactgtcctacagtattgcttttttctctttttttttttccttcaaagctctgtgccctttgatttacttccgtcctcttattttctgctctttcttttccaggttcttgtcttttacacacatatccttgggtgccagtgctactttgccattgcttagttctatcctcagggcctctaaactcccctctttgactgtgaagaaagatgggctcctttcaggcaagattgtagaggctggagctggagagggcagagggcatgtggtggcagctaccaatgcagctcccagtgatctccacctcctggtattcacacttttgggtagtcccctcccacctggtactagtgtaagtctgtgtgatcagtagactatggcaaagtgatggtatgtgacttccaaagttaggttataaatgattgtagtttctgtctcagtcaccctgtcttggataatttgctctggagaagccatgtcataagctatggagaggcccatgtggcaaagaactaaagcctcctgccaattgagcttcagatgcctgcagccctggcaaccctgggagaggccctgaactagaaacatcctgctaagccactcccaggttcctgacctcataacaaaagctacaaagtgtggaatcattaattaagcagcaataaataactaatacggggcaggtatttgggagattgtgtttggaatgtcaaagcccagtagaataacaattccagatctctgcttagtataggttgtgtcccttgatctgggacagatttggccaccatggctggtgacctgaagggtcaggtttcccataagtctttgtgtatggttgctgagggcactcaacccaggggagtagggggtaggaaatactaatacagattgttttctatcccttagaaatctctcttgatccagtctcaaaagactcactcaagcctgtcttgtgctaaacagggagttctaagtaaaaactcaagccattttacaaataatgcaaaacatcgatgtaccatccacagttctttaggatactttttctgggtgtgacacacagggagagagcctacatgacaccgagaaggttccacacatctctggtggtgctgagtgcaaagagcagtatctgaaactaggaccctgtggggcagtagatgccccagagagagatttgctcatgggcaaagagaactcctgtgagacacattccacaaaagtgaaagcctaagttattaaaggagaacattagttggtgaaattagatctcttattgttaaagaatcttcactcatgcttgcaggcttgcagggattgggaaaatttggggtccaataataacaagaaatattatttatctacttattaagcacttaccatgggggtagggagattgggagatgttgctcaaaggaataagattagacagagagaacaaattcaatagatctattgaacaaccatgtgactgtagttaatgatgatgtatcatatacttgaaaattgctaagagtagattttaaatgttctcacgagaaaaaaatgataagtatgagacttcaaaaagttcatggaaaaatggaactaaaaaattaaaatacaaaatataaacttgatttctcactataagctccatcaagatcaagaccctgttgtaattgatgacagcacgatttagtccatttctgaagaaccgaggggtcctgggaacttagccatgtcaattcagtcttttttacattattagctgaagaaaatgggtgccttttaaagactttttaagagtaggaaacaaacaagaagtcagaaagagccaaatcaggatgcttaatgatttcccaccaaaacactgtcaaaattgcccttgtttgatgagaggaatgagtaggagcattgtcgtggtggagaaggactctatggtgaagatttcccggacatttttctactaaagttttgactaactttctcaaaacactttcatacttagcagatgttatcattctttggccctccagaatgtcaacaagcaaaatgccctgagcagcccaaaaaattgttgccacgacctttgcttttgacctgtccacttttgctgtgagtagaccactgccaccccttggtagccattgctttgattgtgctttgtctttaggatcatactggtaaagccaccccctcatctcccgttacgattcttcaaagaaatgcttcagggccttgatcctacttatttaaactttcaatggaaagctctgctcttgtctgtagctgatctgggtgcaatggttttggcatctattgagcggaaagtttgctcaactttaatttttcagccagaattgtgtaagcagaaccaattgagatgtctatggtgttagttatttttttgtgctggtaattgtcagtcctcttcaattagggcacaaatgggatgatttttttcctcacaagttgatgtggatggtcggtcactgcaggcttcatcttcaacattgtctcatcctttcttaaaatgaggtatctgtttgcaaactgctgatttctttggggctttgtccctataaacttttgtaaagcatcagtgattttatcattcttccacccaagcttcaccataaatctgatgtttgttcttcaattttagtagaattcatgttggtctgatagaggctcttttcaaactcatgtcttatcctccttagtgcctcaaactagattctgttcaacatattataacaagttagtatgagtttatgttggtgcagaaaaaattttaaatccatgcatagttttctcataagacacatttttcataaactttgtgaagtctctttgtatgtgagataatggttatgttaatttttagtcattccacaatgtagtcattatcaaacatcatgttgtgcatgttgcacaaatatatacactttcatttgtcaattaaatagaagttcaaagagtggacatattatgaagtatagtatactgcaagatagaaatgaatttgaaaaattaaacttgggggaaaaagcacttaccatgtgactattttaaactatttactacttgaaaacaaacagttcatgaacatcatctttttcaagctttgaaataatctataaggtggatattattcccatttttcagatgaggaacctgacattacataacttgcttctttcaagtgcctcctccaaagggcaaagctggggccacacaggtgggtgcctaccacccttaaaggcacagtcgtctggtgtccccatctgacgcaaacagtccaactcttgtgttgtgaacacaagtagatccactcctttttgagaccgattccctggaagggagcccatgccactgcctggcccaagactcttggctgcaggaagctgacctgcttttatccatggagtcagcaaaatgtgaagataatttataatagccattagcagagtgcatttgaggtcaagtatgaacctcctgcacttcagctctacacagatctgtgcaggagcaaagaggagtcaaatttctggaagcaatctaaccataacaaatgaagactgtgttgcttcaaggcttttaggtaagtgctaaaggggagatggagaacaacagtgtgaacatacttaacactactgaactgtacacttaagaatggttaagatagtaaattttccattgtgcgtgtgtttttttgccacaattaaaaataaaaataaaaaaggagatggtctccttttttatttttatttttaattgtggcaaaagtgatgatctatagcctgcacagatatagatcagatctattactgataattctccatatttatcagttggtaaatgggacctgtaaaggaagtgtgggtctgtgtgggatatagatcatcaagatagagaagtgggggagcagatgcacagtcagatcaggcagaggtagaccataaaaggccgtcacagaaactctacctgtagccagtttcattctggtgaggaggattggcagttaacctcaggcccctaggccatgactgtactttattcaaagtcactgtatatgtgtatacatgtatacacacacacacacatatgtgtatatatgcctatatatacacacatatctgtatatatgtgtatgtacatgtatatacatagacctatatgtacatgcatacaaatgcatatacatgtatatacacatatatgcatgcatgtgtatgtatatgtatgtttatgcatgcatgcatgtttatctatatgtatgtataattcacaaaccatattacatggttaatgtcatagggggatttaggtctttcaaacgatccttttgtcatctttacaaagtcctgaatcacagaagcttttgttcaggagggaggtctgaatgaatggacctgctggcattgtagtcatcattcctgggctgagtgtatgtcccagatgagctgtctcctgtgcctatctgtttgggctacatgttagaccagaagcagcacacagaaagccagcaaggcagaaacagcaccatgattctgattgtctaatgggaagatccagcctctcttctcttgaccagacttagctgcaggctccctgggagataggaccctgacacatctctcagagagaagccctgccagtgacaaggtaagcgacaagtctgggaacaagtttggaaatcttggcttcttttgaaatgaatgaggccttggatgctgggagtggggcagtggggagggaagctgtggctcttgttttttgctcatggagaaatggaaggcctttagagaaacaggtattgacttagaggtataaaactggagtggcaactgattcccagaactttagagctctctcctctttttcaaggttctgggatggtatgtaagtgtatcccttctgcctagccagctttcctatctctagaccggagaggaccctctctctgacctttgaccctgccatacctagcacaggacttaaaagtggctcctgttgcatcccatggcgagtgcagacagccctatcctatacccttttcattcctcttagcttggtatacaacagtcttttcccctagtttataatctgtgagggctgacactatgtcttgttcatcctgggagcttgcatagcttctctttccctccccttctccacgtgccttgcatacaatagaggatcccagcaacatttgttaaaaaacccatccccggatgctcctctagacagtactatcttctcctttttgccctataaaccaactgctgtggctttaaaactttgcattgttggccaagggttctgaaactgcagtttgtcttaatctgtggtctctggattcttgcttgattgctctctttctggaaatctcccagatagatcacagccagtcatatccgcactgcacctctccccaggatagtcagcatgagggcagaggtagaagggccttgagagagcatccaggaagcccttgtattacagatgggaaagcaaaacccctgagaagagaagggatttgcctgaggttatggttttgagtcagggccagaaatcagcttttctgtctcccagagcccccagggctcctaacgctggcctggtcttcttctttacactggctgagttctaaaaaggcattttttctggccctcacttttcaagtatcgcatccagagaggcaggttggtagctcagccagccaaagggtgtctgctccaggggagatcaagtgttgagaacctgagaaaagagacctggtccaaaggagtggagacaacagccaatggccctcttgatattctctccatgcaatgacttctactgtgaaattgtcgtttgacaacaaaccttgtaaatgaatagcgtctcgctgtaactcaccctgaacacgaacttggttaagtgttcgtggccatcggaattccctgcccactccatctaattgtcttctggcaggaggactgtttttttttttttttgtgtggccttgtggtaatgtttttctcatcagcggaggctgactcctgcctgagccctgaccaaggccactggccacatgccgtagtgagaactggagaagaagataataatgcagcttttcaaagccctttcccaagcactgcttacttgatcctcagtgaagccctgggtgacaggcagggaagtccttattagtccctagcttatggaaaacacgacggcccagagagaatgagtgattaacccaagggcacatggcttggtgagttattgaggtcaaggaaacagtcttcaaattccacctctgctacttactgtgactatttgaggtttataactcactagtatgggaccttgaatgttacttaatcactctgcctcagtttcctcacttttaaattaagaatatagtacatccttcattgagatgttgggagattaaataagccaatatatgtaaagcagttaagcctgtgcctggcaggcagtgagtggcaatattagaaattgttgctattattattgttattatttttggcgaagaagtctcactttttcgcccaggccagagtgcagtgtcgcgatctgggctcactgcaacctccgcctcccgggttcaagcaactctcttgcttcagcctcccgagtagctgggactacaggcgcatgccgccacacccggctaatttttgtatttttagtagagacagggtttcactatgtcggccaggcttgtctcgaattcctgacctcggccttccaaagtgctgggattacaggcctgagccacaaggcccagccaattgttgctattattatcaagtctgtctctgttgtgtgacaggaaaagcttccccagagctcatataaagatccctccaggggatctctaagaagatagatttcaaaactcatagcattacaaaagcctcagtgatcatctagtttgtccgcttatttgattttattattatttttctgatctgacctttgaagataatcacacaattattagatgcatagtcattaggtgcataaggtcagtggtccacataaatcattgacattattattataattatgtagccaaatacaatttttaatatttctatttttgatattatttggaatctataaatatagacatccatgttatcacatttctccataacatgcaccatttcatcttgatcacatgcactgacaatgactcatattaagaggtaaaaatagaaaaaaaagaacagtactactcataatatttgggaagtgggggaagggaggaaggggaagtgtaagaatggtaatttccttatcttttatagcagccagtcaattgatattgcctaaaattgaagcatgtaaaaaagtttattccagtctctgaatatttttcataacatattttcttaaccttagaggtacaacatccttgagaaatactgtctcctttgggccaggtgcaatggctcacgtctgtaatcccagctctttgggatgccaaggcaggcagattgcttgagctcactagtttgagaccagcctggacaacatggcaaaacccagtctctaccaaaaatacaaaaattagccaggtgtggtggcacgtgtctgtggtccccgctacttgggaggctgaggtgggaggattgttggagccggggaagtcaaggctgcagtgagctgcaattgcaccacagcacaccaggctgggtggcagaatgagatcctgtcccaaaaaataaaaataaaaatatcttttgtggagaatacaccaagttaagcaattccattagctttattaacatctttgtcttctcttaaattcaaggaaaattaaattttataccttttattaaatagcatgtaaagtgtgatctctttctaaaccactttttgtagtcaactatccatacatccattcactctcccttcttagttacctatccatccttctctctgtacacataaggagagtgacatctgcaacaatgttcacttgtgtcagccatggttatttggtggtggtgggatattgaagatttttaaatattttctttgtgttctacaatattgtttgaattttttataataagtatgtatcatgtttataaaaataaattattatcttaaaaaaacagagggagacagtgctcctggatttccccccaacaattggggatttccttgcttttcccactctccctcaccctatatactccaggaccaaggctttcaggttcttctgataccctaatacccatgattgttccagaggattttgcttccagagctcgggggtccttagtgctggggaacttgagtggtggaaattctttgcaaggaggctgtggataccctggcatggaaacatacaactgaggagaggaggaaagatggccagaggacagtgagacagcaaaagggttgcgagtccaggcatttctcatcttacgtaggaggagagcaagcctagggcggaagagtggcttgtttagagtcagcagcctgccacacacagcaaaggcaatcagttgtcccctcaaaggcattcagtatttttccccaagccctgtgattaaggaaaggtggtagggcttcaggcccttattctcagtacagaaagggggaaggaaggcaatgttagggcataggagggggattgggactgcaacctccccctcttcagcagctagtcttgtttttcctattggatctgccagaattagcatctgtagggacttcaagacctccctggaggcatctatagcatccatcacacagaatgtttagaatcagagtaaaggagtcctgacagatattgtgtctggatttcagcgaagtggagaagattcagaaagctctgggggccaattcttgtctttcccactccaacttgggggcatggcctatgtttccataaaccctccaatattttacttttttttttttttttttctggggaatgtggtggtggtaggagtgtggagtggactctttcacaactcttgaggacggtccccatataaattccaggaaattgtcagcacctccctagtggacagctccccatcagccaccagaatctccccatctcaatggggcccctgggccactggtgttctgggaacactggcttgtctttctcttgttcttctttctttcttaaaaaattcactttggtttaaggagctccaatttaagagatttcattatttaagatacccaatgtatataaaggaatgagttggtccaaataaaggacctttggctaaatataagagcctgagtaattgaattagaaacagctcaaggatgggtgtgtatcacagctcaggaatcttttataacaagattttcagaaccaaaccaacatcaagaacacatcgtcttacaaaaattgttttgggctatttcccagtattaatgcaatatgggagaggttagttggacagagaaatcttagaattccatggatattttaatagtttaaggctaaagttcagcatatttggaatctgaattgtcccagaaaatccagagttatgcttctcttgctcataaccagcagtctagaatgactcaggtagaagagagaagtctaacaggaaatggagatcctggcattgtgaatgccctgggaactaaagtactagagggtgcacagattttcctctagtaaaaggaggaagcataaaaaagggagcataaaggtttgaaaaattgtgaagccatctgttattgcttcccttaacagaagtggaacactgccaccagagcctgtaagaaggtatgtggccaggtcaggtgctggcaggtgaggctggttgacttccattaggctctttatgaatcagcttttagggtggaaagtctccttggcccagagcctggttctcatcttggtaggcttggaaacacatgtttatcaacactgagagtggctctatctcactcagaatagggtttcattgtctgagcttgcaagtgcttactgtgtaaactacttgctaaacatttgttggcgatgagaagcaaaaccacttggggactgggcatttgctgcctcttgtcagcatcccctcttttttaatggaaagccatctgggaaaccaggtcatcctcagaagattgcttggtgagcttggaatcagatttaggggtgatcgtttcatgatggtgcaacctgttgatggcaacaggttctaatcagctgttacccccatgcctgggatgggggaaggacttcctttgaagctgggtaggttaaggccttgggtcaggagactgcccctctttgtttgggttcctccagaagcaggccctgaaacaaggatttgagtgcaaatggtttaattggaaagtggttccaggaaacagtggtagcagagtgaaatgaaacagggaaaggaaggaagccaatacagatgtgttatcaaacaagataccactgtgggtaactgaagcttagcctcactgaagactctgggagacagtgtacaatatgcatccccatgttaatccaacctagggtccagagatctgggtctttttttttttctttgaaacagagtctcactctgttgcccaggctggagtccagtggtgtgatctcagctcactgcaacctctgcctcctgggttcaagcgattctcctgcctcagcctcccgagtagctgggattacaggcatgcaccaccacacccagctaatttttgtatttttaatagagatggggtttcaccatgttggccaggctggtcttgaactctggacctcagataatctgcccaccttggcctcccaatgtgctgggattacaggcatgagccactgtgctcggctggagatctgggtctttatgcaccaactctcataagtcattggctgagtgatactcctgaccagggagtggattgggtggctaatttgccaacacatccttcctactgcgtacatgggaagaacgagctctggtggccagagcttcagtcaagagcaacagatgtggtggttagaagttgggctggtgggtctgaaatggatagtgctgaggggacataagaagggcacaagtcgcatatttgcccatccctgtattgtgggcagtcatgaattgactttgcttaaaaaagctcatcccttttttttctgtgcttgtatcattgaccctttatgattagtcaattctctttatttattttttttgagaccaggtctcactctgtcacccaggctggagcatagtggtgtgatcatggctcactgcagtctcaacctcctgggctcaagcgatctccctacctcagtctcccaagtagctgggactatagttgtgtgccaccatgccagggtaatttttttatttttattttttgtagagatgggtctcactatgttgcccaggctggtctttaactactgggttcaagtgatcatcctacctcagcctcccaaagtgctgggattacaggtgtgagccactgtacccagcctctttattctttaaaataagtttgttaaactgaatcaattaggttctgtgcttcctacttcttaccccagaatagtctatgattattgctttctacatgttctagttttatttataatgtgggggtttaaaatttttacttcttagaattttgggagtgccttgctgatgaccacatgtactgcttaaaggaggtgggatggggagaaggagaaatagatcagtaactagaaaaggagaaacatttagaaacaaagtatttgatgggttctgaactttttatgcaacttgaccacaaattcttaagttcatctggaagaaaaaatgcagaagtctagccaagaacattttgaaaaagaacaatagtgaagaattttccctattagatatcaaaatataccataaagctatagtggttaaaacattgtgggattggcacaagcatagacaaataattcagtggaactgaacagagactccagaaacagattcatctacatgtagaagtttagtatatgatgaatatggtatttcacacttgatcttagccaaaagcctgagaagtaatgaatacggtatttgaaatgacagggcacaaagaggggaataagggtgaatattataatagatgatgttcttagttatctatctgggaaatgattggattagaattcctatctcacacatatacaaatgaaaataaattttcaaatggattacggaaggaatactaaagaacaacactaaaatgttttagaacaaaacatttgagagcagtttttcaatcttggagtgggaaagaccattctgagattctaaaattgagaagtcttaataagaaggggctggtagatttgactacataaactcgaaaacttttttgcaagttaagacaccataaaaacattaagaacacaaaagaaagtttttctgcatctctgccccctctctctggtgtctatctttctaagtctggcctctctcgagtccctgtcagcttgtctgagtctcggctcctcccggtgagtctcggcctctcccactctgagtcttggcacctcccactctctgagtctcggctcctcccactctgagtcttggctcctccctctctgggtctcagctcctccccctttgagtctcggctcctccttctctgagtctcagctcctctctctcagagactcttcctctttccctgtcttggctccttccttcctgagtttcagctcctagctctgagtctctgatcctccctctttggttttctccccagtcttgtctcctaccttttcactcaggttgtctcacaatctgtttcctcaagaaaagtagacgagtcctggacagacaaatgatgagtttcattcatagactgaggaagcaataaggaaaaaggaaaaaaaaaaagaaaacagcatgggaaagatttgcagtgtatatagaacaaaatatcaagattcataaggaatatatagtaagtataaatccatcaaaaaggtacaactggccaggcgcggtggctcacacctgtaattccagtactttggggggccgaggtggatggatcaacttgaggtcaggagttccaaaccagcctggccaacatggtgaaaccccatctctactaaaaatacaaaaattagccgggcgtggtggtacacgcctgtgatcccagctattcaggaggctgaggcaggagcatcacttgaacctgggaggcagaggttgcagtaagccaagatcacaccacttcacttcagcctgggtgacagagtgagactccgtctcaaaaacaaaaacaaaaaaaaaggcgcaactaccatgagaaaattggttaaaggatattcacaggcaattcaaagacactgaaatgtgtgcagcttagtaagtgctgtgatgcacccggctccctccttcagagccgggtactccttctccaatgctgggagtctcagtagcctgtggttactccgtgagtctctctctaggagtcgtcatttattcagaacaaaagtatatcctagctgggcgtggtggctcacgcctgtaatcccacactttggggaggctgaggcgggcggatcacttgaggtcaggagttcaagaccagcctggccaacacggtgaaaccccgtctctactaaaaatacaaaaattagctgagcatggtggcgcatgcctgtagtcccagctacttgggaggctgaggcaggagaatcacatgaacctgggaggtgtagttgcagtgagccaagattgcgccactgcactccagcctcggcaacagagagagactctgtctcaaaaaaaaaaaaaaaaaaagaaaggatatcctgccattcctatgagagaagtcacagagaagtctgaaatacacaaaaaagtctttataattaagtggtcttcactttttttttttttttaaatacacagaattttgctcttattgcccaggctggagtgcaatgacacgatctcggctcatcgccacctctgtctcccgggttcaagtgattctcctgcctcagcctcctgagtagctgggattacaggcatgcgccaccatgcccagctagttttgtatttttagtagagacggggtttctccatgttagtcaggctggtttcgaactcctgacctcaggttatctgcctgcctcagcctcccaacacatttttataattataattgaaaatagtcttcacagtttcattataataatcatgtcaatttcctaagtttttaaaatttaatttaaattaaaaccttgaatttcctttagtttttaaaatttaaggacttaattctcttccacataaaaaagtggcccaatttcaaggacttcatgtctaaaacaccaaaagcaatggcaacaaaagccaaaatagacaaatgggatctaattaaactaaagagcttctgcacagcaaaagaaactaccatcagagtgaacaggcaacctacagaatgggagaaaatatttgcaacctactcatctgacaaagggctaatatccagaatctacaatgaactccaacaaatttacaagaaaaaaacaaacaatcccatcaaaaagtgggcgaaggacatgaacagacacttctcaaaagaagacatttatgcagccaaaaaacgcatgaaaaatgctcatcatcactggccatcagagaaatgcaagtcaaaaccacaatgagataccatctcacaccagttagaatggtgatcattaaaaagtcaggaaacaacaggtgctggggaggatgtggagaaataggaacacttttacactgttggtgggactgtaaactagttcaagcattgtggaaatcagtgtggcgattcctcagggatctagaactagaaataccatttgacccagccatcccattactgggtatatacccaaaggattataaatcatgctcctataaagacacatgcacacatatgtttatagcggcactattcacaatagcaaaggcttggagcctacccaaatgtccatcaatgatagactggattaagaaaatgtgtcacatatacaccatggaatactatgcagccataaaaaaggatgagttcatgtcctttgtagggacatggatgaagctggaaaccatcattctcagcaaactattacaaggacaaaaaaccaaacaccacatgttctcactcataggtgggaattgaacaatgagaacacatggacacaggaaggggaacatcacacaccggggcctgtggtggggtccgggggatgggagagggatagcattaggagatatacctaatgctaaatgacgagttaatgggtgcagcataccagcatggcacatgtatacatatgtaacaaacctgcaggtcgtgcacatgtactctaaaacttaaactataataataataaaatttgaaaaaaaaccaatttgcatttatgtagatgacatgttattgtctaaaccaaaccttttttggtatttgtttgcttttacgtcaggctttgaagttgctaagaaatttgctctgccctccctactctcctcgaaggagatgtgacctgttccctggattaccctaaggatccaccacccttcagtaaccgagggggccaagggccaggaaagcgggcagcaactgaattcctctctgggatctgactgtcctcagcagagagaaacaccacacggactggagcagagccacagttctgtgagctgtgagttcgtcagagagatgtccctgacaacaacagctgggtttgtgattgtgatttccctggcagctctgtgaatccatgtgctcatctttcctgacatgagcctctcccccttgcacaatgcaatggggtttttactatccacctggagcagttgaggtccagagaggccaaggaaataagcgagaaggacaacagcaggattcaaagccaaatgccacatagcgtacatgcctgaatgagggcatgggttccctaagaagccctcccttcctttatgctccacaggctcctgtgccattcccaattatgccccgttggaagtatcttggaattctttaactattcttgtacacagctctaacacctctgattgtcagggattcatgtatacctgtggagtctaaagggtgcagcaaagcagttaattttctcagcaaatcatccactggtccatatagcagcagccttagataggcaaatcggtgttccctttgccctctttgcctcccttatgaccccgtttctttgcactccctggcctccccttggattcctactctgttatagagtgatagcatcacatcctgaggtcttcaggaattaacgtctttcaaaatagtcagaggagcatcataaaacaagtctttctcaatcccagcactttgggaggctaaggagggaggatcgcttgagcccaggagttcaagcctagtctgggcaacacaaggagatctcgtctcttaaaaaaatgtaaaaaattatctgggtgtggtggcatgtgcctgtggtcctagctattcaggaggctgaggtaggaggatggcttgagtccaagaggttgaggctgcagtgagttgtgacagcaccactgcagtccagcatgggtgacagagcgagactgtctcaaattctcacgccccaaaacccaagtcattctctttctaatattgattgccttccatagcttgtggtttttatgctaacagagtttctgccactctatggtgactatctagagacaaaccttcactacaagaatggtggggttatatgttgggaagaagtgggcaaggggaacaggaaacctcattatgctaccaccgctcctctcccaggtggcggaccccttgagggcagggatgtgtcagaatcccgcctgtccccacactaagcacagggtctgttgcaaggggaaagctcagtgaaccttggatgagtgaatgaaaatactcgggctgtaggaaatcagccctcaacgacatccctgaagcccgtgcctccttcatatgtgcaacccactttgtcccccacccactgcctctggtgtgactcactttcattcatccatttaccaacattaagaactatgttcactgactgtgctggagccctctggaggggccagacaaccccaacagttgcaacactgtcttccgctgctaggatggggtcgacacagggcacggtggggacgcagaggaaaagggctggatccagacacggcaattgggaaaagcttgaagttctttctagaagctgtaaagttccgggccagaggtagggacagggcgaggggagccagcagagagagagagctggcctgcagtggggccaacaaaaaatgtggccagccgctggccaggaaggggagtgagaagcctcaaatgaagctttgacattgtttttctttcttctggagtgctgccatgtgccgccacacagagcatctcacgggtagatgcgtattattgcaatgtgtttatctaggaaaccagagcccagctccagcatctggttttcagcacaatcctgagtgaagtccaattttccagttgggttaatgaaaataaaacttgggaagttgtgggctggctgcatcaggggctgaattctgggctcatgcagggccatggattgcagagccggaagggcttgggcaggtcatggatttattgtggacaaccttgcatggggagggagttgctgcctggcctggctctgaggaacacgcctcacagaggaatgatgtctttggattttctctgtcttaacctgacaccagttgacggagcacctactttggctgaaacactgggctgcgttgtggggcaggggtgaagcacaggtgtggaccagtgcctgagcccagcttgctcgagcacagtgcagccaaggagagatgcccgaacacacaggcatcacacaggtggactgctgagtgggaccctgatagcttgtcagggctcaccactttgaagctgtctggagacctgggatccgagagagactcgtttttaaaagccagcttaaaaaaaggcgtagccaggtttcagggagacctggaaaccagaactaaaagtccactggctctctttgcatctccgtctgcaagtcttgagtatttgtttcatgtttctctctccttgcagaacaggtttctctgatcttcagacagtgtggcagaaaacgcaattgccctacagctcctgagtccacatgagcctctttatctctctctctttcttcccccactccaagttccttggggtaaaggtgctagttagctctggcaggtgacaggctcactattggtaaaatcagaggtggctagggggtcagagtcacatgtatgaatatggctaagaggagcccaccctgaggtcccatgcctgggggttcttgtttatagaaagtgtttagtagtgaactgcaagtcacagacagctgcttctttgatgtgactccacccttgtgagggagacaggacagggaaatgggggccagccattagtgtgagagtaaggctggacccagggctcctgactcccagcccagtgctctttccacactctgttccgctggtcctgatgtggagccaacagttttgaaatggactgtgcctatgtggtttcccctcgggagcagctgcagaacgagcagtgttgattaaataggattttgttggcaggccttggaacgagtggggagccaaacaccagtggtgtggctagctgcaacccttggggaggttatcagaaggcgtgtgtcatagatcctggacagggtgacctctcacagggtgtcaggatcctgggggaaggatgggcccttaccaaggatggtcttccttaccccaaggttgcttcctagacagaatgtagggaaggcccaggcagggcagggaggaagagcctctctctcctgagtctcacctcacactaaggaatcacactgagtcataaaatggtgttaggggaagaggcctttctctgaagctggagaggagggtccccaaggcaggccagagagccagttcctaaaggactataaggggtaggacatttggtgtctccttggtcatccgtaatcctgctgaacaatgacgctttccctcattccaccatcttggtgtgggaagggatacttatgtttttcaagatgctgtcagttttgtgtgcaccttgctgtccctgcagctgtctctccagcacctcatgcctggagtcactgatgttcccacttccaggcctgagcccatccgggagcctgagccaatactgaaaacagccccaatcccattccatggggcttggagtcatcttcctgctggtagcaccaggctgggcttcctgctttgctgtgttggtatatccataggactggggtctcgccttggtctttcttcctagttcacttggttatatttccttgaacccttcctgtgggtctctacccacgttttaagccttcctggggctctatacctgcttataaactttggcccattcctccagccactgatgaagggaaccctgggcatggtgatgaaccttcacctggcttcatgttacctcccatctctatcatctctgccaactggcctggctatctttaatagtgatgtcaactagggatgacctctgaacagtttaccagcccattttgcagctgggctggaacctgtggctcagggttagtgaggaggctttctccattttctttgttcttctccttggccctacattctttctccatgagcccattctaatgacacttggcatgggctatgcttcctgtcccactgagccatgcccaggagtcttctctcctttccatttgtctcccttctgttggttgcaaaggtcattaggagtccattgacagcagcccatcccccagtgagtagatctcctcatgtactggtaagggttactgactgcaagatcacattcctcatgtagacatctcccagagtattatgggtcatcccgcatcagctcatcaacccatgtgattaacctgagtcaaggcaactctggccaaagtgaagaaggagaaagtcagactatatatattctttattttttggttttaattctccctgtcatgatgcaggcaggtattacctgagcacatgcaagcctgacttatcctaatctctttctcatctaggtgctaaaatgacattttctctgaacttgggactatagaattcttgctagtgcagggtctgttctgttcagtcaccacccattcctcagacatggtttctattgccttttgcccacagctgaaattcccccatccatccatccatctatccatccacccatccatccacccatccagtcatctaataaatgtatctgccaagtcctgtgtaaacaactcaggcatggtttcttcctgcaaggagccttgtgtctgcctcaagccctgcctctgtctggcaggacctggactgtctccagctggacttgctaatatgtctccagtctaggctcattcttatggggatagcagacaatggcagggagactggcaataaacatgtaaacatataattaattgtcaactgctaattggcttaatgttatataaagaataagactgcaaaagaaaatgacaacaaattatgagggcacctacttaggaagggtattaggagtaggctttctgaggaagtgacctttaagctaagatctgaaggatgtcataggggaaaaaaatgtgcagagaacagaaaacaaaaagtgctaaggccctgaggtggagaaggaaacatgttccagaactggaaagaagcttgatgtggctgaagtacagcaaatgagaaagtggcataaaatgagaccagggaagaaggcaggagacatattcatgcacagctttttggccttggtgaggaagttataaaaggaaagagctaaagcagaaattgatgtgatctgatttaaaagattgctctagctgctacgtggaaaatagattggagagggggtcacatggaagcaaggaactgctggtcttttagccaagggatgatgggtggcttaatttgatgggacagcactggagacaagtttggggtatagagtaggatgtggtgggcaagggagacttcatgtacttttgccacatttctgcttgagaaactgagtgaatagtgtaggggtgggttgcccctccacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattcatcatttgtgggtgtttctcgaagagggggatgtgtcagggtcacaagacaattgtggggagagggtcagcagacaaacacgtgaacaaaggtctttgcatcatagactatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacgggcaggagacagatgccttcctcttgtctcaactgcaagaggcatgccttcctcttatactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccatttaactctgagttgacacagcacatgtttcagagagcacagggttgggggtaaggttatagattaacagaatctcaaggcagaagaatttttcttagtacataacaaaatggagtctcctatgtctacttctttctacacagacacagtaacaatctgatctctcttgcttttccccacaaatagtggtgtctttaactgagatatgaagatcacaagcagagaagcttccgagttcagggaggaaatccagagttcggatttgagcatgttaagtttgagatctccgttagacatccacgaaggtcaggtaggcacttgaataaatgagactggaactcagaagaggcttgggctggagcgaaagctgaattgtcagcatatggagaataggtaaggtaggagggacaccctcttatctgtttccctgggagccttgcactaaagctaaggtctttcaaacagacttgagtaaaggcatcaggggtgggggacctggaatacccttccaatatgagggctcttgggttcctgcagggccaggactgtgcataatagtgattcaactggggcaggagaactttcttggctccactggggctggcctttcttaggattgttttaaattccattgattattctttgctttgctctggaaacaactactctttatgtaagccctctctgaaagtgacaaatcatggaaaaattcttttggatttgaatgcagtgaaggcagagagggcgcatcttgctttgtggtgtggaggccatgctgaggatgtgccgcgggccagagagctggaaagtgggttcaggcagccaggctgagtcaacccttcacccctgagaaacccacgcagagcatcacgtgatgtggaggaacaggggcactgagtcagtctaatattcaaggcaggaaaggtagaattggaaagggaggagaaaatgtcattttggtgtggcaggagaacacgacatgcttctctggctgccaggaagaatatttcctgcctagggctctggattctctatggctgagctctctgggatagagaaggagggagatgttcattcccatttggagatgtgggctgttttcttggggcatctgggctggtacttgtgaaaaggataggacttcgataggtacagttttccctttacctgctgaacccttctgcatgtcaaaaaaataaaataaaataaaataaaaaagttcccaacttgacctcagggacctccttccccctaccatggagattcctgctgccactcttcttggctttagaggacacacttgaggaagcagagtcttttctgatgagctccttgtccctgcttaccagatgtagtgattcctgagctccttcaggggtgaagtgtctcagcagttccttcctgaatcgtgcctctcctctcctctggctttctctctcagctctctcttcctttgtcatatttttatttcctcactttccctcccacagtggaatgaagcaccgtattgagtagaggctgttggtgttggccagagctgtagaatgctgatggaggaacaggaagtaagtgaggaaggggcaagggtgcttctaagtgctctgtgcactgacccagaaggtcctttttggagccacagggctgtggtcctgagcatgaaagaggagggctggggtgaggatcaacactccagagggccaggaaagggggagccactgtctccatgggacatttctggaagacagttttcgaggtggtatagtggcacgacagttattaagataatgatgaaaaaagattagaggaagcagcattgaaagcagcagcataaacttgtggagatgggggtcagtgtggccccgatggtcctcctccctccatcacccttctcccacccctaggtgtgtcaccctgaagctaaaactggtcctgtatggatgaggcaacataaatgggaggcaaggcagcagctgttgaaaattcaatcgcggaggcctctttggggcatatgtggcctaggagtggctggcacagaagtgctggaagtaaaaccacccctgcccctttcttttctctctacctcttatgagttttatggagttagtattcctcccctggacaaaaactccaaaggccttccgacttcctcagtaagatccaaagttcttctcatggacttaagaccctctatgacttggcctcccaccccttctcctggactctcttttgtgtactctattttggctgcactggcctccttgttcctggaagatgccagcgtgccatgccacgcggcttcacatctgctgggccctctgttgggacgctcttcttgcacagtgccgcctggctcactccctcactccttctaggcctccgttcagaggctcccttaacaaagaggctttctctacacaccccacatcaattagacactttcttcactcacactcccactcgccttaccatgattaatttttcttcgtagctctttatcatcaccacataacatattctgtatcaatctctttactgtctatctctctctgcctgaatgtcactgttttgtttgctgctgcattcccgatgcctagaagaatgtctggcacatgcaggctttcaataaatatttgttgagtgggtgaatgaatgactacatctgacgagaagagaggctttggtcactctttagcattgatatgtaatctgttgagtgcgtgtttgctgcatttatcaacattcttttaaaactagattcattttctgatagtattatctcatcagtcaggggaccgcctgagcattaggccacaagccaggctattcctggaaggattgcaggacaggcttgcaggatgatgcacaggctggtaccctggggctcttcatgtttgagaagagagccatggcacttctgggatgttcacagtgacctcactcttatttgattttccctggaagacacctcaggctacttccttctctgaggatgaagtagaggaaaggagtgtattattagtcagggctctctagagaaacagaaccagtaagatatctacccatccaccctattggatatatatcctatcgagtatatagatacacacatacatacaggaggaagagagggggaggggggaagcgagggagagagagggaaggagagagaaagagaatttgttttagggaactggctcacatgattgtggggttggctagtctgaaatttgtagggaaagctggcaggctggaaactcaggaaattcctatattgcagtcttaaggctgaattccttctgtttcaagaactctcagtctttgctcttaaggccttaaactgatgagctaaggcccacggcagtatggagtgtaatctgctttactcaaagtctactgattcaaatgttaattacatgccaaaatcaccttcacagcaatgtctagactggtgtttgattgaacaactggccaccatagcctagtgcatagaaataactatcccggggactcaccctggcagcaatatacatgctggtgaacagtccagtagctgcagtctcttagaattaggaggagctgccaaggtgccttatctcattcatgcctctggtggagtcctcctgtggcaagtcacaccagtgagcagtggggccccatcaggaaggactgggcgggggtgcccaagccccttattctgccttgttctggccctgccctggcctgatccttaccccaaacccatatccccggggccctgagtcatacctagtttttcccttttgtcacttcatttattctgagctccaggactaaaaagagagaaatcagtcccttttcacatggagcttacattccagttggaagtcagtcaatcatatgaacaaataaacaaaaatatttcagcccgtgataaatactatgaagaaaataagacaggacaatgggattggtaatgatggggtctcacctttctgaggaggtgccatttgaactgagaatgagggatgcgtgggaatcagtcatgcacagatctggggagcaggggggtcagcaagcgcaaaggccctgagcatgcaacttcttgggagccagaaagaaggccgtttgctaggcgcacagtgaaagagggagagtcacacgaggtgaggtcagagagaaagagaggggccaggtcgtgggggtcttgcaggtcatggttaggatcctgggacttgattctaatttcaaggaagctgttggaaagtctgtagtggtagaatgctataatctcacattttataaaaggtcactctggctgccatgtagtgaatggaccacacagggaaagagtggaagcaggatgccttgttggagatgtcacccaagccagagatgatggtggcttggagcggtgtgacaacagcgcagatgaagaaaatatacatttggtgcatttttggaggctaaaatgacaggcctttttgatgaattggatgtggcagatgaaggaaagaggaatgaaggaagattcctgggtttttatctaagcaatgtgttgaatggtgctttggttaactgagatgggagaagcaacagctggtggagggtgaaggtgggcaatcgggtttgtaatgcctcttaggtatgcagggatgtggtcaggcctggtcacctactgctgccagcttcaaagtggcagacctgagctgaaacctggacagggcgactttttcccagtggctgcctggaattcacttgctttcctttatcatcaagctcaccgttggatggtaaccccatgagctatacctgcggggagttctacctgagcttctcagctctccttgtatcttgagcccatggctcctctctctctgaggcagttcctgccttctgttgaattcagctcagttccacaagttcttatggacaccaactcagtttcagatccatgctggatgttggtagcacaaggaccagcaaggcatggctaggccagcttccacagttcctgcttgctctctggagcaggacttttaaaacctgggttcatggatggactgtgtattagtccgttctcatgccactataagggcatacccgagactgggtcatttataaaggaaagaggtttaattgactcatagttctgcagggctggggaggcctcaggaaacttacagttgtggcagaaagggaagcaaacacatccttctcttcacgtggcagtaacaaggagaagggccgagcaaaagggagaaaagctccctataaaaccatcagctctcatgagagctcactcattatcacaagaacagcatgggggaactgcccccatgattcaattatctccacctggtccctctcatgacacggggggattacagaaaccataattcaagatgagatttgatggggggaacacagccaaaccatatcagattgcaagggaaagatctgtaacttcccagacatgtggtataaaatttgtgtttaggtacattaatgtggtataaaatttgtgcttaggtacattatggtattcatttttctaggaaggggacctatggcttctaacagacactaaaaaaaggtaggtgacccccaaaatgccaagactgctattctgcgggtgaagcgcccaatgcttaatccctctccctccagtcttgagtcatcaccagcatccagcctttctcaaccttgcagctgcttcaggatgtgacagatgtgataaaatgcagggcaggtcgggataggccaagaagcaggaaggggctggatcttagggtgtgtgagggacaggtacagaatgcccctggagagagtgtggggggcttcaaatgccatctgaggagtctggatttacccctgcgaatgatagggagttagaaagcatcttaagcatgggtgacatggacaactttgtgtatcagatagtcctctctcatagttgggtggagcgtggacaggagatgggtaaggctggagagggagagtcaggaggaaagaatgggagatgagacagtgtggatttggagtggaaggaagaggaatggagggagtggaagctaaatgaccactgcctgttgctacagagagaggctattctggaaatgctgagcttggcagaagaggctttgggggctcaggggagaaaagaggggtagcttgttggccagagaagtggggagacacctgggttgaatgagggtctacaggaaggctccctggaagatggacagcctgactctgcagtgtggccaggcttctcttggaagacactctcctgaagtccttgtgggcaaatgatttgggatcagggaagagaggactgaaagtcagggaggccagagggtgcatggcggactgtaggcccctgcaggaggagaactgggagaggtcagaggctgagggcgtgcagagtctcaaaggtaggctaagcaaaagcagggaaatcaggggaaggatggaggctgagatcactaaggggcattccacaggaacagttgcttcctcagggtgaccatgcccagtgcctctgtatatgctcttccctggggctagaacactccatcctccttcccacacgtgcttggtgtcacgccccaggctctcgtccttctgtgacctcgagagcagagccagtcacttcctcctccctgctctcacagcccctgggcttgcctcctcaaagcactttgcaggctggattgctggtgactgtgtgtgcttgctacccccacccccaaccaggagactggacttcctgggggacaggcttgtctgtcatccatgggtcccctgagtctggtacagctgattgcagccctgctatggatattgaactgttaggtcctgagtgggacactcctgccagtgggtttacaaaggagccagtgtaggacataatttaaaaaagtgtttgccaatttattataaaggatattacaaagaatacagatgaacaacagccagatggatggaatagatacctaaggcaagagatgtgggaagaggcgaggggctccatgccctctctggatgcaccaccctccaggagccttcaggtgttcagctaccaggaagctccctcaaaccaaaccttttgtgtttttaaaaaggatggttagttgccttgaagtaggtggcgatgccttaactgcatgcatgctgtcaggttgcagggtctcttccgtcattgtcaaggggagtgctaactttccctcctttcttaaaacatgcaacatgatgttttaatgtacatatgtatgcataatgtacatatgtatgcataatgtacataggcaggaacttgctgtgcaactatcagtagtttctttctatccgtagccgaagcagttactatggccgaggaaactgacatatccattatctcacatagttacctttctttctttttttggtgagagtacctaaaatctacgctcttagcaaatttccagtatgcaatacaatattaactatagtcctcatgctgtccgttgaatctctagtcttattcatcctatacaactacatctttcaaccctttgacctacatctgtccagtccctcccatcaatcatcattcttctgtttttatgtattcaatttttttaagattcatgtgtaagtgaaatcatgcagtgtttttctttctttctgtgtctggtttattttactcagcataatgtccttcaggttcatctatgttgttacaaatggcaggattgctttcttttcaaggctgaataatatttctttgtgtgtgtttacatttatatataaatatatgtaacacacatatatatgtttatgtatacacaaagaaatatatatacacacatatatttatacatatacatcatgatttctttatccatttatctcttgatggacacttcggttgttttcatatcttggcagttttgaataatgctgcgatgaacatgggagtgcagctatctttacaaggtggtgatttcatttcctttaggtatatacccaatagtaggattgccagatcatacagtagttctatttgtaactttttgaggaacccccatactgttttccataatggttgtaccaatttacattctcaccaacattatacaagggttcccttttatctacagccttgccaatccttgttatctcttgtctttttgagaatagccagcctaacaggtatgaggtgatcactcattgtggttttgatttgcattgtggttttgatttatcttttattgtacctgtttgccactagtgtatctttctctacctttgttttccctcttctttctttcctgcctttttaacctcacctctcacttctcctgaaaagtcctttccagtcttctactctgttccaggaaagggtaatagaaagatccaaacaaatgatggcctcagacgtgctgggcccaagcagccccagacacccactgtggcctgatcttgccctgtggacccctctccgcagtacgtttaagctggaccagcctttagtgggcgtggtggggtgcttggacagtcgccccctgcctctaccataggagatctgggactgtctttggaaacctcaataatgcaggtgagaaaataggcacagagaggggaaagaagctgctgatagttgcaagttcctgggatgtcaggcttgctctgccactccgaggctgtgtgatctagtgctagcctcaacttagttttcacatctacgaaatgggcataacaagaggagaattaattgtgaaggtgttctgaaagttttttcacatctgtcactgataaacagtgggccgtacctaggacctaaatttcttgatttccagcctcatactttttgtatccatcaaatatgtttgatggagctaagggtgaactgttctagctgggatgtgcagccactctgggcacagaaagtcctcagccaaccactgtaaatgtgctgacttgactccacacagactttttactatatgctggagatccagtagagaggaaattgtgggcagcaaaaggaagtgaaaaattgctccctcaccctcagcaagggttcattattaattcaacaaatatttattgaggacctattatgtgtcagggtttgttccaggcactggagatacaatggtgagccagacagcaaagttcttgctctcatgaaaattctggatctttcttcacctctgatatcctgacttatcctgccctaaagtagtttcagcctccccaaaccaagggccagaaggcttcttcccctccaccctggatcccagtccctgctgtctctaaattacagctctgtttcctggggcaaagtgccaggctcagcaggaacactggcaaggcctttggaagccaaagataacacccctcatctccccgcaactcttccccaggagtcgtggtccccttctgctgagttctgggctttgtcagggatgggctgccctctgggggtctggctggactctcccagagcagctgagcttcaggcaggctccctctgccactcttctacctcacagagaattcagtcttactcgaaatccccagcctcaactttaggcactagctcgagccttcctaaaatttcccagtgtccacatttctaatgcccaggactctgcttttgctccaagctcagaagcccaggtctggagcctctgagaagtggctgacaatctccagggttcccaggctgccctgttgagatggaggcagcctgggctgatactagagccctaggatgggcacaggtaggcctggagtttggtcctgtttctgccacttgcttcctatgtgatatggggcaagtcactttccatctccgagctgaggttacttgtttgtgtgttcattcatccattcacgcatccagcaagccttttgactactcttcacctcctgttgggtcaagtctcagctccttgacacagtatctaaggcccttcacagtctgtaccatctaggaggaagctggatgagaggttttgtttcctgaatggctcttgttctgccctctgtcttaccagttcttcacatgcctcatctggaaccccagctggtctcctgtgccaggcaccctggcaggggcacactctgggcatctgagcacagggaagctctgtctttctctaggaattctggctgcctggtgctaacagacagggttttgaaagacgattttccagttcctgagttcaggcctaaacttggaggtggaagagagggcaccgaggagtaggttatttcaagaaccagggagggccagctggccaacaggctcagagaggtagcctctgggtggacagcccagggaaaaaaaaagatgggaggacaaagggttctgtagaagctgagacctggaagtggacatgggcaggttggtttgactcagaaattgggacttgaggttgctgctgccttggtggccagactttagaggagagcacagcttggatgtgttgggaatgtatcctgttccatcactatgattgtggtgattagttcagggatgggtacatggcccaagagtggtctttctgagtgaattccaggaattgatcctgagcattggggaagagacttgttcttttcccattggacatgtatgtgggaagatgaagcttggaattgctggtagccatttttccatagatgtaaagtctgagattgaagccaacagagacagagcagagcagaggtacagctagactgggcaatgtcattctttgagcctagtgtaaagctttgcctgaagctggctgtccctggtcttttttagtttcatgtgcccttttttgcttaagccagttagaatttttaaaaaatcacttgcaaccagaagagtcctacctgacacataaccgatgataaaattcgtcttcagaaagatcaatgtgataggggaagagccctcaagaaatcatcagacctcagtcccacaggaactcggtggagctcaattgttgatgactgccatcttgtgtgggatctaatgggggccccactgatctagagaccaacagcctgggggcccaagacagctgctctttgattccaaatgaggtatgaacagaacctgtccacctggacaccgaggcacctgccttgttgtgccacatgtatctgtgactaagaggagatttggctggttactgcctagctctgtagcccagtcagctcacatagtccagggaaaagggattagttagacatcaggactgggacttggaaaacccatctggggtggagggtgcttctgaaaggggtctacttagaaataaaggcgagagaaatcctgtgtccctctgatgtccatcatagccgtacaagctgccactcctggatatgacttaaccttttgacagctcttccccaaatggacttctgggtctctacttggacaaaagagggctaggcagagaattcagggcttttggcctgcagaggttgaaaatgtagcagagcagaatgaagattaaacggaactgaacactggaacgtagtacaattgtcccttgatttccgtgggggattggttccaggacctcccacagatacccaaatctgaggatgctcaagtccctggtataaaatggcacagtatttgcatataacctatgcacatcctctgtatactttaatcatctctcaattacagtcatgtgccacacaatgatgattaagtcgatgatgggctacatatacaatggggtcccctgagattaaaatggagctgaaaaattactattgcctagtgacatcgtagccctcataaaatcatagtgcaatgcatcatttacatgttgtgatgataaacaaccattcacattgtttctggtgtaaacaaacctactgcactgccagttgcacaaaagtatagcacatacaattatgtgcagtgcataatacttgacaagataataaatgactatgttactggtttgtgtgtttactatattatactatactttttatcattagagtgtactccttctacttataaaaaattgttaactgtaaaatagcctcaggaggtcctccaggaggtattccagaagaggacactgttaggataggagatgacagctccatgcatgttactgcccctgaagatcttccagtgggacaagatgtggaggtggaagacagtgatatggatgatcctgaccctgtgcaggcctaggctaatgtgtgtgtttgtgtcttcgtttttaacaaaaaagtttaaagttttaaaattttaaagagtaaaaaaaaagtttataaaaaatagatgaaagctcatagaataggatataaagaatttttgtacagctatactatgtgtttcaagctaaatgttattacaaaagagtcacaatttgcaaaaattaacaagtttacaaagtaaaaaagttacagtaagttaaggttaatctattattgaagaaagaaaaaacgtttaaaacaaatgtagtgtggcctcattgtacagtatttatgaagtctacgatagtgcgcagtgatgtcctaggccttcacattcacttactgatcactcactgactcacccagagcaacttccagtcctgcaagctccatttgttcattttttagtcttttatactgtatttttactgtatcttttctttgtttacatatgtttaaatacacaaatccttactattgtgttacagttgcctacaatattcagtatagaacatgctgtagaggtttgtagcccaggagcgacaggctatcccatatagcctaggtatgtggtaggctatacaatctaggtttatgtgagtacactctgtggtgtttgcacaaccaaatcacctaaagacacatctctcagaccatatccccattgttaatggatgcttaactgtactgataatacctaataaaatgtaaatactatgtaaatagttgttatactctatttcttggcagtaatgaagagaataaaagtctttatatgtttaggatggatgccactttttttttcgaatattttccatccacacttggttgcatccatggctatggaactcttggagatggagggccaactatatatagaattgtagttagtggccgggcttggtggctcatgcctgtaatctcagcactttgggaggccaaggcgggtggatcacttgaggtcaggagttcgagaccagcctgaccaaaatggtgaaaccttgtctctacaaaaaatacaaaaattaattgggcatggtggtgggcacctgtaatcccagctacttgggaggctgaggcaggagaatcgcttgaacctggaaggtggaggttgcagtgagccaagatctcaccattgcattctagccagggtgaaaagagtgaaactccatctcaaaaaaaaaaaaaaaaaaaaaaaaatagattgttgtttgctggatttctactcaatagaacagaaattacctcaatagtaaatattctatagttctcatttcagatgaaaattcagctgttctcaacgacttttttgttgtttgcataggtgatcctcaactttgatatgttctaattttcatgcatgtatctttcacttctgtgactgtatactgataactcaaacagatacttcatcctttagttgatgggtggtgattttaccttccctcttgtgtgaccacttgctaagtgctgctgcttggggataaaaggctgggtttctacagagacaaggggtatgggaagcgtttatggtacagctgcccccctttccctctgtgtgccaagggaatcccaaattttctgaatgcctggagtttgtcggttgataacaaattgttgtacaatgaacaattaggtgtttgcttcccaggcccatgctcccctctccaccactacagtccttgcatctggtaagggtgggaagggggttcagtggccactggtcctaggtgatggcaagggtggtgtcactggctggggatggtggagactttgccgtgccacaggggtggagaagatgagggcagagaggagaggtggaatcatggaagagaagccacaggctcgacctcccaggcaccagggagcaacagagggatgcttgtgaaagtttttatctgtcaggacccaagatagctataatgcatgtgacagggatggcaattttgcaaatataaaacagatatatttaattactcattacatcactgttttccctctgagatccagctacaaaaattatcactagagggcaggagaggtctctttagcaagaaacatgcgtcctagcccagggtactggcttctcccatagtgtgggggcagtgctgactaatgcttccctgttcacaacacgcttagaaagtgagaatatgcgtgtggcacactggggtcagctaaaggggatttgggaatgcctacatgggagctagtgaaaaaaattcacattttcttcatgttatattattacaataatatacaaaacaaaatattaaatgttgaatttatataatattctaaagaaaatcatttaaatattttattgttaaacatgagcttgcttcaaattaacatgtcttttttatgtagttttaggcttgaaatggctacatggaatttctgatcaagatttttaagggtttcttcattcttttttcaaatttcatttgtttctaatttttaaatgtttatagatttagtgggtacaagtgccattttgttacatggatatattgcaaagtggtgaagtctgggcttttcctgtaactatcacttgaatagtgtacattgtacccataatcatcattaacaggaaatttgtttgtacagattggtgataaaaagttaaaaacaattttgcacctgttaaaaaatatataccagttgaaatcatatagagactataacggcattttcttttttcaaacaacaaatgtggtattgaaattttttgggatgagcattggatttagcacccttcaaaccttttggattctagtgcacttaggtaatggtgaagccctaatctgcagaatacacatgcaattttacatcagatatcctgcaggcagtgtggaggtgactaaagaggctcatctactgagaaagacaggaacagcccatatacatcgagtgactgttgtcctgatttgtcctgaagggctctgattcattcttctgacatgacatgactatccagagcacttccctttgctaaaaaacaaacaagaagcgtgccagtttggtgttcatacacagtgtggatgaatctcgaaacattgcccagaatgaaagaagccagacacaaaaaagtacatgctgtatgattccatttatttgaaattctagaataggcaaaactaatttgtagtgatggaagacagatgagtagttgtctcaggcagtggtgggggtgagtgactgcagtggggcatatggggcatttggggggtaatgacaacattgtgtatcttgatcatggtagtggtgacactggtggatcacccatgtatacatttgcagaaactcatagtactatatagttaaaatagatgcatttcattatatgtaaattatacctcattaaagtcgatttaaaaaaagaaagtatactattttggacaatgaattttatggtttctgtacataggcgtgaagacagattcagggctgccatttctactgtggctgccagaagctccctcctgctctccttgcccccggccccatccctcttggtctgtgctctgtgctcacccgacgcaagggacacacactcctccagtgggtttctggctctgtccatgtgggagtggcacactatgcagcaagctgccaaaggacgtgtcctcgccgcttgggatgagatcactgtccttgctgtttgatggggcccactcttggctgccctccaaggagctgtaggtgaggttctccttagaggtacccagcctgtgcactttggctgccctctcacctgaggaccgagggcatcaccattgtgctgcatgcctgtggcccatctgaagcacttccacggggaagctctggcctagggaaggtacctgtgcctgtccctaaggctttctcatgaggctagagtagaaagggggaggatctgacataaaggaagcaaataagcacccatttcttggtcccagggaattgtgggaggaagaaggagggaggacaggagatggtggagagtggagggcagtggcgggggcagtgcaaggagaaatggagcgggatgggaagagaagttgagagtggtcagccagatgggtcttaaattccctttctgggctttggtctagagcaagtgttggcgaactattctgtaaagggctagatagtaaatgtctgaggttcgtaggatcatatggtgtctgtcacaactactcgactctgccattgcagtggaaaagcagccaaggacaatgggtaaatgaataaatgtggtcatgttccaagaaaacttaatttatgggtggcaaaattggaattcatgtaattttcatgtgtcacaaaatattcttctttagatttttttctcaaccattaaaaatgtaaagacaatttttttttttttttgagacagagttttgctctgttgcccaggctggagcacagtgacatgatttcagctcactgcaacctctgcctcccaggttcaagcaattctcctgcctcagcctcctgagtagttgggattacaggcacacaccaccacacctggctaatttttgtatttttagtagagacggggtttttaggctgggagccactgcgcccggcctaaaaaatgtagacaattcttagctcatcttcctcataaagtgggtggtgggcctaattcggctgttggggcatcgcttgccaactcatgtatttagtgtggggggtcctgagggtggaggacttagggaaaggtgtggctcttggaattctgagtgtcagcatagctgctcccttccctcactccctctgcccttctccattcaccaggcatcttatctgtgtaacccacagattgtaattatgggttctcaggcctgcaccccaacccaggggctgtgccatgctgtgtgtgcttcatagctgcccctcctggacctagtgcagggctgggcccagagtgggccttgataacatttgttgtctggaattaaatcagcagctcactagtggaatctgcccaggcctggctagaaactgggagctgtagccagtccctcctgccctgtcctcaggggccctcagccaccgaggatgcctgcctgttgctacgctggagaacattttgtcatgtttactaacaaggaatccgaggggtggagtgggatggggaccaaggagggtgttctgtaacaccacagggcagagagggatggagatggactcagggacaaggtcaggttacagaaatggactttggcaggagcattgacatggggcaggggcagagacagcaggaagcagagggcagggggagtgagatgtgggtttcctgtggggccctcccttcctgggcaggatggagagaagctagatgcctcccatgcctcccagggagagctatgcccaacaggcatgtgagagctcccttggcatccctggggactgatcacagagcaccggagactcaaactcacaactctcctgggttcttataagaaggaatttcaactctcagattttgtctgctgtgggtggcaaaggataattgctttgggaaagggcaattttgggtggaaggaaggggatctccctgggccccagtgttttgtggattgtgtgaggcacctgcaaggtcttggagaaatggtgggctggacaacaacagcgaggccctggcctaagctgacactgctgcttgagtctttaatgcatgtattcttttcttcacaaaggacattaaaaggagaccttttagcatcaggttatatgaaggacaaacaaagttaggacaaatatgggtcatcttcctggagcatcaatttgacgtgaacattggtggggaatagcacccccacctatgtttatattaaaacaaatatacatataggagtaaaatactgaatttgcatagatatatatttaaggaaatagggagcctggagagaaatttccagttttagaggcatatttaggcgatgctctcagacccttggaattcgtgttctttcttctgcccttagcactgtcactttgtctctattttacgaatgagaaaaacaaggtctggaggggtgcgtcagcaacttgcctatgtgataacacagaacaaggaggtaagggtaggactggaacccacattgctgggctctgcattcagcatgttacctgctacacaatagtgaatctagagtttcatgctttagtattttgatttcagtagtgccatggaaataaccaaatctcacctgtccaagtcgtctttgggcacagccccatgtttcaaatcaatcaagtctagtgggaggcaatgtggggtagtggagttaggggctgaaagtcaagagactggagtttacctttaaccagttctttagataataaagctccgtgactttaggcaaatggcttaacgcctccgggtttaccttccctatctgtaacatgtggtagctacacaagatattgcctaacagcctggccttctatgatgtgggaccactgcttgcctttctagaaccttcagacctgtagatgggctcttcttggacattctggagtccctgggggaaagggaagtctgaagctcagttggccacctctgcataacaaataccgagagcactgcaagtggagcttggacaaggtctggaaaatcagccttcttctggatgcctccagcctttgctatcatctgcctaggaggttggaagttactcaagcggctcaaggaaaaggtattgtgagcatgcaccaggtcatgtgattggaagggctatctgctcctggcctgaggccagcacccaaagctgtccacatctcccagggacagcagcatctttcttctttactacattctctctcctctcatcttgattggcttcctctgcctgtacatggctaactttgctaccagccagagtgggagtaacccacagcccctaagtcccctccagagagggctgtcaacagggctggctgctgagctggggaaggtgggagggtctcaccatcccatatgtagatttcacttaatttccctgctttcaggacagtgcttcacctttaacttcctctttgccaggtatcgcttatccttgagtgtctctggatcagtttctctggagatgaaattatctatggcctaccaggatagtttccaggcagtgcagagttgggaggaggactggggtagaaacactttcttataaagacttctgccctatccacctgttttcagccccatttttcaccctggctccaatgcatgaggctttgtggggtcggtggtcggaatttgcttgcttcttgctaacatttctctttgcattcactttggtttcagctctctctgctttgctaagctggttatcatccagcttcttacctcttccaataattattgacttctcttgtcctctgtcatgttcatgccattctctttgctcttgtgggctcactctttttcttttttaacaaaatttcattacttttactttagtgggtgtcaggatggaatggacataccacatgtgtttacacccccatgtttcattagaaatcctagtcactgttcaacacattctctcagctccatcagtcctttgaagctgttcttgtcaaggacaccaccatttccatgttgccaaatctcttggtcactttgctgtctgtcttcataatactcagtctctcagcagcattccacacacttgaccactcttgaaaaacttgcttcttttgaccttcatgataacacatgcttctgatttgtctgctacatccactgagcatgcttcaccctctcttgctatatcttcctcttctgggaattcccatggactctttctttggtcctcttcttttctctatctatacactttccctagctgatctcatctagtcctagggctttaaatactttctatataccaatgactctcacatatttatctgcagccttgatagcttccctgaatctcaactatctacttctcccagacatctccatttggatgcctaatagcatcttaaacttaactgggcaaacctgaactcttgattttcaccgccaaaccagttccttcttagtatttcccatcaaagtcatgctcatacactgagtggctgaaggccaaaactcaggatcatgcttcactctgctcttcctttctcctttcccatttactatgtcagcaagccctgtcggtgcctccatgatatatgattagtgagtctgcttctccattgccactgctgactgactgctcctgtcaaggccaccatcatgtgttgcctgggctattccagttgactcctgagtggtttcctggcttccactatggccctccaaggatccaccttccgcatagtagccaaatgattccattaaacatgtctatcaggttatgccactcctttgtttaaaattttccagtgatttcctgttgccttaaaataaatttcacacttcttaccaaggcctctgctcctctgcaaactctttctcttctttttagagatgaggtcttactattgcccagggtggggtgcagcagcttcatcatgtttcactgcagcctcaaactcccaggccctgtctcagcctcccaagtaactaagtcaacaggcataccccacctcacctggctaattttttttaaaaaagagatttggtcttactatgttgcccaggctggtcttgaactcctggcctcccaaagtgctgggattatgggtgtgagccactgtgcccagcctaaactccttttttttttttttttacacaggcttaatccactatggcctttctggtcatctcccattcctaccccaggacctttatacttgttcttccttctgcccaagaaggaagactgcagccacaatcttgatgcttactgcagccacaactcctcatcattcaggtgcaagctcatacattctcagagaggctctcttagtctattttatctaaagtaggaaccccttctcccaaatcatttgctagaacagtggtcccccaccttttcggcaccagggactggtttcatggaagacaatttttccaggaatggttttgggatgaaactgttccacctcagatcatcagggattagattctcataaggagcgtacaacctagattcttccatgtgcagttcacaatagggttcgcgctcctatgagtatctaatgccaccactgatctgacaggaggtggagctctggtgctaatgtgagcgatgaggagaggctgtaaatacagaggaagcttcacttgcttgctggcccacagctcacctcctgctgtgccacccagttcctaacaggccatggacaggtactggttcatggccctggggacccgtgctctagaacatcactttgttttgcttgtcttaaaaaattcatagtaggtatcattatccaaaattattttatttgtttacttgcataccagctaactctccccattaaaaaatggactctatgagaaagggtccttgtctgcattgctcatttttcatatctttatctaccacagtgcttggaatacaataggtgctcaatacatacatgtacaataaatgaatgaatgaccagttaagctaaagggactaggagtagagacagtccctggagagggggatgtgggtagaacaggcattccacagcgtgtctcttgaacttttgcttcattctaggccagagtatgacacaaagtctcctaattttataaagggtcagtaagcacaaattgaagggaaaggtgagggcaggggcagtggatgtggggagcgtgggacagctcaggaaaggtgcagtacgtgttgctctgcaaagattttgctccattcttttgtcccaagccgcacagcttttccattgtgacattctgtaactttctggaaattttttttttatggcccttgggtaattttccacgtggtcagccagctccgtcaagtgcaatggtgaggagtgggactcagaatggctgggaggccccgagaccatcagacagggaagatgcatgtcgtttgcacccggcactgacttccagctcccttttgcgtaggaggctcctggactgtgacatacaggatgttcctgtgtggctctttttaaggaagcctatttttcctccatgttaaaactaaaatctgtggtctagctcggagcagatgttaagagcacattctctctaagagtgtgggctggagtgtgggcaatggctatttatcaccgtttccttttctttgtgtttctctgtggttattgaagtttttggtttggggaaaaacaacaaaaacaaaaatagcaacatatttatgaacaaagaagagagctaaaacttaacatctggaagagaggaaagaggggagtaaggtgcctgaaaataatttcctttaggagtgactggaggcttcagggggatcacagcactcctgtggaatttttacagaactaaggaaggctggagtcagccaaacttttgaaacctcagcatcctaaacctcaactcttgctgccctgagaagagcatgagccggccaagccctggtggcggcttccccaggacctcccacttccttcctgatgtgcctgcagtcctggagctgtgatcgcctcttctttagcttcttagaaaagaggcggcacaagaaaaacgctcagtcatcttgcagagacttggcatctctcagcaacacgttctctctttctctcttttcttttttcctttgagatggggtctcgttctgccgccaggctggagtgcagtggtgtgatctcggctcacggcaacctctgcctcctgggttcaagcgattctcctgcctcagcctccggagtagctgggactacaggcgcacaccaccatgcctagctaagttttgtatttttggtagagacggggtttcaccatgttggccaggatggcctcgatctcttgaccttgtaatccacccgcctcggcctcccaaagtgttgggattacaggcgtgagccaccacgcccggccgacacattcttattaacttgatggcacagttggctggcaggttcccaggtcatgttctcagtgattggagttcttgctgtttcttggactccttcatgtctcacccagtcctaagtcccttccttgcttcttaattaatttatgtccttgtgtaatatgtggcacacccacatagccatgaggcatgttcaggctgtgttttttaatgttctggcttgttctacatttgccaagtgggcaaggacagcagttacctgattggctccatttgggcagcagaacctaaacagtgactacctgttggaatccacctggcctaggtatcttttgtttgtttgtttaaataacaacaagcatttcttatggtgttttgttttctcctgaactctgtaaagacaatggcaacacagaggtcagtctagaatgactatactggcactaggagatgagaactatacaagtggaattaagcaaatgtatagacacaaaatcatcacaaaaagggtgaagtgctgttcagttattgatgccagtccctcttctctaggggactgtgacagctgtagccagatgtgtccaggagattatctctgtcctgattctgtcagcatcctcttcatttattgtctggttttgcttctaagtcttcttctgcatctcaagctgtctgcatgccatactgtctgcattgaaatgatttgcttgcttaaaatgagtcttggccaggtgcagtggctcacgcctgtaatcccagcacttcggaggccaaggactcctgaggtcaagagttcgagagaagcctggccaacatggtgaaacctcatctctactaaaaatacaaaattagccaagtgtggtggcacatacctgtaatcccagctgagacaggagaatcgcttgaacccgggaggcagaggctgccgtgagccgaggtgccactgcacttcagcctgggcaagacagagggagactctgtctcaaaaaaaaaatgggtcttaatatcaatagtggggaattctcagtctctccatcagcaggtgctgaaagctcacaataaaggagaaaattttcaatagctgtttttttttttaagagatggggtcttgttctgttacccaggccagatgcagtagtgtggtgatcatggctcactgcagcttcaacctccctgggtcaagtgatcttcccgcgtcagcctcccaagtagctaggactacaggtgtgtgccaccagacccaggtgatttttaatattttatagacatcttgctatgttgctcaggctggtctcaaactcctggactcaagcaatcccgccatcttagcctcctgagttgctgggattataggcgtgagccactgctcccggcccagtagtcatgtttttgaggaagtttatttttatccagtatgtttggctctgcatgggttccttaagatactagggactgtctttgggtcacaaagccagcatgacactaacatgggtctcaatatcctttgcttgatagctttggacctgaacatcacctgacagctccacacactgtgttctggcttgttcctaatcctgccagttcctgacctgccattgttccatgtttggcttcaccttgtcttttgcacctgacatttggtccgtgctgctggctctattccacctatggcaacctgaataaaaactctctttccagccttgtttctaaagctcttccttggcccagatccccctaggtggcttctaccagccttgtccagttgaggagcatggcctagacacctgtgagggtctctgcctgcctccagctgtgcccaggattggcttctcctcagctgtgcctcatgctgggccacatcatgggagcaggctggtcagcaggggtggatgctgacctacaaagggctccttactgccaaaagtcattgattccccatccttctggtctaccattaaacatctgtagccacttagggttttgacttttaactatttcttgaccacatacctccattaccctccagagagcacccttttagaaataaatgtaatagttactacatttgttcaatgatttacagtcaacagagcactttagtatattcacatgtattatctcatttccatactttctttttttaagcaaacataaaataattttatcagatacaacaaaaattaaaacataacaaaagtatcacatataatgttatattcccatttaaatataacatagaaaaatactacaaaataagaaatacaaaaccaaaacctagataagattttatttattatgatgggtgtgcttgcctgttcataagttcattccagtctggaacacaggaagataatgctacccacatagctgctgcaccatttgatccattcctttctgttgcttttaactgagttaagatagaaaaccctagttcacacaaactagttgttgtgaatggtagtaatagtaggacactctttctacttaacaaaggaaagtcttcctttaccttaattcaaaatgctgataaatttaaggtctcataatcattcttcaatgtatatgaagaactaaactaagataattcattctcttcttcaggcaccagttattaactaagcccagttattgattctgggtttcaaaaagcaaactgattgtttttttttttttttgagacggtcgccaggctggactgcagtggcacgatctcggctcactgcaacctctgcctcctaggttcaagtgattcacctgcctcagccttccaagtagctgggactagaggcgcacaccactacacccagctaatttttgtatttttagtagagacggggtttcaccatgttggccaggatggtcttgatctcctgagctcgtgatctgcccgcctcagcctcccacagtgctgggattacaggcgtgagccagggcaccttgccgcaagcggatcttttacccaactattttccctgaatgtttcaaatttttcttctggaaagaaatggttaaaaatttgagatagagaagtgagattcaacaatgtctctaattttatttctttcaaaatgtttccattaataatattctcttcaatatgttgcaaaaatcttggaaacgtagtagctaggacagttacttgtaagtcttgcttgccataacaataatgtctttcgaaatccctggatatgtctgacatgttggaatacatcactgtttttcccccgtggttttaaattcagtttattaagaataccaaaaataccagttaaatatgccaatttttttatccaaatgtcatcttcaaaaatatttgccaaatgagatttttttcaatgagaaaaaaagtcaatctgattcctgagctcataaaccctgcttagtattttcccttgagacaaccaacgaactttggtatgacacagaaagtgggtatggttagttccaatctctgaacaaaacgtttcaagaagctggttattcagtgagtttcctttaataaaactgacaacttcactgcatttttcagtacttccatgagatactgtggaatttctctggatgctaaaccttcatgatgtataaaacaatgattccacacagtacaactattagtcacttctagtaattttttaatgactctgctgtgttttccagttacttttgctgtgacgtcacctgcaattcctttacagtttttccagtttaatttatattgaccaactctgtgcctttctaatcctgtaaacatatctaatctacttgggtatgaggttaaacttaaaaaacacaaaagaccctccataaaatcatctttccacgcatatcggacataaactgaatgtcttgtgcagctgccaatatcatcagtgctttcatcacactgctttgcaaaatctataccagactgttatggagtaataagcattgtttctaaacgttctgcaatactacaaatccaaagagataattgtgttatcattagatatagtttttaatttatcagctaatttctcatcaaaaatcatatgcattgtatccaaacatgctggaagaataattttttcagcagctgtgttagctatgttctttttgccacatgatatgcaactaaatatgatgatacggctctctcactaacagtagtagaacaactaagaaattgtgttgatcattttatgtcttctttctttcttcgaaaatattcaagaggcttatcaataagttcagcatgctgaatttctaagtgcctttttaatttaggttttaagctttcatttgcaagaatattattacaaataacacactgaggtctgtcattttcagtgggcttttcacatttgataaagccatattttaagtaatcataatagcgtcttgcacttaagtttttctttttgaaatgaggctcaaatgaagtttcagtttgcagattagagtctgtatttttctcagtattgtcactattcacacttccaaattcaacagatgaacttcagcatgcttctgtatatttcatttcatgattcctctttcttttaataaagaaattatgcatttaatagcaattttttccagtttgattaaaatggtataattggtactaactcaaaaaagaagaaaaaaatacacatatatatagtttaaatgacatcttttcaaaaactacactcaaagtttgcaattgaatctcagttgactatctccagtttcaagtcattgtaatataaaacttgactgcacaacattcactttgctaatatgaaaaccaagcgagacacccaagagcaaatgactgaaaaccacttcttagccaacatacattgtattcatcatatcccctccatcaaatacctttctcacatattgaaattgacctcactattccttgcaacatgcacaattcaggcaaaggatccatgcaaagcactttgatattttacactttttaagttatactttaagttctgggatacatgtgcaaaatgtgcaggtttgttacatacgtatacacatgccatgttgatttgctgcacccatcaacccgtcatctacattagatatttctcctaatgctatccctcccccatccccccaccccaacaggccccagtgtgtgatgttctcctccctgtgtccatgtgttctcattgttcaactcccacttatgagtgagaatatgtggtgtttggttttctgctcctgtgttagtttgctgagaatgatggtttccagcttcatccatgttcctgcaaaggacataaactcatccttttttatggctgcatagtattccatggtgtatatgtgccacattttctttatccagcctatcattgatgggcatttgggttggttccaagtctttgctattgtgaacagtgctgcaataaacatacgtgtgcatgtgtctttacagtagaatgatttataatcctttgggtatatacccagtaatgggatcactgggtcaaatggtatttctggttctagatccttaaagaatcgccacactgtcttccacaatggttgaactaatttacactcccactaacagtgtaaaagcattcctatttctccacatcctctccaacatctgttgtttcctgactttttaatgatcaccattctaactggtgtgagatggtatctcattgtggttttgatttgcatttctctaatgaccagtgatgatgagcattttttcatatgtttattggccacataaatgttttctattgagacgtgtcctattcatatccttcgctgactttttgatggggttgttttttctgagggttgcctgtttactctgatgatagtttcttttgctgtgcagaagctctttagtttaattagatcccatttgtcaattttgacttttgttgccattgcttttggtgttttagacatgaagtcgttgcccatgcctatgtcctgaatggtattgcctaggttttcttctagggtttttatggttttaggtcctacatctaagtctttaatccatcttgagttaatttttgtattaggtgtaaggaaggggtccattttcagtttactgcatatggctagcctgttttcccaacaccatttattaaatagggaatcctttccccattgcttgtttctgtcaagtttgtcaaagagcagatggctgtagatgtgtggcatttatttctgaggcctctgttctgttccgttggtctatatgtctgttgtagtaccagtaccatgctgttttggttactgtagccttgtagtatagtttgaagtcaggtagtgtgatgcttccagctttgttctttctgcttaggactgtcttcactatatgggctcttttttggttccaaatgaaatttaaagtagttttttctaattctgtgaagaaagtcaatggtagcttgttggggatagcattgaacctataaattaccttgggcagcatggccattttcacggtattgattcttgctatccatgagcatggaatgtttttctatttgtttgtgtcgtctcttatttccttgagcattggtttgtagttctccttgaaaaggtccttcacatccctcgtaagttctattcctaggtattttattctcttagtagcaattgagaatgggagttcactcatgatttggctctgtttgtctattattggtgtataggaatgcctgtgatttttgtacactgattttgtgtcttgagactttgctaaagtttcttatcagctaaggagattttgcgctgagatgatggggttttctaaatgtacaatcatgtcatctgcgaagagagacaatttgacttcctctcttgttatttgaataccctttatttctttctcttgcctgattgccctggccagaacttccaatactatgttgagtaggagtggtgagagagggcatccttgtcttgtgccggttttcaaagggaatgcttccagtttttgcccattcagtatgatattgcctgtgggtttgtcataaatagctcttattattttgagatacgttccatcaatacctagtttattgagagtttttagcatgaaggggtgctgaattatatcaaaggccttttctgcatctattcagataatcatgtgttttttgtcattggttctgcttatgtgatggattacatttattgatttgcatatgttgaaccagccttgcatcccagctatggagccaacttgatcgtggtggataagcttttggatgtgctgctagatttggtttgctggtattttattgaggattttcctatcaatgttcatcagggatattggcctgaaattttctttttctgttgtgcctctgccaggttttggtatcaggatgatgctggcctcataaaatgagttagggaggagtccctcatcttctattgtttggaatagtttcagaaggaatggtaccagctcctctttgtccctctggtagaatttggctgtgaatctgtctggttctgagctttttttggttggtaggctattcattactgcctcaatttcagaacttgttattggtctattcagggatttcacttcttcctggtttagtcttgagagggtgtatgtgtccaggaatttatccatttcttctagattgtttagtgtatttgcgtagaggtgtttatagtattctctgttggtagtttatatttctgtgggattaatggtgatatcccctttatcattttttattgcttctatttgattcttctgtctattcttctttattagtctggctagtggtctatctattttgttgatcttttcaaaaaactggctcctagattcattgatttttttgaagggttttttgtgtctctatctcattgctgctctgatctcagttatttcttgtcttctgctaggttttgaatttgtttgctcttgcttcactagttcttttaattgtgatgttagggtgtcgagtttagatctttcctgctttctcctgtggccattaagtgctataaatttccctctaaacactgccttagctgtgtcccagagattctggtatgttgtgtgtctgttctcattggtttcaaagaacttatttatttctgccttaattttgttatttacccagtaggcattcaggagcaggttgttcagtttctatgtagttgtgcagctttgagtgagtttcttaatcctgagttctaatttgatttcactgtggtctgagagactgtttgctatgatttccattcttttgcatttcctgaggagtgttttatttccaattatgtggtctattttagaataagtgtgatgtggtactgagaagaatgtatattctattgatttggggtggagagttctgtagatgtctattaggtctgcttggtccagagctgagtttgagtcctgaatatctttgttaattttctgtctcgttgatctgccagtggggtgttaaagtctccccctattattgtgtgggagtctaagtctctttgtaggtctctaagaactttatgaatctgggtgctcctgtattgggtgcgtatatatttaggctagttagctcttcttgttgcgttgatccctttaacattatgtaatgcccttctttgtcgcttttgatctttgttggtttaaagtctgtttcatcagagactaggattgcaacccctgctttttttttttttctttccatttgcttggtaaatattcctccatccctttattttgaacctatgtatgtctttgcaagtgagatgagtctcctgaatactgatgcgtcttgactcttcatccaatttgccagtttgtgtcttttaattggagcatttagcctgtttacatttaaggttagtattgttatgtgtgaatttgattctgttattatgatgctagctggttattttgcccgtcagttgatacagtttcttcatagtgtcgatggtctttacaatttggtatgtttgcagtggctggtactggttgttcctttccatgtttagtgcttccttcaggagctcttgtaaggcaggcctggtggtgacaaaatctctcagcatttgcttgtctgtaaaggattttatttctctttcgcttatgaagcttagtttggctgatatgaaattctgggttgaaaattcttttcttcaagaatgctgactattggcccccactctcttctggcttgtagggtttctgcagagagatctgctgttagtctgatgggcttccctttgcgggtaacccaacctttctctctggctgcccttaacattttttccttcatttcaaccttggtgaatctgaggattatgtgtcttggggttgctcttcttgaggaatatctttgtggtgttctctgtatttcctgaatttgaatgttgacctgtcttgctagggtggggacgttctcctggatgatatcctgaagagtattttcctacttggttccattctccctgtcacttttaggtacatcaatcaaatgtaggttttgtcttttcacataggtccatatttcttggaggctttgtttattccttttcattcttttttctctcatcttatcttcacactttatttcattaagttggtcttcaatctctgatatcttttcttccgcttgattgattcgggtattgttacttgtgtgtgcttcacgaagttcttgtgctgtgtttttcagctcatttatgttcttctctaaactgattattctagttagcaatttgtctaaccttttttcaaagttcttagcttccttgcattgggttaaaacatgctgctttagcttggaggagtttgttattacataccttctgaagcctacttctgtcaattggtcaaactcattctccatccagttttattcccttgctgggcgaggagttgtgatcctttgaaggagaagaggcattctggtttttggaattttcagcctttttgcactgatttttcctcatctttgtggatttatctaccttcagtctttgatgttggtgatcttcagatggggttttggcgtggacgtcctttttgtttatgttgatggtattcctttctgtttgttagttttccttgtaacagtcaggcccctttgctgcagatctgctggaatttgctggaggtccactccagaccctgttttcctggttatcaccaatggaggctgcagcacaacaaagattgctgcctgtttcttcctctggaagcttcgtcccagaggggcacccaccagaggtcagctggagctctcctgtaggaagtgtctgtccatccctgctgggaggtgtctcccagtcaggaggcacaggggtcagggacccacgtgaggaggcactctgtcccttagcagagctcaaacgctgtgctgggagatctgctgctctcttcagagctggcaggcaggaacgtttaagtctgctgaagctgcgcccacagccgccgcttcccccagatgctctgtcccagggagatgcgagctttaactataagcctctgactagggctgctgcctttctttcagagatgccctgcccagagaggaggaatctagagaggcagtctggctacagcagctttgccgagctgtggtgggctccatccagttcaaacttccctgtggctttgtttacactatgaggggaaaactgcctactcaagcctcagtaatggtggatgcccctcccccaaccaagctcaagcatcccaggtagacttcagactgctgtgctggcagcaagaatttcaagtcagtggatcttagcttgctgggctctgaggaggtaggatccgctgagctagaccacttggctcctaggcttcagccccctttccaggggcgtgaatggttctgtctcactggtgttccaggtgctgctggggtatgaaaaaactcctgcagctagcttggtgtcttcccaaatggctgcccagttttgtgcttgaatcccagggccctgggggtgtaggcacccgagggaatctcacctgggttgcgaagactgtgggaaaagtgtagtatctgggctggagtgcaccgttcctcatggcacagtccctcacggtttcccttcactaggggaaggagttccccaactccttgtacttcctggatgaggtgacaccccaccctgcttcagcttgtcctctgtgggctgcacccgctgtctaaccagtcccagtgagatgagctggatacttcatttggaaatgcagaaatcacctgccttctgtgttgatctcactgggagctgcagactggagctgttcctattccaccatcttgccagccacctacatttatttttttttttaagtttattgtgactcacagaattaatttcatgcctcactaatgggtcacacacatagtataaaaaatactcatagagagacatgttgtgccctttgctgtgttggtgcctcgagtatgtcagcttgatgatgaaagagactagctgatctgctagactgttgactcgtataagaatatcttgaagtggtaggaatgtatcttaaattttcattcctgatactttttcatgggaagcgtttttaagagtgccagctatgctctgatctagtgaggagccaatgaggttttccatggctaggtcaaatatcaggttggagctgatgatatatttttatggaactctcctggagtgcatccttgacctccagctcagctgctgcgacccggctaggcccaggaccacaagcctcacatctctccagtggagctgccattggccttgcccccgattccctctgaaacaccacgtccccatactctcttctaatttcttttgcaaagaagactgaaagccagcttatctagtaggcacattagggaccagccctataaaaaagtattaattttaatttcttttaaaaatagaaaaaaatgaatataaaatatataacaacgaacccaaactggattatatttgtctttatactcatgaattcataaaatataattttaagtattattttatggaggaaggagctcagaaagacaaacgtattggggactcacaaaagccataaataatttggccctgatattggccctgataggaccctgactcattggccattttggtgcattgacttgctgtgtaaatttggatatgtttcttaatataagggttttttttttctgccagaaaaatgggaagaaaaatttctgtacccgcttatttcccagggcttttgttaagacaaaggtaataactctgacagtgtctaaacttttcagaagattggtttatataataggactatttcaattgcacataacaggtatccatctcaaatcaacatagaaagaaaggaaatatattggtgatcataactgaaaactctaggtttcagctttaagtgtagctggctcaggaaacccaaaaattttgccaggaatctgtttctctcttttcctctcttgtgggcctgcttctctctatgatgaatttctttcctagcacacttttcccacatgttgaaagaatctcaaagactccaggttttcagaatccttaagcttgtgacctcagaagaagagactcctcctagagccccccctgttcctcagaggactccaactgctcattgcttgggcatcttggacatccctgtgtccaggggatgggtcttctgtctggccagcttgtcatatttgcccctcttcctccctattacttgagtggcagtcccacaagtctcccttggaagcaagggcagaaccatttctaagtgaagaaacacaagcagaccaaataacatgtccattccagggctgatcagtctgaggcattgttaaaattatccctcttgcaggacgttagaaccaattgagattcattcagaacctctacttaattttccagatgtgagttctgtgtgtgaccatcagggtttagtagatactgcacagactcatttaattgtcacaaaacctgtgaggcaattattagctctacttctacagataataaatgtaaaaaattattgagagcttgccataaactaagcactttgctaaaaaccctacatatatctaataaaaattccatgaggtgctgagtctgttgaggttctttagattgtaagcaacagaaaccaaatctagctagtcaggaaaagaacaaatgaattgaaaggatgatagagtatctaatggataccctgtcagaggaaggattgaacaatcaaaacttggaaggacaagaacccattcttgcctgatcttgtccccttaggaggtgaatttggggttaaacctggtgcagcactgctagctcctagcccctattatcactctgttccaaataccacgtttcagggtgggagaatctgattggcctatcttgggtcaggtgtatatccctggaccaatcaggttgaaggaccctgtaacataggcatggccaccaggctctctcaggtttatataggagctgtgctcagagaaatggaatccctgtgagctgattggtcactcaaagggagataactgcaagcacacaattctatcactcagggctttggcacattgaaaagtgggtaattgaagagcatttaatgaggggattaagtgagaagagtttagggaaagcaacaaaggatgttgcagtatcttggggctagtgagtatgggagctgttaccatcccaggcctgaaggggaaagaggaggtagtggcttctggaacctatggaaagagctgtcaaaaggctgcctgaaagtagtttcagtctctgggagagggtcataaccaacccttagcaacccagtggtgtgggtaccaggggaataagcaccaagatgtcactctcctcccaccttcccatttcatgggtgcaactagaagccagagggcaaaggagtccctggatgtggttcatataggccatcctcctgggacacaggtcagggtagagaggaatgagagcacatatggaagggcaaatagaagacatccaagacaataatacaaatcccagtttacagatgaataatctaaggcttgaaggacttagtgacttctttagattcacacaatcaactcaagggaggagctaggacttgaactcagcaagtctgactctggaacctgtgctcttaaccactaggctctatcatctctcggatgaagaccctgaattcagacagcagattgactgtgcacagctcagatgaattacgttatctcactgatccccttgtagtatcacctcttagctgcggcaacaacaagagctcctagtcctgcttcccagaatggtgctggaagattcacacttgccattttccctctagactctcccactgggattcgcagatctacagagtggtttgaaatatcagaggcagcccaagtagagtccaagcttcttgccaccaggcaggcagctctactctcctgtgagtagggatatgattgagatttaaattgaacttcaattaagtctctcctctcttagtcctcaggggggcattctcatgcctggactaatgcacttctgagagctaataccattatcagatgcctgttcatctcatataagtaggcctattagcgcctcatctgtcttgcctcctgtttcctgccactgcttagagcccccagacaagagcacttccaatcaggtatgcagagggaaatatcattaacagttataatattatctgtatggttttatttcatgtcccattattttctagctctttagctaataataggttatatctgttatacatttaatgtatgctaggtactgcactgaaatgtctcatttcatgttgacaataaacctaggaggtaggtaatatttaatccccactttacagatgaagaaaccgaagcttatagggcttaagtatgcctaaggtgacataattaatagacagcagatccaagatttgaacccagatggactggctccagagctaaaaccacttaatcatgatgcttcttagaaccctacatggcctgtattcataaaatagttgactctagacactcttctcccctttcaaagtgaaattttgatttgtttatggaatggggtgtggtggagactactagtgatcaccaaataccaatgtgttcctataaagtccctatttctgttgcagttgatttggagttatgtgatgtgtagcccatcagaagtaagcagaaaactttgtgccgttttctatcctggaaataacacccccgccccctggccccgctgcattatcagccactcctcttcactcctttctatggctccagaagtgaagagctctgaaatgcctaaattgccagatgggaacatctttactgcttggagaaagccacacaggagttacctgacctgccttggatggtgacatgagtgagaaataaacctttgttgggttagactgctaagatttaaacttaaaagtgtttttttaatgtttagtttttgtggctacatagtaggtgtatatgtttatggggtatataggatcttttgatatgtgcatacaatgtataatagtcacatcagggtaaatggagtatcatcacctcaaacatttattctttctttgtgttacaaacaatcccattacacagttttagtaatttaaaatatataattaaattatcgttaatgatagccaccctgttgtactgtcaaattctagatcttatttctttctattttttgtacccactgatgaatctctcttccccctcaccccaccaactacccttccagccctcagtaaccatcattctgctctctatctccatgattcaattgttttagtttttagctctcacaaataagtgagaacatgtgaaatttgtctaactgtgtctggcttatttcacttaacataatgacctccagttctatccatatttttgcaaatgacaggatctcatttatttaatgactgaatagtactccattgtgtatatgtattacattttctttatccctttgtctattgatggacacttaggttgtttccaaatcttggctattgtgaatagacactaagatttttgagttaatttattactagggtatagtttatcatactatgactaatataaatatcatactaagacagatataggtacattgaaatagggcactgctataatagctgatggtgtgctgagaggaagcctggtgttggagaccagaaatatgtcaatgcatgttatgttgtgccaaaatattactaaccaatctaacttgggaggcaagcttcatatttacttatatggcatctctaggaaaagagactgaaaaacagaacattagtagatgtgttggctactatttctgcatttggcaagtattacaagaaaacttcagaataggactggccagagacttgcagaatggacaatacatgatccaactatatgctgcatataagagacacatgtttgattcaaaaacagaaataggttcaaggtaaaagaatggaaaaacatatatcaggcaaacagtaaccaaaagaaagctggagtggctatactaatatcagacaaaatagactttaagacaaaaattgttatcagagacaaagaacagttttataattataaataaatcaatttgtcaagaagatataaaaattataaacatatatgcacctaacaacagagacccaaaatacatgaaacaaaaactgacagaattgatacaataatggttgaagacttcaatacaccactttcaatcatggatagagcaactagacagaaaatcaatatgggaatagagactaaataccaatataaacatactagatctaatagcaatataacccttcactcagaaacaactgactatacattcttcttaagtgcacatggagaattctccagtttagaccatatgtcaggtcattaaacaagtttcagtaaatttcaaagttctgaaataatataaagtatgtttcctaaccacacagaatgagattagaaatcaataacagagggaaattcacaaatatatggaaattaaagaacatttctgaataatcaatgagtcaaagaagaaatcacagacaaaactagaaaatactttgagatgaatgaaaataaaaacatgacataccaaaacttatgggatgaaaccaaagcagtgcttagagaatattatagctataaacacccaaattgaaaaaaggacaaagaactcatattagtaacctaaacttctaccttaaggaactagaaaaacaagagcaaactaaacccagaacaagcagaaggaggaaaccaataaagattagagcagaaaggaatgaaatgtaaatagaaaagaatagagaaaaaaaaacaaacccaaaagttggttctttgaaaaggtcaacaaaattaacagacctttaccttgactgacagagagagagagagagagggagagcatagagagagagagagagagagacagagagagagagacagaatcaaattactaaaatcaagaatgaaagaggggatgttgctaccgaccttgcaaaaatagaaaggaatataaggtaatattatgaacacttgtgtgctaatgtgttagataatctagataaaatgaacagattcctagaaagacacaaattactgaaattgactcaagaagaaatagaaaattgaaacagacctgtaacaagtaaagagattgaattagtgattaaaagtacttgccacaaagaaaagtagatgacaaatggcctcactggtgaattttataatacctagtattaaagagttaagcccaatacttcacaaatacttccaaaaattataagaggagagaacattttccaagtcattctatgaggcagtattactttgataccaaaggcagaacaaaatatcacaagcagaaaccaatattccttataaatatagatgcaaaatcctcataaaaataccgggaaactgaatcagcaacatataaaaagtattttataccatgacaaagcaggacttatggcaggaatgcaagattgattcaacatgcaaaaatcaataaatgtaatatgccatattaatagtataaaggacaaaaaccacattatcatcttaatagatgaagaaaaagcatttgacaaaaaccagcaccttttcatggtcaaaacacacaacaaagtaggaattagaaagaaactttctcaatcttctaaaaagcatatatgaaaaccccacagctaacatcatacctaaaggtgaaagaataaaagctttcccctaagataggaatgaaacaaggatgtccactcttgttacttctattcaacattgtactggaggttgtagttagggaacttgatcaagaaaaaaattggcatctatatttgaaagaaagaagtagaatgatctttacttgcagataacatcttactgaatatagaatatcaagggaatccacaaaaaaaatcttagagctaacaatgagttcagcaaggctgcaggatataaggttaatatacagaaattgcttgtatttctgtacactaataatgaacaatccaaaaatgaaattaagaaaataattccatttacagtagcatcaaaaagaataatatatgtagagacaaacttaacaaaagaattgcaatatttgcacactaaaaaaagatgaaacactgctaaaggaaattaaagaagacctaaataaatgaagacatcgcatattcacaaattggaagactcaatattgtaagatggcagtactccccaaactgatgtatgcttttgaataatatacagtatgttccctaaccacaacggaatgaaattagaaaatcccagccaggtttttgcagaaattgacaagctgataataaaattcatgtggaaatacaagggatccagaatagccaaaataatcttgagaaagaagaacaaagttggggcattcacattttcaggttcaaaacttactacaaagtgtaataataaagatagtgtggtactagcataaggatagatatataaatcaatcaacagagagtccagaaattagcccacgtatttatagccaattgattttcaataaaggtgccaagaccattcaataaggaatgaatagtctcttcaacaaatggagctgagaaaactggatatccatgcaaaagaatgaagttggactactactcacactgtacacaaaaattaattcaaaattatcaaagatctaaacttaagagctaaaactataatactcttagaagaaaacataggtatacatggccttggattatgcaatgatttcttacatatgataccaaaagcacaagcaacaaaagaaaaaacagtcttcatcaaaattaaaggacactattaagtgtttcaaagaacactataaagagagtgaaaagacaactcagaacttgagaaaatatttgcaagtcatgtgtatctgataaacatctagtatccagaatatataaagaactattataactcaataacaaaaagaaataacctaatttttaaatgcacaaaggatttgatagatgttttttccaaataagatacacaaatggacaagaagcacatgaaaagatgctcaaaatcattagtcattagggaaatgcaaattaaacctaaaatgggataccacttcctactcactaacatgactgtgattaaatagagacaatgacaagcgctggtgaggatgtggagaaattggaacccttatacactgctggtgggaagtcatatggtgttactagtttggaaaatagtttgaaagttcgtcaaaatgttaaacatacaattcctgtatgacccatcaattccactcttaggtacctatctaagagctataaaacacacacattcccataaaaatctgtatataatttttcgtggcacaattatttataatagctcaaaagtggaaacaaccctcatgtccatccaccgatgaacggattaaaaaaaatagtgtgtctatacaatggaatatgattcatccatataaagaaataaagtactgattctcattacaacatggctgaacctcgaaaacattaactgaaagaaattggacacaaaaggccgtgtattatattatttcatttatctgaaatgtctagaatatgcaaatccatatccatatctacagatagtagattaatggtttctaggagagaggagaagtggtaaatggagagtgactgttaatggttccaaggtttcttttggggctggtgataatattctgaaattagatagtggtgatggttgcacaactttgtaagtatagtaaataccactgagttgtacactttaaaaacagtgaatatcatggtatgcgaattaggtctaaattttaaaaaatttaaaaaagagttgcctgtttgccagtagaaattaactaaaatagagaaaattcagaatactgaggcctgtagaattgaaaaaattgactgtttctagtttccggatagtaagagatggaaatttaaaaggcgttgcataataaggcccaagaaaatgtctcagttgattaaaatcccagctcatgcctataatcccagaactttcagaggctgaagtgggaggattgtttgagtccaggagttcaagaccagcctgggcaatatagtgaaaccccgtccctacaaaaaaattaaaaaactagctgggcaaagtggtgcacacctgtagtctcagctagttgggaggcttaggtgggaggattgtttgagcccgggaagttgaagttacagcaaaccatgatcgtgccactgcactccaccctggatgacagagtgagatcctgtctcagaaaaaaaggaaaaaaaaaaaaaaggaaaatatctgattaaaggtgcattcctttgttctagctagcttcaaggtagacactatcatattgaaagacagagggagcagggggacaagaaggcgaaaggtaaagcaagttggaaaactgtatcttacaaaagcaaccttgagtgtggatattggcaaatagatcagatgcttaccaaatttttgaggaaacagtattgtcaaagaaaccacaaggctgtataaaaagcgttagtccattagctaagccttaaagcaacctctggtaggaagttgcacatcccctaaagagagtattctccctaactccctctttacatgtggtcaagcagtatcagggtccaggaggaagcccctcagagtgtggtgccaaggatcacaaagaatagtggaggagggagttcctgctctaggctaggcagcctttataacatctgcccactggtatttcagcactgtcacaggcagtgactactgtgggtctcttagtcttcccctttctgaatgggagttatcctgttcctgttattgtagttatcctattcttgttctattatcgcatatttgtatgctgtcatggtgtgttagtctgttcttatgctgctaataaagacgtaccagagactgggtaatttacaagaaaagaggtttaatgaacttacagttccacatggctggggaggccttacaatcatggtggaagacagaggaaaagcaaagggacatcttacatgtcagcaggcaagagagcttgtgcaggggaattcctctttataaaaccatcagatcttgtgagacttattcactattatgagaacagcctgagaaaatacccaaccccatgattcaattagctctcaccaagcccctcccatgacatgtgggaattatgggagctacaattccagatgagatttggctggggacacagccaacccatatcacatggatatgaggcagacatcttgacttttcagttcacaggtgtaagagaagccatgtcttttcctgatagagaggactaagaaatgcaaagctataatagattggactttggattgtctttcgtgaggagtggtggaagatgctctaccttcaggacgaagggaacaaagggatatttaatggccagaagagtgaactgcagtggagactgttgttgctcaccaagttggctcacatgtgcttctctaaatttcccagcctaaggtgttgtccagtaattttcctttcttgtaatatctttctgagcttttggaatcaatgttttgtgggccttataaaatgagtttgaatgtttcccttcttctattttctggacacacctctgcaggccagtattaattatctcttaaatttttgtgaagcaatctgggcatatagttttctttttggaaacagttttaatttcagatttgatttctttgatagatatagggctattggtattttaaaatttcttcttgtggcaattttggcaaattgtattttaagaaacatgtttcacttagattttctaatttactggcataaatattggtgtatagaatgccaatctattggcataaagttttttctaacatcctctcattatctttttaatgtctgtaaggcaggtagtgatattctctttttcaaggctggtttttgtatttatgtttttttctctctcttgctctctcttttcttgaattgtcttgctaggagtttattaagtgtattaatctattcaaagaataaacttttgactttgttgattttctctattaaatgtctgttttctattccattgatcctgctctgtattcctctcttctattttttgagggggttaattttctgttttttgtttttgtttttgttttagcttttttcctattatttaaacatatattttaaagaaagatttttcttacatagagacagggtctcactatgttgcctaggcttgtctcaaactccttggcttaagcaatcctccaggtttggcctcccaaagtgccgggattacaagtgtgagccaccatgcctggccatttttctagttttttgagttgagaacttagatcattggttggtttttgtttttgttttttttgagatggagttttgctctgttgctcaggctggagtgcactggtgcgatctcggctcactgcaacctccacctcctgggttcaagcagttctcctgcctcagcctcccgagtagctgggattacaggcacccactaccactcccagctaatttttgtatttttagtagagacgggatttcaccatttcagccaggctggtctcaaactccctatggcagatcatctgcccgactcagcctcccaaagtgctgggattacgggcgtgagccaccgtgcccagccagatcattggtttttaaccttccttattttttaatatatggacttaatggtatatgtttccttctagattctgctttagcagtgttactgaccacattaccactcttctctccacatatccagcagtgaaagacttctgatgctggaaatgcagaatgaatctgcatgaatctctgagtcactgtctgggatgcaagagagctgcctcacatgcattggctagtgatatatgcaagaaacatacctttgatgtgttgaactgctttgtttctttcttaagaggctggctatggcctatcctatcctagctgttacaagagggcttgttttacaatagctcttatatctgtccatattgcagtttgcaaagacttcccattgattcccccaagtgtttttcctgaagatgtggggttaacggaggggtattacagcatagcacacaacacaaaacaattttaatttaatatacagtcccctccttcccccagggaatttttcattgcctgtctttcagattcggccctgacctattgtcaagttttaaggtccccttttctatttaaacctctttcctcactttccatattcttgcttcttcccatccatcctattccaaagcaacccgaagctctccagctttgctgttgtagcttttctttaccttggatcaaatcagattcttactcaaggtctcttttctactgaccaatgcatactcagatgtctgttaggcagaaatggagcagtgggaagcctgttggagaaacaggacaggccctcctgagctgaaagggttttcccccagaatctagagtggtatttttctttattgtactgcaacttacttacttctatgctcaggtttttattgattttatttcatttgctttatttctacatagttgaaatcatgttcttgtggactgcttttctaacttaatgttctatcagaagcatttaccatattactgtataatattgggaaacatctgttttatattcacattttttcctatttaaaaacataattttcagtcctgaaggatatgagaagaacatgcaactccccaaaatcctactcccgggcagaaaatgtttaacaaattaggctgcatgatttcagctgctgacagctagacagaaagaagaatatttctaaatatgtctgtggagagactgcttggacagagctgtcccttgcaagactataccagaggcatggtcttagtgggacagcctagtgttctgagcaccgggactgtcagattcacatgtatttggatggtccagagcaattgtggtggcagaagtctgtttgcagaaggatctagaaacctcttgggaaggggtctagcctgtgaatgttgttcactctggcccagcctcagagggaagggctgtagtagaaaatgaataaaaacagggcagttcactgaaattgctgtgagagtacagggcgaccgtgtttcgtgttctcagtaatagtgacgcacggggacagggaggggatagtgggagggatctctccccttcatagtaaaaaccctgggacacaactgctgagccttaaggccataagccataaggcctgattgagtacaagtcaccagctacaaagaaaggcaaggaaggtcagggggcaaaggtggtgacccttagcactgtttacagatcctcactgaggaggaaagaaaagctacagggacaggtgggcttggccaggtacttgtagccatcaggttcacaggaggccttgaggtcaggtcagaggcaggaagatcctgtgctgaagagtaaaacttggagaggggccttgtgagatcttgcgagggatctggagaaataggatagggcagtgattaaaaaggcctatcaggaccaggctaacaggagttagccagggaacatgagacaaataaataacttggaatctggcttcattggaagcttgctgcataatcactgtagctgctctctcatcttggccctttaggcccagaaagtaacagccctgatattattagctcttgagtcttgcacagaccctcactgtttccctacacacttgccacacctttgaaaatagtccttctatgaaatgacctgttaaatcaatttgcctaatatgaatgcaccatctgcctgctgctgggactactgatgcagaagccattctgttgatggctccagggggaccctctggaactctggctctcagtaaccagctctggagataaaagacagggactgagatttaaatggtggaccctttatatcacataaaactaaagatatagattgtgacttcactgacatacttcagagatccctggtagaaatttggtaatacatggcagcctaactcatcaggatgagtagagattaaagagatctgatttgaggcaggaatggggtggtggtattaggggacaagaaggctacagtcagacctcagcccagggccatgatcatcactcagacctattcctcttgctctatggagaggagctgaacagaaggccagaccctggaagaggaaaagaattaaagttgaagactcccctgaagaaggaggagggtggaatgggtggtacctggcactagagtgtctgcacagggagtggcatgagtgggcacctctacaactttgatggaaggaagcaaggtgcttacagagtagctgtggggagaagaactttcttcccctctgaccttcagaatatgctcacgtggaaggaatgcgtgagacacacagctggaaatgttgagaaaacacaagagcctgggcctgaggaatcttaaaataggtttgttatatatttaataaatgctggaaaagtgacaggatttggaaaagttaatgtaaaaacagcaccaccctggagcactaaatctggttttatttacccgggccatctggtacttccctttggtaaagtaaggaatttatacacattgaaaaccaagctttaatgcgtaaacttaacagaatgtccaatcacaagtatgtgatagaagtaaagtaggggaagaaatgactcaggtattattcccctcaattctcccaggacctttgcacatgccattccccatgtctcctccctcatatcctgacgaaggttgagttttcttgttatgctctggtatggttcttgtattttttcttcacagctctatcatagtttgaagtcatttgattaacgtcctgtgtcacccactagctgatgacctccatgaagacaagaatggtgctctgctcaccactgttgctctaggacccagtggctgacacctagatgctcaatagatctttcatggatgacaacatgaaggacttttaaagcatgtcaagttgagactagcttcccaaattagagaaggtgacacataatatattaatataatcctggtaacctcaggcctatgttgcctccatttctctgacacatttctgacacattaccaggagggagtcctgctgatgtcaggaattcatgaggaaggggggtgaaaactttaatcagatcaaatcttacctttagagcaggagagacatactttctctttgatctccctgaaactgccaaaaggtttttgccgaactcataggtctttggacctttcagtgggtgctacaactatgcaaatatcgtggtgcaccaagaccaagctggagaagttctgaggttgtgaggatatctaaactgtgctgtgttgatatttttatctgctctctttgatgcaagcttctaggcctggtatactcaagttaaccacgaaaaccaatggcggttatatttggaaaggaaggctatgccctggtgaaattatacgtgagacacaaaaaatactgaggtcactggtcagtgatgttagagagcagctcagtaaggccagtgggaggtgtgatatggtggcttaattaaaaggcctctggcctgtgccctctgccttttattcttcgtcacttcctcctttctgctccatgaaacatgagtgtaatggctgaagctctagcctccgcctcttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttttgtattttttttagtagagacggggtttcaccttgttagccaggatggtctcgatctcctgacctcatgatccacccgcctcggcctcccaaagtgctgggattacaggcgtgagccaccgcgcccggccgcctccgcctcttccttaacaaaggaagagctaatttcccacgccccccctcccaccacaaagtatgagggccacactggagggatggtagagtgatggctggaagaagtgtggggcttttgtggaacagcctgtaatgtccaactctggactatttagggaaaggaaatgagacagaaatttttctcttgtttaggccactattattgtgggtctctgttaccatcagccgaacttaattcccgtgaatatatttgtgaacactaaattattggtgcatcataagctttcatcatgttcatttagatagggatctgaactttgccataggtgactggtagtgatctggatccagtgggaattgtctggaatgtgatcaagacatgaaatgtgcagatgggccagtgacgagggcttaccttttgggagcagttgacaggtgatagataccgatgacttctagctgatttattcctcttaaagagtcatcctttggatgaatcgtgagctatggaaacgattgctcaccctgagctgtttggggcttgtgttcttctcaagatttctgaggacctggctcgagcttctgtgtcagagtcctcattctgactatggggcctcagtccttttttggtgtttatgctctttctctggctgctgccctcctttcctcttctgagccttgccagtgtggaacatgactgtcttctgtgttcccccagaacacggctaaaccgctttgcctgaagccttggggatactggatggtggatagagacccacatgctctgccctgttcatacttaatgttccaaagaaatagtaaagttctgcaataacagtttctaaaaaaattcaatctttaattttgttgttcttttgataattttttactgtggtaaaaatatatatataagttgccattttaaccattttgcatgtgcaattcagcagcattaattgcattcacaatgtcatacaatcatcacaattttttgatttcccaaattaaattctttaaaaaatgtttaaaaattttttaaaaatttttgttatttttgttttagattcagggggtacatgtgcaggtgtgttacataggcatattgcgtaatgctgaggtttaggcttctaccaaattaaattcttaaatagagccctctttcctgacccagagatgttatagccccagtgaggtcatagttcggcttctttttaaataacaggaattcaggaacttgaaaaatccccatgcttttctctggtataattttagccaccccttcctccagatgtccctggtagaatgcacagatctgtggatgtattgagtgttgatggtactgtcgaaggctgatggtggccagcccctggagtctgacattcaactgggaagcaaacaccgtgggacaggaaggctacagaccctcactccagattcagcttttgaccctattgcccattgaatggttgggtgagcagttctgaacaaggcaccaggacgaaggtagcttgagactaggaaaactagaagctacagccagggaggactcctgggaaagagtatggcctaaggggaatgtgtgtgtggtgggcaggtgggcagcaatgggggagactgcatctctgggagacagaggtcatagcctcacctgagttccactctactcacctccctctccctgcttccaaaaattttagacggctatggtcagcctagaatttgaagtctgaatttcagatgataaggcagaagagttgaagcagattgagggcagagaatttgggaaattctatttgaagctgtgactctcatctatggatgttcagctgcagagtctcaccagaataatgtaatgttgaggctgctggtggcattttggagactatgaaagatacacaaacatggaaacaagatagtggtgacctggagcaataaactctacttgtgtagctgaggatgatcttgtacagagtcctggcaagaaggtagagacgacaggtcattcttagatggagtaaaggactgctaattttcagacttcagtttgattcagaaactgtgtccctatcagcagacagccatgcctggggagcaccagccccctgccatgcacttagataatggagggagggttttgtggtcacatgtggtaggccccaagcttcagattcccactcatgactctctttcactccagtctggtgacgagttagggactctaagctcaaggacccaaggttccccgaaacagactcagcccagtcctactcctgagccctcttcttgttgtctcctgacctggtgcccaggacaccccccctccccacttcctgccataatcctgagtgcacgcactctgtgatgaggcctagctgtcacatgcactaattttcaaagtgctcagatttggttctcttctttctagaaacccatttcagaaaaaaggaaccagatcttaacagtaaggagactgctgtgccaattgtcagactccagtttgcttaggtctgattgactacacagattaaaatcctgggaaggaattaggctcaaactggagtggaggggtggtgggggaaaggcttatactctcattatgccacagcatcagggtaggctgcaatgcccttccacacgtggtgccctgaaaatgtccctggttattcttctttcagccatcatgtacttctgaggtacctatttctatcctagtgtcaggccatatgccatgatttctgtccactcaattagcagaaggccccagggcactttggtttgaaaactggctatatctgatgaggctttgctaatgtgctctcagaagcagagtccttctcttattgcctcctgtggggagatttggacctctgtagcagagaagactgtaaaggtcgtagagaaactgggttttcggaggctgccatgcccatcttgtatacatgtatgcattgtgcaaccattattcagaagggagcataagtcagggcatgggaacagagaccccaaacagatattggcttccaaaaacgctcaaataaccccatcccccagtgcattaggagtcagagtattgttggaggtaacctgaagctctggtccaagtgctttcctaggtgttcaaaggtctgaatgagtggagcatcaggccgattggaggagaggagctgacagcacaggatgtctgtccctggtgtgaagctggaggagagactggtggtattccttggggtggggtgagggtgacagtgggggtgagagctagagggggtgaggggtcgggggggtggttgtattggcagaagactagttaggtggtattcttgttgaactgaggcaatggaagggttagattaaatcagtggtcttcacaggaggtgtagaatgttccattgaaatgtaaaagaaaaattaaaacttttatttttactttttttttagtctaaaactaaaaagctaaccttcaccaatgtttactattatacattttaccctcactcaactcatgcattgggtgtccatgtcatgcatcatatcagaggcaagtcagggaagagaggaggttctacaacatgggggatggagaaggggaccacagcaccctccctggcccacctgctttcaaaatctattgctaggtcttaagaactatttgtgtcctggcagtggatagacatattatcagttttcactaaactcttctcacaaaagagacaagtggtttgaagacattcctcaaaggaacccatagactgaaaataatatgaacaatgtaagcaaaagcaaactcagaaaatggcaaagttgacgatttcttactactaatatgatatccattatgatgattagtcagctcagtagtagtcagctctgacaactaagttcaaatttataaaaaagactacttgaaacagggatttacaccaccatatgttggcccttgaggtattagctaataataatataaacatgaaatcatgatcagcaagacatgtaaatgctataaactcagggcaagaagacaaacctctacgatttttttttcagggattttccaagtcatgcaatacttagttgtgtactttttaaaaattattttttggccgggcgcggtggctcatgcctgtaatcccagcacctttggaggctgaggtgggcggatcacctgaggtcaggagttgcagaccagcctggccaacatggtaaaaccctgtccctactaaaaatacaaaaaaaattagccgggcatagtggcgcatgcctgtaatcccagctacttgggaggctgaggcaggagaatcacttgaacccgggaagcagaggttgcagtgagctgagatcataccactgcactccagcgcctgggcgactcagtgagattctgtctcaaaaaaaaaaaaaaaaatagtgctcagaaatctcttttgaggcttcttatttaatagtaaaagacaaaatatcagtcaacatcactggaaaaaacagctgttgtatttgccatggttaaagtgactgagttaatacagagagaagatggtagtacataaaaatgtattctgttggaagacacacagactttaagtttgaagaataagttttaaaacacatggtgtgttgtggaagttggctatatggttggatgcaagttgctaacatgtttcaccttgagtatttgctatgctttttgataatgacattcataaagaaatattttttgtgatctactaaaggaaagatagatatgttcacaacagtgaacaacttagtaaaacatgctgtggtttttatgggtgaaagtaaaccactgagggagtggctgccctctctggaatacaaaatgaagggtggttggtgttttgtatgaccagcaagacatgtaaatgctataaactcagcaagacatgtaaatgtctcgttctaccacttgtctcttttgtgagaagagtttagtgaaaaccagaaaacgtaatctgtctatctactgcccaggatacaaatagttcataaggcctagtaatatactttgaaggcaagggtgtcatggtcccattctctgtcccccgtgttgcacaacctcctctcatccctgactatgcctctgatatgacacatggcatggacacctgatgcatgagttgagtaagggttccatgtagttaacattggtgaatgttaattttttttatttttagactaaaaaatatgtagaaataaatgttttaatttttcttttacatttcaatggatcattctacacattctactttgaagactactgatttaatgttacccttccattgcctcagttcaacatgaacaccacctcactagtcttctgccaatgcaaccacttccgctacccctcaccccctccacctctcactgccactgtcaccctcacccaaccccaagcagtagcagcaccaccaatctctcctccaaaactggggggtggttcgtgttctggtccatgaggactacatgtgaaattcagcaatcacattattcatttacaaagtacaacaagaagttgaagcaagaagatcatgaaatactatgggatgtcaataatatggttaattaaaaaattaaaatatagcagaatctttatagcactttgtattgagatgtggaatgagactaaaaatctttcttatgattccaaggtttactgattatctcaaggcaaacaacttgaacgctgtgaatttaaagatgagtttccttaacaaagaacaagtgctccaaatttgctgacctccgatgtgctggcctgagattgtcacaagtgtgatacatagcagaaagaaacacacatatacacacacatacacacacacacacacacacacacacacacacagtatccttttgggtaaaggtgatatttcagcaatgaactgacgtaacaaatgtgctttagaagaattgtgttatagggaaggcactttgaaaattgacgtttggaactgtttccattatcatgtgattttcatgccaaaacgaagcgtgctagtgtcacctatactctcatagccacaatctgcaaaatgtagaagcatacttctaaatccattttacaatattgcaaatgcagaatttcaagtgttttaaaagtcccatttgttaaaatgatttgcaagaacagctgaggaaaacatcattgaaaatgttgatttcatagacaaagaagagttttcacatttgcaaaattgatagatcaaatttaaacagtaagaactatgatttaataagtgcaaagatacagttcttctattcaggtctatttaatctttgtgagatatcttttttttttttttttaaagaatagccattaagaccaagtatggacattaactgaacttacaagtacactttctggtctcataaagtattaaactaagatttatttaaatcatttttaatgatttaatcactaaatcactaacagattagtggaatcactaaacagattattgctaataactttaaaatgaaaagaaaaaggtatattgtaccactcataaaaatgaaacaatttaaaattattgtttcatctttaccacatcctttaatttttttagtgttctttataatatgtaactcattaacgcagtctcatgtgcaaaacgtttatgaatacacgaattgcgagtatcagaccaatcagactatggggtagaaggaatacaacttggtgcttacatgagacaactctgtgaaagtggttgacacagtgaggacacacagtgggtgctcactaatgaagtttcctctccgagcttggtgacttactcgttgagagaggaaagggagaccgagtcaagaatggctcccaactgtggccccgtggtggtgccgaccccggtatcattcactgagactggaaacacagaagcaggttctggcgttttcctgggaagcaactaggtagtttgggtctggaccgcttccgccggcctaggaagatctagaggagatgttccctaggcagttagattcaccatcttcagcagctcgggggcattctgggctggagatgaaattcaagagccatcatccggcaggaggttgttaaaaccatgggagtggctgagatgcccagagtgggccttggagtgggagagcgggctggcacggtgggaccctggggtgggaccacagagaaaagccaggccgcggaggccgagaagctgtaggtacccaggtatgtgaaaaatctggaggtgggggccgcgggtgccaactctggaaactgcactccaagcgtttcaggaaggaagacgtggtcagcaggctcagatgccaggaagaggtgagcgagggaggctgcacggcacccagtggctttggcaactaggaggtcattcaggactttgaggggcaggtgaaggcagagcgaggagggttggagagggagcgtgtgcacgtggtgtgtgtgtgtgtgtgtgtgtgtgtgtgtgtgtgtgtgtgtgtgtgtaggtgatccaagtgaccagaaggacgcctggaagagtggacggttggcgagggagtgtgtgtgtgtgtgtgtgtgtgtgtgtgtgtgtgtatccaagtgaccagaaggacgcctggaagaaaccaatgcttgcgggttgctgcaactacagggagcaagtcacctgtgcggggccgagacccccagagtctcgcgctgggaaaagttgtgcggggaggggaggacgtcgggcaagcccgggcggcacggggagcggtgtggaagcccggcggggccagcgcagttgaggtctggggagcccggctggcatctgctccgggctgcggcgcgggccccgcggagcccaggaggcggcgggtgcttccggccaagggccctggcggccgccgcgcccctgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctccagccctgcggccgtccctttcggccggcggcatggccctgtcgtccgaacccggtgagtgcgcgcgaggctgcgctgctgaccttgggccagccccgcggaccctgcggcccaggcgggaatcagcagcgccctggggtctgaaccgcggcttccgccttccctgctcgcagaggcggtggcgctgactccggtccgatcccttgccctgtcccctgttcctgtccctgtccctacccctgcctctgcggtggcccgagccccagcggcctcaggtgagcgggcagcatcccgattccctggcggcctagaatggaatcgcaaggtttagagaaattaagggacctgggacttgccaccctgggcaaagttcctaggtgcttgaggactggctggatgtggacagctgaggtggacttctacctggaggcgagggatgcactggatgatagggtgatgaggtcgtttgaggccttcatccttacctctttggctctctcccggcaagggaggtgtacagccttgggctctggcagtctgctttctgcccttgatcttctggtagctgctttgccagcagagctgctaatggctgttgtaggctggcagaggtccctggggagagttttgagaggccttggagtaggagaggcttgctaactagggtatcatttccccaaactgtatgtggctgaaagcttgatggcgacacatcagcaaaggagctgggtgaaagcaggcagcacaaggagggattttagcatggtcttgagcccctgttggctttccctcaggatgcagtgaccaacatttggccatcttcatggaaaagctgcctgcagctggaacctgcagaggagaaattctttccctggctgtgcagcactaaggccgagtgttagtggagccattgagccagacagacagagcctctgtcacttcacacctctaggagtgttgacagcaggtctggggtagttggcctggcctggctgcagcttcatggggcctggcttgctctgaggatgatggtatggggctgccctctctaggaataatgacacctgcataggtggtggctgggagactctttgacctctcagtcccatccttagctcagcctctgtcttctaaggttctcctagctctcagctaggtcaagaagctctttgagagatgaggttttttgtagttgtttttttttgcctctacactgactggatcactcttcaaatggcctcaaaatctgtctcaggtcttgaaaatgtcatgggcagataacatgtagccttcgggttaacagggagataccctttctcccctaaagctgcccattggcctccatgattcttccaccaagtataataatctcttagttcttctgtatgctggttgcatatctaggacaacagacaattgctttgggcttttgatttgtaaggaactgactggggcatgggaggatgagctcatggctggagtcctggctgtgtacagtcaccgagaagtaccattcataggggagaaggatgttcctcctcctgatctggcttcacatttaaatatgttttccttcttcctgcacccaggtaatagaaacttgggagagtgccaggcacatggtggtgctcaataaataaggttgaataaaaggattcagtgtctagataaaacttcatgttcattttcctagttcttctctctcgtatctgatatcataatgatgatgacaatgatgttggcagataatgcttataaaacacatactctatgccaggtaccagtctaaacacttcacttatgctcattgtcatggcaacctatgagattggctttttattatccacacttcatagggaataaaaccgagccacagaaaagttatttaacttgcccaaggtcatacaactaagtggtggaacaggattcaaatgcagggagtctagctggagttttttttgttgttgtttgtttgtttgaaatggagtctcactctgtcacccaggctggagtgcagtggcacaatctcagctcactgcaacctccacctcccgggttcaagcgattctcctgcctcagcttcccaagtagctgggattacaggcgcccgctaccatgccaggctaatttttgtgtttttagtagagatggggtttccccatgttggccaggctggtctcaaaactcctgacctcaagtggtctggccgcctcggcctcccaaagcgctgggattacaggcgtgagccaccacactcagcctgagtctacgtttttagccatacactctactcattcctgagattgccataggtggattgatctattataaatagctagttcacttgttcattgttttatgcattcattcattcaacaaatacttgctgaatgtcgaccatatttcaggtatggggatacaactgtgaatgagacaggcgagatttgtcatggagctggtatttagcaagtgaatcccctttgtccaactccttgtgtgagtcacacacacctcacaaatgagaagaaaaatgaacccctctatgcaagctcatgcctggcttttggggaggagagtgatatctttctttttctttttctttttttttttcttgagataaagtcttgctctgtcgccaggctggagtgcagtgcagtggtgcaatgtcagctcactgcaacttctgcctcctgggttcaagtgattcccctgcctcagcctctcaagtaggtgggactacaggtgcgcaccaccatgcccagctaattttttgtgttttagtagagatggggtttcaccacgttggctaggatggtctcaatctcctgaccttgtgatccacctgcctcgggctcccaaagtgctgggattacaggcatgagccaccatgcccggccgatatctttcttgatgagacataatttgattccgtcctctcctgtcttttagagtttgtaaggggtgcttaagtgataaaaggggatgcagtctagtctcgggcaggagaagcgggccctgtatctggttatcataaattgtcttgatgtttgttcgaaagggaaataaggctttgagcttgggatcagtgctcttcagtccacagagacatcttggctgcaagaagcagcaacaagttaggctcaaggtggaattgtgaggtcctgagaagagcttgctcttctgggacagaactgtatttttcttctaaactgcccatgttctggggagtcttcccgccttttggcttcagcaggacccttggtcattgttacaacctgtgtcatcttagtggagctgctgctggtttctgtctgaacccgatgcaatgggtctcatacctgtaaactgggctccaggaaggcagctttctctaagttggaaaatgaagactcaaggtggagggtgtttcccaaagccgataccacaagatattaataggtgtttttttcctatgacagcagttctaggatggtcaaataagtgcgtcgggttaaacaaagttaagcagctttctttactgcaggacttctcaggtgttgaatttgctagtagaaactgtgcatgaatacccataagggactacaggatgcagtgttttccaagccttctgacctttcatgttctgcagactgcactttgaaaaatgcttgtttagactaaggctagctgggatccggttaaaggtgcagaataaaattccctgaacgtgtcggacttaaatccttgggctggaatcctcccactgcagtccccactctacctcccctttccccaaaacactagcagaaaaagtcatctgcccctcctccttctggcagaatagtactaagggcttggatttttttctcatactgtaagttcatttaattgtttaatgaataaatattaccctccctctaggttgcttgtagcctgctggttgcactgtttatgaaacagctgtgaggacaggtgggccgtaatctctgggtagctaaagcccagcagcagcccgaggatcatgtgtcaaccctgtaatactgctctgtgcacacaggaattatgatgtgagctcagtaagacacaacctcacgattggacatgcggaggtgactcaggcccaagtcagggttacagctagcctcccggtaaacaactgacccatccttcctgagctcttctccccaggatttcaacagcaccacagaaatagccattttgctcatggttatttcccaggaccacaggatttgcctaagtcactgggaggctatgtgtctgttctgagccttcccactctcctaaagggcagatgaagatcagagctttgcaccctgtgatgccattttaatcaaccctgcttggttttagaggattgctcctgtgggtcacttgaggcaggctccaccttccccaggaggagtggcagagtccagccagcgctcggagctggaggcccacgtgggagcagtgagcggctgtaagcaggggagggtttggggtgggctccggtgggtcagttggggtgtactccttttctgtgtgtgtggatgggggtgggggttctggtaaagcttatcaggcttcgcagtcacctgtgatgtgggcttccttctgggaagaaaggaaggagtgggatggggctgtcagcttttcatcctagcctgcccctgtcctctgtccgcctctgtgctgaggcagttcctgctccctgagtctctgtcctttcctgggaaaggtggaagcagttcatggtctttccctttcagaggaggaggggatggaggggattgtattagcaactgggattgaagctccccctggcagttatggggtgcccttgggagggctgctttaggggggctttctgagaagaggcaggtcgggctgtacctgagaccaatccccttgataaaatgcagccaggcctgaagcacgttcagaacggaagcagcaaaggtgatgatatcgctcgttgctactcagctttcaggaggaggctgggcgttagagggaggctgtggcttatctcctgcagctgggcaggacggctgagtttactgttgtaaagaggaagccgccgctttagtttcctcttgtgagggctgtgaagagggccaggacactgcattcaggataccacagccattttgttttggataactgggattacctggggacttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcaggtctgtgtcggggcttctgcaaggggagtctggcaagagtaggaaccagcttccttcgtataacgaggggatttcagtggcactgggcttcctttctggagggactgtggcaccatgaaaagttactgtttgttgaaactggcagtgttttagaactttctaactttgggacacttcttcaagttcatcagagcgtgttgcatgtaacagtgagataagctgtatcattggctgactgatgctggtgaattcacagctaagcctcccaagcctgctggcttcagctgacaaagggttggaagccaggcgtgaacatgcagctggagctgaagctctgcttggcatctgcagagtgagctttccttgtcaggcctggcctggcaggtgtctggagggtctgagaggagagacactctggagggacgggttggcaggtgggagctgtctgccaaggacatccagaaggcagcagatgtgggggcagctgctaaggcctgcagcaccccaagtgggttacttggtccatactaagatatggaattaattattttgttgtggttgctgttgtttcttgcttttttttttttttttttgagagaaggtcttgctctgtcacccaggctggagtacggtggtgccatcatggctcactgcagcctgcacctccaggactcgagcaattctcccaactcagccttccaaatagctgagaccacaggtgcatgccaccacacctggctgtttttttttctattttttgtagagatgaggttctgacatattgcaccaggctgatctcgaactcctggcctcaagcgatcctcttcagcctcccaaattgcttggattataggcatgagccactgcacccggtcttggaatgaattatctaccaactatttaagacactggtagtagttctgcggaagatttttatgggttctgtaaaacaaaaagggttctgtatgttaatgttactctatgatccttgattttaatgagccttatgaatgtgagttgaggggctgtggaatgcaacatctcccaataactgaccacaggacctgttttaccagcaacaggtatcaatttcttatggcatccagtttgggaaaggttgatttaagctaaagagaaaggaagatatgttatagaaagctgtgtcctgaaaagtatttttagttgattagagcaagctaaaaatgctttgtgcgctggtatgatggctcacacctataatcctagaccctgggaggccaaggcaggcggatcacttgagaccaggagttcaagaccagcctggccaacatggtgaaaccccatctctactaaaaatacaaaaattagccaggcatagtggtgtgtgcctgtggtcccagctactcgggaggctgaggtgggagaatcaccggagcctgtgaggtcgaggctgcagtaagctgtgattgtgccactgcactccagcctgggcaactgagaccctgtctctcaatcaatcaatgaataaatgcatgcttcatgagcaaacatggcaggatctggcataagagccctcagacatcaaggacttccctcccacccaaatacccattgccaagggagcctggttgggggtgtctgggtcaggcctgtgtgtgtctgagggcatgaaggaggtaggaaggtgctgctggtggtggatggcttctgtccagggtaggagctaacacagagataggtctgaatggtgaaactccctttggcctggcctctcaatagtgtgggttaggctgatcttgaactcttagcctcaagtgatccttcctcctcagcctcccaaattgcctggacaacatggcaaaacctcatctctaaaaaaaaaaaaaaaaaaaaaaattagccaggtatggtgatgctccctccctccctcccttcggcaattaaggagggagccctaattgccaaaacctgccagaaaaagaagtttgttttcctatttttctctcttttcatagagtcttaagtctactcattttctttctattctctttgtatttgttaaaaatggcattataatagcattcatcatcaaaataaaatatcctctcacacacaggcagccctgccacctggtcattttgactgcgtgaatctcttgcaggtcttgcccataaagggatgcattttcctttcactgtaaataaagcatgggtatggttctatgtattaattttttcatttactgtatttttatttttttatgtgattgcaccatcctcataatcataattctgattacttaacatctttttcaagtgagtatgctctaatttaggcattttaaagctatttatgtaaataatgcaggtaaatatccttgtgcttttcattcttaggattctttttttgaaagaaatttgtagaagtaaagttgcttagtcaaatggtatggtgctttatggcatttgcggccttttgcctgggctgttgggttgcatatcttcttctgagatgcgatgtgaggttttgggatggtgcccttgattggtggccttggaataaggggggaggtgaggatccagtttcgtttcagcctgatggagcctcctgggtctggttctttgtgctgttccagactttctctcccctgtcacctcctttgatggcctccagcttcccccctctctgctatcaagacatggaaatccccacaggcagctctgttcctcttcctttttgcagaggccaggcctcgctgtcttgatgtctgctccccagacagttgtgtgttgacaggctgttccccaccagctccctcccactcctctcatcagggagtggcaggtccttgggtctcagagttaagggagccacagacctcactctgattgcctgttgctagcctgctttcttccttcctgtctgtgtcatgacttagtcccacatgccactcagactcagagcagcaagccctcctcaggcaccggaaatctctctggtacctagaattatgccacttagagctgagagggccttagagaccacttagttcaatccctttatctcacagatgagaacattgtgaggccggagaatgactgtcccaagatggcctagtgtgttcccctcccctgtagctgcacttctccctgctggacagcagcagggctctgtctcatctccattcttgtctgtctggtccacaaaaccacttctctctttaaaccaactttaaagaaactgtggtcataggtagatgggaaactcctcttccagagctgctcccaacgagggtggcttgtcgaaaagggtgcagtattaatccattccacaagtgttatgctggggactgtgaggagcccctgcccggacacatacgtggacaaagagaagcagcacagcatggtgggtgaggggacagaggcaggaaccaggtgcctgggttcagatccctgagctgaggatcagagaggaaagggatgagagagaaaggctgagaacagcacaaatctctgctgacttattaaaagtgtgaccctgggcatgttagctctctatgccttcattttctcatctgtcaagtgggaataataagattaactgagttaataagtatgaagttctttgcagagtatatatatgtatgtatacatatataaaatatatattatatataatatatattatatataatatatattttatatatatatatatattttatttttaaaattgagacgaggtctcaccctgtctcccaggctggagtgcagtagtacgatcataactcactgcagcctcaacctccctggctcaagagatcctcctgcctcagcctccctagcagctgggattacaggcatgcatcaccatacctggctaattctttaaatcttttttagggatgaggttttgccatgttgtccaggctggtctcaaacttctgggctcaagcagtcctcttgccttgacctcccaaagtgctggtattacaggcgtgagccaccacacccggccccagagtatactttttttttttttttgaggcagagtcccactctgttacccaggttggagtgaagtggctcaatcttggctcattgcaaccttcacctcctaggtttaagcaattctcttgcctcagcctcctgagcagctgggattacaggtgcctgccaccacgcctggctaatttttttgtatttttagtagagacgtggttttgccatgttggccaggatggtctcaaactcctgacctcaggtgatctgcccgcctcagcctcccaaaatgctaggattacaggcgtgagccaatgcgcctggccagagtgtacatattaagtgctatacaagtaattgcaaaaaaggaaagaaataaggaaatgaagaaagcaagcaagcaagaatgaaacccaaccaaccaagcaggtggttgaggccagtgactgttagtaaggaatcagtatgcgaggaggtggatagagaaagcttctttgagggagtgagttttcagctgggtaaagagtgttctaaaacctttattttatttgctgtgtcttgttaggaggttccagagggtttggaactgcaatagcagattctttctcttcagcaaaaggccttgatttatgtaatgaagaatgcagctttggatttcccagggctctgctgtaatcttgtgcgaccttagctgttaaagcctctgtgaagtgggggagtgaggtttgattattgttgcagctataacagtatcctcatagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccaggtgggcctggccctcacttcagtgccttctcttccccggtgctggtgactcagggcatcctgcaattcatgcttgttctttctttgctagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaaggtttgttcccaaggcatggttttcgtgtacatagagtcatgcagacccaggcaggctgtgggtgtgtgtcctgatatgaggcacctcatggggactggtatgtccctagagctgtgttggttccttaaccaagaccacttaactcacctcttatttattgagggatgtctcggtgcctctgttgcactgaaaagatcaaaacccactttgctgctgatgtgaaaaaatacacaccatttccaaatggcatttctcttttctttttggaaatttgaggatttcttaggagacagcaattgtatttcttctcatcacttgacaagcattttgcattactaatgaacacagcttactatttgccgggtgctgtgctgggactggagatgttataatgaacaagatagatagagtccctgggtctagacaataattaagtaactggacaaattaacttaaaaattacaagttataataagtgctgtatcagtcagggtccaactagaagatcagaaaccaatgaagtattagaattttaatgcagggaattggttacacaggtggtagagagctgagaaaccaaacaggggagagagaggcggctcagagattagacacagtaaggagcagctactacccaggacaggagtgacaaggaaagcagtagtgtttctggagccaaggtggagtcgccctggggaaggtggaactgtggtggactttccagtggaaactggagccaaggggaagaggtggcagctgcagagatgcctcccaaggcagagatggaggcaggcaatacctcgtttgaccctttctgcaccttccaggttctcccagtggctgccatgggccaaacctagccagaatcctgctggcacacttgggaaacacaggagaggatgaggaatggatctgagggcaaacaggcccaggagcagcgcaagtgctatgaaagagatgaataaggatgagatggggttaggggagagaaaggccgggaaagagagagaaaaaatccttttttagactgggaagtcagggaaggcctctccaaggagatgacatcttagcggatgcttcagggtataaagaagctagctatgtggccttccagatagaagaatcagctagggcaaaggccccccagtttcttccagaaggcccatgtggttagaggtctgttaaaggaagaagtgctgtgaccagggctggaggacttgtggggcccagatcagactggccttgtgctccctgataagaagtttggattggagtctaagtgaaatgagaagccctcatcctttcacagtttatctcaccctgggctttatcagattttctgcctgcccggtaccctgcaaacatcaatagttgacatggtagacctttgagccctctccgacctagtctgtgatcacactagatactgcctcagttttaaaggcaagtcttttcctttcttggttgtgtagaagctcgcattttcttaactcgtttggaaagaagtaaaaagttgactactggtgtaaaggcaagaacagagcttcaccactcataagaccagtgctttccttccttgaaaggatggtgagcccataaaggcaggagtcactggtgccattggttaacctctgagtgccagccttgtgttggataaggtggggtggccccagccccagcagtgtgctcatccctggagggtcaagaagagtatgactgtagagaccctcattcacactccgtgggtggaacagaagggctgacttcatcaagtgaatggtctgcagggccttctgtgtgttatgaattgagcatttgagacccttaacaatgagaggaaaagaaatcctggcattttttattactaggaacaataagtttctggaaccagtttccactacagagtgacactgggcctgacatctgctgaagcgactgtgctcttctcaatgcccagactcagggcaaaatggaagctttcttactctaagtcttaatggtgctctgtggtttccagaaattcccctgcaaacttctctccaaaaactttgttctgtccttgcctaggttatggtgtcttagtttgcatctgtctgcgccatttgactagacgctccttgaggactggatccattgtggaacttagttggtgggcagtggatgtctggcagaggaagacatcctgcctccccattgccaccatggacactacatcagggtggctgcaacttcttggacctctgtgttctgccactcactgtcatgctctgtgactttggggaaattaggaaacctctctgggcctcagcctcgtcctcatctataaagtggagatgctaacagctaccttcatggggtgttgtgaggaatgagggaatccacaggtaaaaggcttcggacagtgtctggttatagtgcatcccgagtaaatataagtgatttctctgacttcctgctgctgagacagggaacaatagcagctcctgccattgaatacttactatgggctaagtactagcctgtgtaggttggattcattctttaattctcacatcgagcttatcaaatggatattcttagtattctgattttgcagattagggaacgaaggctcagagaagttgaatttactttcacaaagacacatagtgagtaaatgacagagcaagaactagagcccatatcttttgaatctagaccccacacttcaaccataaggctatcccctcttcaggtaggggtggagtcttcggttccctggtctgtagaccctggaatgacactaggtgctgctccctagaatgtaattgttgcttctaaatgaaatggagggaaactggtcaaagctcccgctctgtccatcggcttctttcctgaaaaaaagcttggtccctggactgtcagatgccccagcatcctcctctggggtctgcccatacccaattttgtcttttagtttctcttctcactagaggtgcctttatatgtaaatgttcgaaagttaacattttcatggaggacaccctctccccagctccctctttgtctgtggcacctcccatcccatctcctatttattcttactttacacagaattctataatctggctatattgtttcttatcccgtggcagatttaaagaagcaaattagaagcagggagagagacttctacaggcagggtcacagaggtgatgtgtggtgattataagcctgggctttggggtcagacctattgggttcaagtggcagccctgtcacttactactgaatggccttggtcaaagctcttgactgcctgagctggtttcctaaactgcaaaatgagaataataaaaggacataccttgtgagaattaaatgagcgaatacacaaaaaatccttagcgcagtgcttggagcaccattaatgttcctgttttgttattgttgttattagacagtcaacagtgagagaggaaacaaaataattatgaaaagcaggcacaagaatttgaagcacagtagtttagggataacacacctctgagatcataactggataatacagtgatgatcctgggtcattgagaaaactttaaattatgttcagcatgctttgaggaagaatgcaggaattatgtatttttttaagaagccagataaaaattgatttttaaaaaattaggatatagttaaggctggcaagatggccaattaggaacatctccggtctgcagctcccagtgagatcgatgcagaagggggtgatttctgcatttccaactgaggtactggttcatctcactggggctagttggacagcgggtgcagcccaaggagggtgagccaaagcaaggtgaggcgttgcctcacctgagaagcacaagggatgggggaattatcttccttacccaagggaagccttgagggactgagcctgaggaactgtgcactctggcccagatactgtgcttttcccatggtccttgcaacctgcagaccaggagactgcctctggtgcctacaccaccagggccctgggtttcaagcacaaaacagggcggccattcaggcagacactgaactagctgcaggagtttttttttttttttttttttctgtaccccagtggcgcctggagcgccagcaagacagaatcattcactcccctggaaagggggctaaagccagggagccaagtggtctggcttggcaggtcccagccccatggagcccagcaaactaagatccactggtggccaggcgcagtggctcatgcctgtaatcccagcacttagggaggccaaggcgagtggatcacctgacgtcaggagttcaagaccagcctggccaacatggtgaaacctcatctctactaaaaatacaaagattagccgggcgtggtggggggcacctgtaatcccagttacttgggaggttgaggcaggagaatcgcttgaacccaggagaaggaggttgcagtgatctgagatcgcaccattgcactgagcttgggtgacaagagcaaaactccgtctcaaagaaaaaaaaaaaagatccactggctcaaaattctcactgccagcacagcagcagtctgagatcaatctgggacactcaagcttcgtagggggagggtcgttggccattgctgaggcttgagtaggaggttttaccctcacagtgtaaacaaagccaccaggaagttcaaactaggtggaacccaccgcagctcagcaaagctgctgtggccagactgcctctctagatttcttctctctgggcagggcatctctgaaaaaaaggcagcagccccaatcagggacttatagataaaacccccatctccctgggacagagcacctgggggaaggggcagctgtgggcacagcttcagcagacataaatgtccctgcctgacagctctgaagagaccagcagtcctcccagcacagcgttcaagctctgctaagggtgagactgcctcctcaagtgggtccctaacccccgtgtatcctgactgggagacacctcccagtaggggccgacaggcatctcatacaggagagctctggctggcatcaggcaagtgcccctctgggatgaagcttccagaggaaagaacaggcagcagtctttgctgttctgcagcctccactagtgacacccagccaaacagggtctggagtggacctccagcaaactctagcagaggggtctgattgttaggaggaaatctaacaaacagaaaggaatagcacatctaatcagagaccacatccgaaaatcaccagcatcaaagaccaaagatagataaatccacgaagatggggatgtaaaccagtgcaaaaaggctgaaaattccaaaaaccagaatgcctcttctcctccaaatgatcacaactccttgccagcaagggaaaaaaactggacagagaatgagtttgaccaattgacagaagtaggcttcagaaggtgggtaataacaaacgcctctgagctaaaggaacatgttctaacccaatgcaaggaagataagaaccttgaaaaaaggatagatgaattgctaactagaaaaaccagtttagagaagaacataaatgacctgatggagcagaaaaacacagcacgagaacattgtgaagcattcacaagtatgaatagctgaatcaatcaaacggaagaaaggatatcagagattgaagaccaacttaatgaaataaaataagaagacaagataagaggaaaaaaaatgaaaaggaatgaacaaagcctccaagaaatatgggactatgtgcaaagaccaaacctacgtttgatggatgtacctgaaagtgacggggagaatcgaaacaagtggaaaacactcttcaggatattatccaggaaaacttccccaacctagcaagacaagccaacattcaaattcaggaaatacagagaacaccacaaagatattcctcgagaagagcaaccccaagacacataatcgtcagatgccccaaggttgaaatgaaggaaaaaatgttaagggcagccagagagaaaggtcaggctacccacaaagagaagcccatcagactaacagcagatctctctgcagaaaccctacaagccagaagagagtgggggccaatattcaacattcttgaagaaaagaattttcaacccagaatttcatatgcagccaaacaaagcttcataagcaaaggagaaataaaatcctttacagacaagcaaatgctgagagattttgtcaccaccaggcctgccttacaagagctcctgaaggaagcactaaacctggaagggagcaaccggtaccagccactgcaaaaacataccaaattgtaaagactatcaacacttcgaagaaactgcatcaactaatgggcaaaacaaccagctagcatcatgatgacaggatcaaattcacacgtaacaatattagccttaaatgtaaacgggctaaatgccccaattaaaacacacagactggcaaattggatgaagagtcaagacccaacagtgtgctgtattcaggagactcatctcaagtgcaaagacagacataggctcaaaataaagggatggaggaatatttaccaagcaaatggaaagaaaaaaaaaaaagcagaagttgcaagtttaacctctgataaaacagactttaaaccaacaaagatcaaaagagacaaggaagggcattacataatggtaaagggatcaatgcaacaagaagagctaactgtcctaaatatatatgcacccaacacaggagcacccagattcataaagcaagtcttagagacctacaaagagacttagactcccacacaataataatgggagactttaacaccccattgtgaatattagacagatcaacgagacaaaattaacaaggatattcaggacttgaactcagctctggaacaagctccaacccaaatcaacagaatatacattcttctcagcacctcatcacacttactttaaaattgaccacataattggaagtaaaacactcctcagcaaacgcaaaagaatggaaatcataacaaacagtctctcagaccacagtgcaatcaaattagaactcaggattaagaaactcactcaaaaccacacaactacatggaaactgaaaaatctgctcctgaatgactactgggtaaataaggaaatgaaggcagaaataaagatgttctttgaaaccagtgagaacaaagacacaacgtaccagaatctctgggacacatttaaagcagtgtgtagtgggaaatttatagcactaaatgtccacaagagaaagcaggaaagatctaaaatcaacaccctaacatcacaattaaaagagctagagaagcaagagcaaacaaattcaaaagctagcagaagacaagaaataactaagatcagagcagaaccgaaggagatagagacatgaaaaactcttcaaaaactcaatgaatccaggagctgttttttttttgaaaagatcaatgaaataaatagactgctagcaagactaacaaagagaaaaagagagaagaatcaaatagacacaataaaaaataataaacggggtatcaccactgatcccacagaaatacagactaccatcggagaatactataaacacctctatgcaaataaattagaaaatctagaagaattggataaattcctggatgcatacactctcccaagtctaaaccaggaagaagttgaatccctgaatagaccaataacaagttatgaaattgaggcagtaatgaatagcctaccaaccaaaaaaagcccagaaccagacagattcacagccaaattctaccagaggtacaaagaggagctggtaccattccttctgaaactattcccaacaatagtttggagctggtaccattccttctgaaactattccaaactcattttatgaggccagcatcatcctgatgccaaaacatggcagagacacaacagagaaaatttcaggccaatatccctgatgaacatcgatgtaaaagtcttcggccgggcgcggtggctcacgcctgtaatcccagcactttgggaggccgaggcgggcagatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagtcctcaataatatactggcaaaccaaatccagcagcacatcaaaaagcttatccaccacgatcaagttggcttcatacctgggatgcaaggctggttcaacatatgcaaatcaatcagcgtaatccatcgcataaacagaaccaatgacgaaaaccacatgattatctgaatagatgcagaaaagtccttcaatataattcaacaccccttcatgctaaaaactctcaataaattaggtattgatggaacgtatctcaaaataaaaagagctatttatgaaaaacccacaggcaatatcatactgaatgggcaaaaactggaagcattccctttgaaaactggcgcaagacaagtatgccctctctcaccactcctattcaacatagtattggaagttctggcaggggcaatcaggcaagagaaagaaataaagactattcaaacaggaaaagaggaagtcaaattgtctctgtttgtggatgacatgattgtatatttagaaaaccccaccatctcagccccaaatctccttaagctgataagcaacttcagcaaagtctcaggataaaaaatcaatgtgcaaaaatcacaagcattcctgtatactaataacagacaaacagccaaatcatgagtgaactcccattcacaattgccactaggagaataaaatagctaggaatccaacttacaagggatgtgaaggacctcttcaaggagaattacaaaccactgctcaaggaaataagaaaggacaaaaacaaatggaaaaacattccatgctcatggataggaagaatcaatatcatgaaaatggccatactgcccaaagtaatttataggttcagtgctatccccatcaagctaccattgactttcttcacagaattagaaaaaaactactttaaatttcatatggaaccaaaaaagagcctgtatagccaagacaattctaagcaagaagaacaaagctggaggcatcacgctacctgacttcaaactatactacaaggctacagtaaacaaaacagcctggtactggtaccaaaacagatatatagaccaatggaacagaacagaggcctcagaaataacaccacacatctacaatcatctgatctttgacaaacctggcacaaacaagcaatggggaaaggattccctatttaataaatggtgttgggaaaactggctagccatatgcaaaaaactgaaactggactccttacaccttatacaaaaattaactcaagatggattaaagacttaaatgtaagacctaaaccataaaaaccctagaagaaaacctaggacattcaggacataggcatgggcaaagacttcatgtataaaacatcaaaagccatggcaacaaaagccaaaattgagaaatgggatctaattaaactaaagagcttctgcacagcaaaagaaactaccatcagagtgaataggcaaccttcagaacaggagaaaattttttcaatctatccatctgacaaagggctaatgtccagaatctacaaagaacttaaacaaatttacaagaaaacaaccccatcaaaaagtgggcaaaggatatgaacagacacttctcaaaagaagacatttatgcagccaacaaacatatgaaaaaatgctcatcatcactggtcattagagaaatgcaaatgaaaaccacaatgagataccatctcacgccagttagaatggcgatcattaaaaagtcaggaaacaacagatgctggagaggatgtggagaaataggaatgcttttacactgttggtgggagtgtaaattagttcaaccattgtggaagacagtgtggctattcctcaagaatctagaactagaaataccatttgacccagcaatcccattactgggtatatacccaaaggattataaatcattctataaagacacatgcacacgtatgtttattgcagcactatccacaatagcaaagacttggaacccacccaaatgtccatcaatgatagactggataaagaaaatatggcacatatacaccatggaatactatgcagccataaaaaagatgggttcatgtcctttgcagggacatggatgaagctagaaaccatcattctcagcaaactaacacaagaagagaaaaccaaacatcgcatgttctcactcataagtaggagttgaacaatgagaacacatggacacagggaggagaacatcacacactggggcctgttggggggtgaggggctaggggagggatagcattcggagaaatacctaatgtaggtgtcaggttgatgggtgcagcaaaccaccatggcatgtgtatacctatgtaacaaacctgcacattctttacatgtaccccagaacttaaagtataattaaaaaaagaaaaaaattaggatatagagggaaaaattttattagttgaaaaatttggctatctaggacagccgcttccctagaatgttttgagtgaaattgagaaacatatgtgctttatgaattgagcatagcacagctaaagtgttgctaagtcacttcattttatgaaacttgtgaaaataagaatggggaactttttaaacattcaggatcattgacaaaggagcttcatttgaaatagtcaatctatccccttttaaagttagggagagattgggctgggcgcggtggctcacacctgtaatcccagcactttgggaggctgaggcgggtggatcacctgaagtcaggagttggagaccagcctggccaacatgtagaaaccctgtctttactaaaaatataaaggttagctgggtgtggtggcacatgtctgtaatcccagcaactccggaggctgaggcaggagaattgcttgaacctgagagtcaaaggtttcagaaagccaagatcaccccactgctctccagcctggctgagggagggagactctgtcttgaaaaagaaaaagttagggagattgggaagccgaggtgggtggatcacttgaggccaggagtttgagaccagcctggccaacatggcaaaaccctgtctgtacaaaaaatacaaaaattagctgggcatggtggtgtgcgcctatggttccagctttttggtaggctgaggcacgagaattgcttgaacccaggagctggaggttgcagtgagctgagatcgtacccctccattccagcttgggcggcagagcaagaccctgtgtcaaaaaaaagtaaaaataaaaataaagttagggagagagattgtaacacttaagttaacagatagtacagattgcacttcattttcatctccaggtctttagggaggaagggcagctgggaaggattgaggaagggagaagcgaaggtgagtggcaggagatgagtggagattacagtaggccaggaggggttgtggggaagggaggatggagaaagaaggggcaggtttccagaggagctcagggagagacagagggtggggctgtgagttttcacacctgattggctgcaaagtgttagaatcaaagttacacccacctggccaggatgctggtcatctggctgcatatgcggagtgagtgatctctgtgcgcccctgctctctctgtagggacccctgttatagtgcccatcgtgcagcatatttctccagataggctgggacctctggtctcaagtacagggaaggtgtcagcccctcttagttccctccttagatgggggtcccaattccaggtgagccaatgcaggggcagcgtgagcagcagcagtgtgagcctatggaagtggaggatgcctgtcccgcctgatggcattcagattcccagtgtttgcaaaactctgtgctggtttgtgacttctgattccaacctttattttagcgtaacaattctcatgtggaggggctgccagaatgagctgagtgtgcgtgggggaggagttcaaaccagcctccatgttctgaaatgtcccccctctgaccccattgctccactgctcccacccctagtctggattaagtgtctcctctggggtcccaaaatatccagggcatctcattacaccaaccacactgtatgataatctgtggaactgtctgggttcatctcagccatcacagtcggcccctggaggcgggagttatatcttatctactcctctacacccagggcctggcacacagtagtttattgaatgaagtggggtccacgtgtggcccccagctcatagtacacatatgagagcctggtgaaaggttggctccagtgcccctccctgcctagtagtcatctggacagaccacacagggcagtgggcttcagatggcccctggtaagatgctggctattctctaggagagcaaggtgggcctgaagggctcctcactttagcatttgagtgctatatagggaaggccctgggagcctgattccccagagcggaggagggctggggagtggagcagagtaagggaggggacttagtgactgtcaggggcaaccaagggccatagagcaggtggagcaccagacaggtgctgggaggtaagatgctgtaacaacagcccaggtgacctgatcaactctttgtcttgtgggcctggttagcaagaatgtccttgtgcgtcaagaggataaatctatttcagggatgacaaaactgctcctggccctttgagccctcaggcttggcctggagctggtgtcctcacagccccacactctgctggctccttggcaggagtgtgcttctgccaggtgcaagtgtgggtgggggaaggagggggtgtgccagctgtagcccagcaaatgctggcgccccaggggctagtgcaaggtgcagcaggtgagatagtggacagacagaccttggcccatcagaaggaagtgctttctaacaggggcaccagatcagttttgttcatacacacactcatagacacactcactcactgtattagtttgcactgctataaagaaatacctgagactggtaatttataaaataatgaggtataattggctcatagttctgcaggctgtacaggaagcatggcagcatctgcttctgaggaagcctcagggaactttgactcatggtgaaggcaaagcaggagcaggcgtcttacatggtgggagcaggagcaagaggcagcgagagtgggtaggggaaggtgctacacacttttaaatgcccagatctccatgaaaactctcactagaacagcaccaaggagatggtgctagaccattcatgaaggatccacccccatgatccaatcacctcccaccagcccctacctccaacaccggggattaacatttgacatgagatttgggcagagacatggatgcaaaccatgtcgcacaccctctgacacttacgcccacacgcccactcactcagctccaaccctctacctttactggctgggcctcggttgtatagaatggatgctagatatgggcctaggggaggtagaatttctaaaacggcccctgcagatgtccctccttaatctccagatgcagtgaataagatgagttatcactcctgtgatgatgttatggaatatggcacagttgaccttaagataggggggttattggtaggcctgatttaatcccatgagcccgtaaaaatagagagctttctgagtgtaggaggggagggcagagagattcaaagcaacagcacaatgaccactcctggttttggagatgaagggggctatgtgcagggattggagtgaggtcaataggagttgagagtgacccctggtcaaagccagcaagcagcctgggactccagccttgtgggcactagacctgaattctgccaacaaccggaatgaacttggaagtgaattccttcccagaaactccagacaagagtacagtgtggctaacatcttgattttggcctcttgataccctgagcatagagcccagccaagcccacccagacttctcacctatagaactgtgagctaataaatagctgttgttttaagccatcaagtttgtggcaatttgttctgcagcaatagaaaacaaatccagggtcatccttgggctccatatagcttttccaatttcctgagatacaagctgtggttaacttccagttcttccaagctcaaggggagtgagccctgaggagttagcctatctgtggttaaacctatcccttgtgcctacagagtctgagctcctggcccgcagatgctcatatgtgacaatctggagctcaactgaagaccaaggttgtcgccataatggatatccccaggaaggagaattctttgggcaccagtttgtgggtactagcttcctcactggggcagaagaacattcctaggacaagcctggtaggctgttggcttaggcagcctcccagcatttgggctgtagtgtttttttttttgtgtgtgtgtgtgtggtttttttttaaactttcttagctgttgctcaccttagatgtcacctgttgcttcttgttggtaggaccagacctcaggcagccttggctgaggcatttggaggtgaggttgcatggaaataaaaacagtgagctggaaggcatgtgtgagtgacacagaaaccagaatctcatgcgtcccagctgaggtcagaatgtgttggggagcccaaagtaatggctcttcctctgggtgtgggcattcaaaagatgccaaagggagaacctcatcctcaaggtgaatccgcctctgaggagtgactgacaaggtggcatccctggggcaggatgcttggctgagctccatttgatggaggacagaccagagaaagctgaggctgggggctcccagggctcaggttgagtttcccgaagcagtccagtgcatcacttagcaggaccaggggcaaggggaaggtaaattcctgaaaaggagccacctctgtcttgcaggttaaaatagccttgtcccaaagatgtgataacacagggtaggcaggtgagaaccagagggccatggcaagcactgggtgtgtaaacacgggaggagaactgtggttcttgaaaactcggcagtgaggatacctggccacaggccaagaggaagagagctgcttctgggtaagccctgaaacttatttggggatcaactgatttcttcaggcctgtaggtatcacactagtacctggagaggaggagggctctagtgggtcacagttgtcactgagtccttgctggtggctgtggttgtggtagaataaatactcaggaagctactgggcccatggcacaaggtagggcaggtggtcagttggtttctggcatttgacactgtgggatggcaccgtggggaggccgggttccactgggggcagacagaaacatgaggtaggagaagagtgctgatggcctcaccttaatgctgggtaatttttctgcagaagagacttgcagtgacataatctgatgtctgtttcatgaatgaggaaggtagagtcatcacaaatcagccttgcaaataagcatgggcttgtggcattttaaaccaaccttgggcccaagagccagtgtaatcatcttttggtgccaaggcaacaggtccagagggacctgaatttggtgccgatcaatccctctccccaaacagaggtacatatctgtgcctgctctagcagcggcagtcaggatggtacacggcgggctagaggagggagcagcagggctggaggctgggtggagcagccactgtgccatgggccgtgtgactttgtgccagccctttcccatctctgggaaagtgtctgtgagaagtaggctgatcttgcagatctccttggcacccagtaggtctgctgccagccatggggcctatgatgcctgtaagcttggatggcggtcgctagtccacggtcctgagcactgtctcgactcctttgtaaaacaaggagattggattcattgagcatccctctctcttctggctccaatgccccaaatgtctaactgtgtgaaatgcagtgtgattgtctctctgtgaccctattcctggtcctttctgagaccgttcatatgttgggactgagagtttgtgttatctgaagccagcatgctgtccacactgtggggaaagcctgcatgatttgctattgtcctcccctctagtgccctgtggttttagagcccctgccatgtggtctgccatttgtctctctgtctcctagggcatttgcctgctttaatcttctgtgggctgtgcaaacagccctgagcagtgcatggtgaccacaggtaggggtgtctggagggccgtgttctatctcaggcagacatgtgtaagaggaaggcatgaataattagaaacttcttaatggtagggccagcaccagtgattaatcatagcaaaattctcctgccacgcacacagcaaagagtctttatcactcaccccaattagcttctgatgtctcccacttttccttgtccttggctcttagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccggggtaaggcgtctgtgagagtgttgaatgtgccttgcatgcaaaggccaggggccccatgggccacagggtcgtgcctccctctggagcctggccctgtccgtggatgtctgggagaaggtgaagaggaggcacaggagacaaggagggccctagcagaggttgtggggtgtgggtgtggtgtctcggtggctgcctgttccccgtgaggagggtcccggggtgcaggctggcacactgtgtctgtgactcgtaagttccacatgttctctaagtccagaaagctggaattggtccctgtagcctgttgagaaaggtgccagcttgggcctttcagtgttgccaaatgtttagtagattcaaagccatggtactgagtggtttgtgtgaaattagttgttgctaaatcatctcttcttatatgtaggttcaatacccttaaatataggctagatcccttcaaccaggaagagagaatcttgtttagaaattgagcaaattggtttacactaagtcaattaacgcagtcactgaaaatgtgctaatttcacctgattggatgatgcattttttatgcatgtctgcttcttggagagaaatatcactgagttagtgccagggttaagtttggctccatctccctggccccaactcactacttaacgcctcagttggcttcattagtctctttttaacagtagctgtagaaaatatggtgaatctgagaaagcaatgcagcttattgctcttcctataaaatttcccctagctttcaaaaatttttttggttatgtgtaatggagaacacttgcagatggtacaaaatttaaaagatacaaaaatggtatcaattattcagccacccattctcctcctcagaggcaaccactggttttagtttcttatgtattctcacatatatggtctatgtacctacaattatttatgcatacatagtttatttacttatttttacaaaaatggtagtttacaatatacattatactgcatcttgcattttccacttaacaatacatcttaaagataatgccatatcaatatataaagaacttctttgtccttttaaaaaatatgtacatagtattcctttatgaggatatatcatagcttattttaattaagttcccatggatgggagtttaggttgggttggaaacaatgcaggccttgtctggagatcagcatcctgaccatgagtctttggtgttcacccaacctgaggcaggtgggcagggcattggaaagcaagagtcgaggtgggtcggccaccagctgaatgggaggatgtcagcctgtagcatataatagcttctttctcccagtctcctggctggcacagagtagtgcatggagcacctgaactgggcaactggtcctcagaaagctaagtgtctgtgagaggcaggctgatcttgcagatctccttggcacgcagtaggtctgctgtcagccatggggcctgtgatgcctgtaagcttggccggtggccacgggtccacaggggtcctgagcatcctctctgatgtccttagccatggcatgagccccttgtcatgctgagtccattggttccccagagaaagaatttggcttcgttgttggcagggacatatttttgtctaggatgtcggtgtctgctcacctattcctgccgctctcagaagccatccactggaagatgtaaaaggaattaacataccttatggggacatttggaggcaggaaaggagaatctaccatcgtaacaaaaagtcttgctttttgtatttagtatttactaaatactacttcttagtagtatttagtaaaagtataaaaacatgcataggaaaaatatattcagacttcttccctctgaggatggggtagggaggagagtagagttttagctgtatctgtgatgatttatttctttaaacctgtgagaaatttgaaagaattatgctaaatattattgtcagctctagaaggtaggttatattatctttggtgcctgtctgtatgtttaaaatattacaaaattaaaaatgatgattttattaaagcagaggagatcactttcaggccccagccctccccactctgggctatgccagcatatggtgcctccctctgctgttccccttaccctgcattgtgtctgtctggccacttgtctccccaagcatatttctgcgattcccatccttcccaaacagactaagattaatgagcctgttggaaggcgggaatttatctcattcatctttgaatatgaggctgctctggtaaagcagaacatccttagactttgggactcaatcaggttagagtctgaaatttgactctgtagcttcctggcaagtgatttatcctctctgggcctcagttttcccatttgcaaaatgggttgctgtaaggagcaaaatgaaatctatggaaaggtctggcacataacacatgacaatggggcttgttgcctggatgagttgggtgattaacagagttaatcagaagtgtggggttggcaaagaagcaggctgagcatgcagaatttgcttttgcttcttgttttgtttcgccatctgaaggacacatgaattttctcaactgaaaatgacggtgctcatcgccttcagggataggactcaggctttgtccctccatgggcctggtacaaaaacagacttttggcttaattagctgcatgtgaggccggcttctgggtgtgcaggctggagcacttgtctgtcttccaacgaccctaactcctcctgtgtctcctgtgttgggggtctccaagaccactccaggttggatgattcaccaggaggactcacaggactcagcatatagctgtacttacagctttgatttattacagtgaaaggatacagagcaaatcagcaaagggagcgatacatggaggatacgaggtgcaagcttccaaggtcctctcccagcagagtcatcagaacataccaaatacctccagcatcacattgtgacagcacatgtgggaagtgttgtttaccagggaagctcattagagattcggtgcccagggttttcactggggctggtcacatgtctgcatagcacatctcaaattccaggctccagaaggaaagcaggtgtccaacataaaccatattgtttgtacaagtagtttaggtgcaatgaaccactcttattggtcaaggagtggtgagaaccctcctgaaatctaggttcccagataccaggcaagggccaatcttgcaagcacatctttccaaggatggcagtctcaggcctgctgcatgaaccctttcctgcctgcctcccttctgcagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccaggtatggagctctggctggaggttgggtcccaagtgtgggcagaccgagagctagtcagggcttttttctggctcggtctatttcccctgatagtattttaaaatgacaatgttctttcattggcttctcccacactgatgtttgatggttcccccaaggattgattctatgtgtactgtatgcctagcctgtgcagagctgaactgttgaagtcaagacagagatgtgaaagacagtccttgttcttgggagtccaccagggagacagggagtctcatgtgggaattttttttttctttttttttgagatgggtcttgctctgttgctcaggctggcatgcagtggtgcaatcatggctcactgcagcctcaatctcctgggctcaagcaatcctaccacctcagcctctcaagtagctgggatcaaaggcacacaccgccacacccagctaattaaaaaaatatatattattatgttttgtagagatgggggtcttaccatgttgcccaggctggtcttaaactcctgggctcaagtgatcctcctgccttggcctcccaaagtgctgggattatagatgtgagtcactgcgcctggcctcatgtggcatatttaaaagaacacaatcacacagtaaatgccaaattggtggtagggtggatcggggtgggagtaggaacagagggcatgttccctgggaagacatgtaggctctggtgtcaaacacacctgcatttgtatctgggctctgtcaatttcttgggattttgggaaagatatttctctaagcctcactttgtaaaatgtaatctgtaaatggaaatgcaaataatacctatctcccagggctgtcgtgaggattaaacaggagaatgcatgtgaagtacttagttcagttctggcatctagtgagtgttcaataaatggtagctacatttatgctgccgagttcagggaaggggaggtcggagagggctaggtggtttcctcatgaagccttgccatgaagaacctaggagcagtagaggcagtgatgaggacagtaggaaaccccactcctgaaagttggtggtgggggacacataagggcctggtggtctccatcaatgcctgggaccctggctgcctctgggggtagctggtggtgccaagttgccccagtctctggcttccttgaatttcaagtcctgtactttgagcatctggggccctaggtaaatctcagccctttgggcctatttccctatctgagggaagtgggtcctaccaccccagttttggcaaagacagacagaaatgactgtcaaatgtgtactttacatggacagaggacccctgggttctgggcatgagtatggggaagaggagcaacttccgaacatgcaggctgtagcttcacccgggccttgaactgcctgcatctcacagaccactgcattgcattagggcctcctgagctggcctgtggccgtgcctgatggggcattcccctctccagctctgcctgcatcagcccctctgtggctcctcacatgtgctctagggatggtctgttccttccaagcacagatggaggatgcccaggcaggtcactctgccttggcagcttcctttgatgcagatcttgaggtttgctcctgcctatgctggcagctggacagctgatcctggatggtgctggctgagctgcatggagttgaagcctccagctctactgatatttagcatcaatacactccttggccagggacagagtttatcaagagtcaggaaaactaattatgagaataataagaataatatcctataattcattatttgtagtgcattactgtttatgaagaattttcctatacacactattgcaaccctcacagcagcgtgttaaggcagggggtgttatcttcagaggagataggctcagagaggtaaaggagtttgctgaaagtctcacagcagggaaattgcatagaggagttttctacctcctgttggctaattctaaccttaacctatagtggttgggggcagatggctttatcattggcattctctgctctgggggagacaagttccctatcctttgctcctttggggagggagtggcttctttatctagcccctcacctggcctgggctcgggacagttattcccactgggcagtccaggtgcaatctgtttttttcctgggagaagacaccgctgctctttttaatattcctggaatctctgaagtgccgaggaaaatgaagcccatttcagttaaattttaaaaaattgttgaagtgctagccatgtgccagggactgttctagacactcagcagtgaacagcacaaattaaagtctctgcctgcatggagtttctattggagtggagaagacatcatatctgagataaagaagtgacatggtttgacatggtggtaagtgctgacgagacaaaaggaagcagggaagagcatatgagatgcggggccggcgcagggttggattttgggcaggaaggccagcgcaggcctccgtgtcttttgagcccatgtgtgctcacaaggtcaggggcactttgccatccctcaatcctgttttgcagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgtaagctagcttctccgcggctgcctgtctttgcacaggtgctgttctgtaggaaggagatgagaaaggcctcacccctctgccctggggtcccctgtacttaaagcatcccagaaagagcgcggtttctcctttcctcagtgctttgcgggtttctgcaacagttttccttcataagctggcatagcctttgacttggtactccctgtcccctcttttgtttttgaggcaccatcttgctctgttgcccaggctggggtgcagtggtgcgatcttggttcactgcaacctctgcctcctgggttgaagtgattctcttgcctcagcgtcctgagtagctgggactacaggcacgtgccaccatggctaattttttatatttttagtagagacaggggttttgccatgttgcctaggctggtctcaaactccagagctcaggtagtgcacccaactcagcctcccaaagtgctgagattacaagtgtaagccactgtgaccggcctccctgtcccttctgcgtgcatagtgtggagcctctgcttgctggtagctacctgggtgcctctgaatggctgtcatccctctccccaggcaggacagcagccttgcagagagttaccagcccagagcataactatttggtgaggagtgatgaagacattgcttcaggccttgagttttctgggtttctggaggggagcatgcagggagcctggggaactttgctcatgggcatggtgcaccatgatgctcgtgggcttggctccagctaacctggtgggcagccatctttctgaatttggcccctcacttcttggtgggcacttaggctgatcagtaatacctggactctgtgagcctcagagtggctgtgctgggagtgggagtctgggtgagaggaggtgctagtcactcctgaggaccttctctcttgttttctgggaatcttgtgatgccagtctcgaaagtagcatagtgagcccaatgtggatgggcagcatgattcttagtcctccctgatctgagggcagaactaaggcatgggaagggcaggggcggttcctcagaggctgtcctcagccaggtgtgcaagtagtggctgtcccatctgggaggctgtgaggatcctgcctagggagagagactgagtgagatggcctttaaactcccttccgactctgaggctgtcctgtgctccgtccactctggggcttgtctgggcagatggatgactgtgctgttgcagtgccggcagatgctcttatggaagtctacgtgattagatgccaaggaagctgctgtttgttttgggggcctgaggaagcagggtagcgtgaattgtggtcgaaggttccatgcggctgtggatgcaggtgtgtggctaggcacctaggctgtgtgtgggctggcagttggccacagcagtgagcacccccatccccaaaggcctttgctggctgataaatcatgggccccttctctgagttggtgggaatctgggggcatcagtccttacagagatttctgtctcggtaacaaatatccctacagtcccaatccacccatgatgcaaaatatcctcctcttgtcgtgaagcctcagagttgagagatccttgggccgtggccattaggtcagggggctggttcctctgcaacccaaggtgggcaggtcatgccttatagtttgactgtgttatcaatcctctgggcaacaaactccttcttcaaggaatgacaagtggctgaggatagaaaagaggaaggaaaggaggagatgaaggagggagacttccactgagcatccactctgcttggactcaggccctttcccaggcataaaccagtttaacccttacttcagccttgggtgttaccacctgatatttactcatgggaaatggaggcttgcggttaattccctaaacacataaacaagaagtcaaaacacctgtatgaggtcccagagctggcctgctactgccccatctcctgactctccactgactttatagagtctgtggatatgactcaacagttcagcagggtctgtagaaagccagaacctcctcattccgccctgctccgtcctgacccttccagccagggttggcccctgcagatgctggaggcctccaaactggagagctcgatgcgactcaactatggtctctccccatctccaacttgcaggaaaacctattgtcaccggcgactgaactttctggaatccaagttcagccttcatgagatgttaaacgaaatgtccgagttcaaagagttgaagagtaacccccaccgggacttctataacgtgagaaaggtgcgttaggggcgagtgttcacagctgcctcacccggtccccctcccagcccatgggatgccctgagccagtctgaggcttgtcccctgtgagaacttcagggctccttgctaagggcggccttcgtggccagaggggtatgaagcatatgtgcagaaggaagatgggtgagctgcatttgtgtcaggctgggcctcagacagcacttgaatcactctaggtggaaacatttgtccgcattgtatatctgttgggatgtgccctcttccttggaaaatagggcacagcctattaattggtcataaaagttgagcacagcctacttttaaggtaggggatgtattagagtcatcaaagaaagacacagctgttaagatctctttggtcccctccttgtgtccatgtgttctcattgttcagctcccttataagtgagaacatgcggtgtttggttttctcttcctgtgttagtttgctgaggatgatggcttccagctgggcttaatacctaggtgacgggttgataggtgcagcaaaccaccatggcacacgtttacctatgtaacaaacctgcacatcctgcacatgtatcctggaacttaaagcaaaataaataagtgaataaaataaaatttaaattccctgaaaaaaaaaaaagatctctctggagatgggagtttgtggttttgcatccttcgggatcatgtggatttaaagaaaagcctctgatatgctcagatctctgcctctcttctcccaccaaggggatggcagccttgtccggggctcctggcagtctccgcctgcaggggccgcaactgcggtaggagcgaaggttaaatgatcatggccctagcctttccattctcttttgctgaagcgctgtgcagtgaggcacagggtcagtgctaggcagggggtgtttgatggtgagcaagagtcacttcctgtcaaccaggtggctttgagggagaggccagaactgagctgacttagagtgagtaggagcttgccaggcagagggtgtggtaggggaatggaagtggtggcattccaggtagaggcacgtgatgtgcaaatgtcaggagggagggatggtatgagagagtcgagagagtcagaacagtgtgttgacataactgcaagcagtgtggtgtggttggagctcaggcattgggagcggggagcagcgggttgtggggagagtaaggctgcagagatgtggggaggtcctggatcatgcaggggctgtgggtttcccacagaaggcagggaggtgggccggggtgtggtggcgagctgggagagaagctcctgggggaagagtcgggatcaggctttgcttggaggagggatggctaaagctgggtggagtcacagtggggttgccatctccacaggagctctgtcccagctgggaacctcttggggacttcttctttttggggtcagctttgataagggagggtaggccaggggaggatgtggctcctctgggaaagcccagctccagcctccctgaccccctggctgggagcatatcagcaatgcagatggaagaccctacctggaggccctaagaccacttctgttacacgccaggggtccaacacagactcccacttggatgggatcaagagctttaagaagtgagagtttggcttcagctcatgtgccctgagaggcttacagaagtgttttggggatttccaggcagaagtgaaaggtgttttagacaccacttacgtgggcaccctggcattttcaccttcaagcaccatttgttccttctctgtgaggcttaggcgttcagacaggtggatgcctccatcactgtgtgaactcctctcagccctgcccaaagaacttcacacgcctagcacatgcccaggcccgtgttcaaagaaacgccttgcccagcccgatgcagccctgccctgagcatacgtgaatgctctgggcttacctgcttcctgctgcctggggccaaggtgtcctcactggctgtgctggcactgacactgttttcttctaaggtggggccccagtgggtgttcctgggtctaccagctgccctctggccacaacatgagaaacagtcctggcgtggggctagggtaacaaatcagagcctatccccagggttctcctgcagtcttggggttaatgttttctctggacagagatgaccttgatatctatgacccagtggcctgttcttaggcaccacagtcagtccataaacatgggcgcaggtctgctatgagtcaggtctgtgcccgcccctgggtgctgcctacttgatagcactctgtctctcttttttttttttgagatgaagttttgctcttgttgcccaggctggagtgcagtggtacaatctcagctcactgcaacctcagcctcctgggttcaagtgattctcctgcctcagcctcccgagtagctgggattataggtgcctggcaccactcctggctaatttttgtatttttagtagagatggggttttgccatattgcccaggctggccccgaactctcagcctcaggtgatctgcctgccttggcctcccaaagtgctgagattacaggcgtgggtcaccacacctggccttgatagcactctcatagcctctactatggggaggagagctgctttctaaaatccagaatgggctggatgatggcctccgtatgtctaaagtggctattggtgtccctggggcagacaagggctgtggtctgaggcaggagctgcgacgtggccgtggatctgtgtgggtggtatctgtgaaggcacctgtcacactacagcaggtgaagggctgagacaccccgaggcccagccagcaggactgtgtgactgagacacttgttttctatgcagaagcaagacagaagagctgagtgtgtttgctgcttgggaattgggtagaagtaggtgacatccactgtggtttaagtgtcatattaagaatagcaaataggttttaccttctgtgccaaacctgaccaattaggggccacccctaaagcttagtgaaaagagtgctgtgttcgattattgatgcctgccatgggtatggaaatggtcaatgttggcttaggtcccaggtctggaaactctgctctttctttacatctgaggtcttaggtgaacacggggaatgcacttggatcctctggtgaactgaaaacactgacctccaatgaccttcaattattttgttcctaaaataatcacccttgagttctgaagtttggatggggtgcttcctggattgtccagttgttttcctcatttatcttgtgactcatgggggtaaggacaggctgacccccctgtggtgtgtcattggtaagccagaggacaggaccagaaagcccagaatccgctgagtcatgctgaggtcattgtaccaagctgtgtccagctgagctgagccaggctgaccttcttttgtgcatcccacgtgagcccagcctcatctctgaggagcctgggctttggggatgttttagttttctgctttgctttgtttccccagtgtccagtggtctgtctttctggtaagaatggcaagattaatggcaggaaggatgctgatgagtgagtgctgtggctaacgacatgggctggctggcataatgctcacagaggtccagtggatcaaatatctggtttggcattacttggagatgctcagccagccgtggacagcattccctgccctgaggtcagccgcctcctcaccccagcccgggctgagcgcccagtcggccgcagcagtagctccagagtgtggtctaatggctgtcagcagcctggccttgaggctgctgtcgtcctcccccggagctcccataggtcccttgtgctcagggagggggagtcagtttacccatagtgacttgaggccatccctcagcttagctggggcttcatttccttagggcttgtggttgtcctatgagtgaagcacagtgaaaaggcagactggggatgaggggttggggagatgggtaggatccaggcaatattagcagagccctcatcctaagattaatgaagagggttcagtaacagaatcaaattacatttaaagaatcccttctagcttctgtgtatggagaatgaattgaaccagagcacaagaaaaaggaacaagaccagttaggaggtcactgtgaattcaggcctgagaacatgcaggcttgaactcccgtggtggcagtgaggttggagaatattgtatggatttgacatccatttggaaggtagaactgatgagactcactgagggaagggagtagtaggaaggccaaggatgactcccagtttttcagcatgaccagctggattcaggacacaccatttcctgggattccagaatctgggagaaaatcaggtttgggctggggtcagagatggagagtccacttttggatatattaaatttgaactgcctttgggttatccagatagagatatcaagaaggcaatagtatgtacagttctggagcttttggctggtggcataaatttgggaattggtataaggaaaataattaaatgcacagaaatggaacagatcacctttggagagaatttatagtgagaggacaagagggcccaggaccaggcatcaagaaattccattattaagaggtctggtagtgaggatgagctgactaaggaggctgaaaaggagaggacagagatgcaaggggtcggtctggtatcacaggacttagcatgatatagagggcatgagaaatcccatgaggtgttttgagaccttgctgggctccttctgcaaaggtgccttctgcaaaaaactgcctttccctggaatgtggggagaagtctaagctgactgttcatttctgcttcttaggatttgctctaagatctttggccttgggccccacagcttgagtccatatgttggcttagggtcagtagagcggcttccagtagagtggcttcttcttgggacttggatgccctggagtttgggtgaggtgtaactagtcaaggaagggtgtgtttggaggcttggcctttagtgtctgttcttttcattcattcccacttggaggtttgctttgggaatgctctgagggttctgagagggatcaatgggaagagtgggatttgatgggccctcagggttatcactaaaactgtgagaacctgtcgtacctgttaatttgttcattcattcatccattggttcgactttgtactaggctctggggtaggtgctgaagacttagaggcatcaaacatggcccttgtccttgaggagctcccagtctagtgaaagcgtagacacacaaacgttagagtgatcgggacggtctgcacaacaatgggatgcctgtgccaggttttgaggttgggcaagggaaagagcattcagttgtgcttggaggaacaaggttggctcccaaatggaggaggttgtgggaaatttctaggtggatgagatggtggagagaaaggagggcattccagactgaagaaacacgtgggcaaagggatgcagtgtactgtaccttggtgtgtggtgtacccgtaagtggtttgtcacggctgcagcacagaatggggcagtggcaaggcgagagttaaggcttgaaataagccttgaatctcaggccaaggtgcttgggctttatcttgagactgatgggcccataggtcatttgttaactggggaatggcctgatccaatctgcattttaaaaagatttcctggtgctgtaaggaggtggaatgcgcagcaaggctgaaagggagggataccagttccgaagtctggaggagaaatggggggtgggatccagacactggtggggctgcccggatggcccatgaggtgctggggttctgtgcacattgagggttggatgtcttaactcttgttgctaggggaggtggcctgactcagggcctggtgggcgctgtgttccaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacaggtctggggcagccatgggacagggaaagagggtgtgtggcttggggcctgacaggtctaagcactaatcccactcctgccacttaggagttttgtgcccttaggcaactcacagaagcctttatttccttgcctataaaatggtgacagccatgtgccttattaacttaaaaaaatattaaaacactaaatgatggtgtaactgctatggaaaacagtatggtagttcctaaaaaagttaagtatagaattacctatgcctcagcaattcatttctaggtatatacccaaaagaactgaaagcaggaacttgaacagatactcacataccaatgttcatagcagtattattcatagcagccaacagatagaaacagccggtgttcatcaacagatgaatgggtaaacaaaatgtggtatatccatacaacggaatatcattcagccataaaagggagtcaagtactgtacatgcaacaaccatgaatggatttttcaaaagattatactaaatcgaagccagacacaaaaggacaaatatcatatgattccactgatataaggtccctagaataggcaaattcatagaaacagaaaggagagtagaagctaccaggggctggggagaggaaggtatgggaagttagtgtttagtgggtatagagtttgtttgggatgataaaaaagttctggaaatggttagtggtgatggttgcacaacaatgtcaatgtacttaaagccactggaactgtatggttaaaaatggttgaaatggtaaacgttgtgttgtacatgctttattagaacaaaaaaaacttttgttaaacaaaacattgaatgatataatgtggagaaagtgctttacaaaatgtgagtagtgatagggaatgttctattattcagtggtgcagcctctctgctcactaagtcagccatgtcctgagccgagctgtggtaacttgcaggtggggcctctgctgttccttcacagggggccttgccaaaggatcccaagctgaccgagtgaggatccatggtcctggtgctcaggagtttctaaggtttcatgcaagaattgacatagaagatgtctttcggtgtggccatacagaaggccgcctcgtaaaggtctagagaggggaacgtgcatggtggctgcagaacgatgcgttgattggtgtggtctcccccctcagggccggcagacattccaccgctttgacaagttcaactccaaatacaaccctgtgggggccagtgagctgcgtgacctgtatttgaaaactgaaaactatctgggaggagagtactttgctcggatggtcaaggtgagtgaaccctcagtctctctgaggcctctcaggtgcctcccaacatctgccttcagagagtgggggccctgtgtgcccctggccccttcccctccctctgtgtaccatcagctcagggaagggtgaggtgcccaggtgcccagtgctgtggtctggctgcctgctccaggcagtgctgcatgtgccaactgcaggaaagaggagggaagggtatccaccttggccaagctcacagcacctggcctggctttcgtgtctctgcagcctgaacctagctgggtgcagatgagctccgtgtggagatgcttctgctgtggcctggttctgcagacccaaggccttcctcaccagagggggcctctcctaaagtggaacaagagcttacaggagcaggcagccctggggatttagatgagtgcttccagcctgggagcaaggtggctgggggagcaacaggaccctgctggtgacggagagtgagagtctcccatgtagctgggatgcactggggctgacccaagctcttcttgtgccaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttagtaagtgaggtggcccgctgtctaccctgtgccctacagaggtgacaatctgtccctcatgggctgctgagtctgcactcctgaggggtagggcctgttctggtgccagcttacgcttgtcctttccagggatttttccatagaaggagtgatgaaaaagatgtctgcatgacactagagctcttttttttttttttttttgagacagagtctcactctgtcacccaggctctgagtgcagtggcatgatcttggctcactgcaacctccacctccctgattcaagcaattctttgcctcagcctcccgagtagctgggattacaggcacccgccaccacgtctggccaatttttatatttttagtagagatggggtttcaccatcttggccaggctggtcttgaactcctgacctcgtgatccacctgcctcagcctcccaaaatgctgggattacaggtgtgagccactgcatccagctgacactagaactcttgatctttgaaaaatatagatgtgcaaaggccttgggggaactactacccccgccttcttctcattgtgggttgaggatggattgtccttttggtgagccccagggtatggggagagctgtagtggtctacattgctggcctctccctggatgtcactcagacggctgctgtcctctccaggcggctggccagggtggagcccatggctccaggatgggctggggtatgtggtttagggaaacagagctgagtaacagaatgtttgggtcactgggaatttgaggattcatatctcagtctcttggtcagccagaatgccaccatcccattcctagtggcttctggcttgagaaagtgctctgatgggcatgggtaggtgtggagcttgcaaaccaaggcagaatattgcagacattgctgggagaggaggacagaggagggatctgttttctggtcccatctgacttgattctgggtgtttgatggggacacagggtgcctgaggaagtgactggggctggtctctgacagggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtaagtgtgggtggtgccctaggcagggctcatagcggcagaggcaggaatggattcgctgtgagctgggtcaggcttgctcctgcccttcacgatggtatcttaggtcctgccacctgtgttccaggcgtggggtcaccagccccaagaagctagatttctaaaaagtccccttctcctcaggggcagctctgggagtcagtgggtgtggggggatgggggtggtggtcttggggtaggcctttcccccagcagggaaggcaacagtgggcaaagactgggaactcggttcctgccaggtggggctggaaaggctggatctagcccccggcagcaccaagcagcagcctcaggtttttttttcggaaatgcaaacacttcaattcacctgctttacctcgcaacagaggccctcacaccatgtgtgattaagtacaagcccctaaagtgtatttcccttccggatccagttgtaggagaaggagaggagcagtctgggagaggcttaaccagggagggaggcggagggggcgggagccggtcccaccctccggatgcctgggatcgagggggtatcagatggtgatacaggccagtgcctggtgatggatgactttctacagggagaggcacagcggggagcccgagggctggggcacggggaaagaattgagtctgtgtgcccagaaagtgactggacaagctgagggacatcatcaaatttatgttttagacaaacatattctggctgttgtgtggagttggcccagaagagaaggtagctggaggtgggggcaggggtgagagtcaggggcctgcctggagacaggaggggagcttgacccagcggaaatagctcacactcgtgcgtgcttctgcctggcctggtcagacgccacaacgtgatctcacctaagcctcacaattaccccgttactatcaccattttgttgttaacagtaagcggaattattatgtgcttggtgcgtgttggacacggtgttgagtgctctccctggattatctcatttaatcctcaccaaagccctgtgaagctgctagcttcaattgacacacaaggaaattaaaacagatcataaagctaaaagtggcagagctggaatgcgtttccaggcaggctgactccagcgatgtaccctgaacccctattctatgttgcctcccaagtgagaatagtaaggtgcacagcagctaccagcttgcgtctctgaggtgtggcagcgcagggactctgcacaaagtgtggggcttggtgagaagcggtgggcgtacacctggcaggacctggacagagactgaaggaggcactggggggagtctaggatgcctcccaggtgcctggctttgcaggagcatggatgatgtgctgtccgaaggttgctgccagcaatggaggaagagcaggtatggggaggaggaggaagagcaggaggaggagacaacgcattttgcacccgaggctgtgggagatgcagtggtgaggccctgcttcagctggatagagctctgaagaggggctgaaattatccgcatgccaggccccagaaagttcgggtgaagtatggagctagtgagcacagagcagagctcaaggtcctccctggccccccaaacccgtctagggagtgcttagggtcatagcagggaccctgtcatttcctttgacacacagggctctgtgacacggaagattctggccaagctgccttgctcctctgggcctttgctgcccccataggaacaggagaggccagcagacctggctggggtctggggcgtgggctgggagccctccagtttgggccagttgtggattaagggggacagtctctttctcccatctgctattcagaggcccctttgcaaagcactgccgtggcctggtagcaagcctcccctgtgcgctgagagcccgtaccctccatgcatgtgttcttggttggggatgacccctgggatcagccagaaggctccagtgactcaggagcagccccccaggggtcccagccaaggtagaactgcagtggaagggtgggggtttcctgaggctactcaggcccatctcagagggcagctcccagtggggattggagagcagagctgcctcccaggagccatggcttagcccagcaaggaccctcttatctgtctgtgaggcagctggcgggtttctcctggccacacctggacatgccctagagtattctctacctaccgccccaaagagtgcagacccagagcccagaacctgttttttttgtttgtttgttttttgttttttttagatggagtcttgctctgtcacccaggctggtgcgatctcggctcactgcaacctccacctccggggttcaagtgattcttctgccttagcctcctgagtagctgagattacaggtgcacgccaccatgcccagctaatttttgtatttttttttactagagacggagtttcaccatgttgggcaggctggcctcgaactcctgacctcgtgatctgcccgtctcctcctcccaaagtgctaggattacaggcatgagccatcatgtctggccaaacctggtttcttgagcaactttcttaattgctttggccctggtttgctcaattgtaaaatggggctggcagccaacccctccctcctgggttgctctgaatatgaattaactgacgtgagtaaagtgctttgagcagggcttgatgagtgatgtgtactaggacccttttccctcatcgcttgtcgctgctgctgatggcaatggccactcctccctgcaggctggcctcggcatagcagaggggcaggtggtggccatggctgctttgcccttcacctggcttggcagtttcctccactgtcaccaccaccacacaggggcttggcactctcctgtctcacctccagagtacctatggaagctccgaaggggcagaccttggtgttgtacccacttttcatccctgggaggaatatggcctcaggcaggccaaggggtccccagctgaggtgtgaacctgaggggcccagacccacaggcctctggcagctatgagctctgggaggctgaaccgaggctgagtcctggtcctgccttggcctggtgctcaggacctctcctgcccaggtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcaggtgcgtgaggcctgccctcgcacatgcttgggttcatgtgttagtacatgcacgcatgcacacacatgcacacacacatgcatgtgatccttgtgtccgtgtgcacctgaaccaacatgcatgtccatgtgcccacacacctcaaaacacacagcactttccagcctgctatatgaggcatgtctccacatgatcacacacatgcaaacatgcccaccataacacacatgccagtacagacatatgtcatgtacagtatgcaatgcagccacagtccacacgtgtccacacatttatatgtacacacaccagggcacactccacgtgtacctgtacatccctgagataatggaagcataggacatgctatcacacatgcacggtcacttactgccacaccaacaatgtccacacgtgcatattttcgttcagcaaatcactgcatctggcatgcgataggcattgccctgggcactggacaaataacggggaacaaaacagactaaatccatgcatgcccttacaggcagaggctcctaccaatacgcacacagacgaggcacacgtggccaggagttagctgcccagggcagcaggacactgagccattcccttccctacaagtcttgcatcccactttcccctgctgggccctggggtctctctagctcagcctaaactggtgctagttggtgggtgtggaggtttcgaatggggtcctgattgaaagaaatggcctggcagggtggaggcagtcctgggctgagcttttggagatgggggctctggttctggctttgctactgacctgttcagtggcatggaacatagacttcactctccgggccttggtttgcccatttccataacacagaggtcagactctgtggtttctcatggccttccctgctctggagttctacgaatgcgggacacaaggccaggagaggaattcaggagagtggctggagggcacagcagggtctctttctactgcgaggcccactctctgcccgtagaggtgatgcttcttggttctaaggggccccagggcctggacctctgcattttaggaggggtagtttccagggtgcactgggtcagcacagctgaccatgggtggtcattccccccggagctggccctgagctgtggctgcaggccccaggcagagccaactggggggggccttcctgattcggaaaccccttctcttacagggagcgcggcctgagcacgttcctgttccggccgcactgtggggaagccggctccatcacccacctggtgtctgccttcctcactgctgacaacatttcccacgggctgctcctcaagaaggtaaccaggtcactctcgggagcccgtcctgagtgactgccctgccctgggctcctgggaggctcaaccagtgaggccagaaggctgggccctcttctgggctgggatgtctgtccttatcttggttttatttttaattatgaaagtaatataatcaaactcatcacaattttgattttccaaaaactggagaaatggaaaaaagccagcccttatgctattacattaatagaaatagccattattagctttttagtatatctaatttccatcttttatccacagcatatttttaatgtgtttattatcataatgaacacagaatttggttcctgcctcgtcccttactgttgtatgacaagcattttttgatgctgcaacgtaatatctatgctcctttttccaaaggctgttgttggatgaagggtctgccactttgtctgtaattgactcaaccagtccacactagttgggcacagagtccatccaccttttcactggtgtacccttgagctctgtgcatacagtcttctccgtattttggatcactttccattggcacgatgtttgatcaaaatgctccctttccctgatcccggtgaggtgtaaccatgggtcacatttttgggtggggtgggtgctacagtagaaaaccactctatcctgggcaggtccacccctcccatcccttcagggatcatctcccaggagctggagtgtttatagtctcaacctggctgtttgcagtcaaagcaataaaacagctagaggggggcatcttctagactgggtccgtgcctaggagaaaggagctgaaggtgtaggctggagtgggctgcccttcctgccctgagccttgcctccagtttggagcaagaatgagcacttccaacagtgggtagaggcaccagggagggctggcatgcaatgtaggaatgagatgaacagtggggaaggggagagtgggtctgagtgtcctggcttcgaggaactcgggttgaggacttgggcagacatggttcagacccctggtttccactggtgaatgcttcttcccttcctttctcccttcccttttcccttctcccctctctggcacttgtcacatgagttcggtggttcttttgcagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggtaaggactttggggtgaggacagtagtgcttcagtaggcaccagtcctagcctgtcctcccatttcaggaacctgagcccatggcttagttctgcttttggggtggggttggtggcccagtgaaggcaggaaggaagccactgttgggggaaaattgtgccatccaggagccctttctttggggttcttgaaccctcaaaggcacaatttagtatctttgccttcctctattttctctttctttgacatttatgagctctgtgaccttggtaaagttattagatttctggatcaagttcttcttcatctgtaaaatggagataaaattttctctgtccctaccctgtaaggattcatgaagataatgaatcaaaggttctaacatagtgtctgcatatattcaaaatggttgctactttttaaatcaatgctattataatttctacactttgggtctctgggaaaataaaagaggaagctaacagtggtgtcatgcatggggactagccgcaagtatacccagcatgttttgatggtgtcgacaagaccagccattgcttaacaaaaacagaagcaccagagtcttttaggacagaggttctccaacctcttggtctctggacccctttatactcttaagaattgaagctttcaaagacctgttgtttatgtgggttatatctactgatatttaccatgttagaaatgaataagaaattttaaaatatttattatctcatttaaaaaccacatcaataaaccaatgaaatgttacataataatgattttttttctgaaaagtaacagtttcccctgcctttgttttgcatttttaagcctctttaatgtcttaatggaagtcagcaggactcttctagccacttctgcattcaatttgtttttaatcaaaatatgtaaaaatagaaatcttgcctcatgaaaatacataattggaaaagacaagacctttcaaaaggtcttaggaccctcaggggtccttgacctgtacttcgagaactattgctctaggctacagcggcagtggggtggggaagaggtcacagacggcttgtgatgaatagacacttcacatcccagaagggaagcaaaaccacagctcaaacccagatcattctgggattacaccattttaccacttatcctatgatcacttctcattttttttttgatgttccatctctgcttttagtactttactcatctatctatctatctatctatctatctatctatttatctatctatcatctatctatctattgcaaacttaagaaaatagtgtgttaaaaagaaaagctagagggcaagtgctaaatgtggcatgactagagggcttgtcacaggagagcagagactgccatccctgatgactggcacagggtttcaacatgaggtctcagtgctggtcaatgaataaatgtagaggcgtgattttagatctctctttgataacccatgattttacagaagaaaagatcttaggctttgaaggtgtgatgtttgatgatccaggtgccatttagtgaggaaaagttaaacccgcagtgtctgatgttgttagctttggacatgtgtgaacgattgacatggatatccccccttctaatccacatgctttgggggaggatctaggaagcacttatggaagaatatgccattgcagctcaagtgtggaagctgagcacctgcgacctgtgtgagatcgccaggaacagcgtgctgcagagcggcctctcgcatcaggtatggagtgtgacggtgctgcctgtgtccctcctgggaaggctgcctgctgtgtgccaggagccttccaggcactggggatctgtgatgaacatagcaggcagggcctctgagacactcaggcacagggagagaagacgcggcagcctcctgtgttttcatggctgcttcctcacccttctcagacctctacgcctccttggagaggccttccctgatcgcccattctaaaatagccacacacttgctattattctctatccccttaatcagtttttctccataccatttattcctgctgatgtttagttatgtgtttttctgtctttccctctagcatgtaagctctgtgagggcagaggtttgttcagaattatatccccgggccctagatagtccctggcacatagcaggcgctcaatatttcttgaatagatgaacagtatctagactgaataaaaatctagactatgggactcagacatctgtcattttttaaaaagcctgatgaggagctggcactgagacccatgttctgatgtacgttaggtcccccgacacctccctgggtgatgtcactggttgggaagaggttgcattaggggctgtgctcgtcggatgatgatgcagcagagttaaaggcttaagattcttttcatgcgcagtgtggtgccttggattggccctccccaggaacattgtccttgtcagctctcaggggcttcttaattagagtcttacctccttcccctttgcctttcccatccccagcagctgctgcagaccttatctttcctctctgatcaaggaaagcacagccaggaatgaagggctgtctgaggatgactgaggttgtcagggtgacatccttgaggacacagaggccagcaggaattttaagagttctgtggggataagatgtcctgaccaaagatctgcttcagggggactagtctgacttgctgtgactgatgtcaaagctgcccacatggctatagaaagtgaatcaaaagtatatagtttcatttgtatttctcttggtccacaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtggctcaatagtttaaaactatttaaagataatcatatttaaagcaaatgttaaagatttttactcttaagattgggcaccatgaaaagctatcaataataatagctaatttatcttttactaagactccgacatgaatgacattcactaggaaaactcaaaattttcaaactgaagctcaccagacccagaagataaatcttcctttgttattttctctaacttctaccctgttatagttcatgagcaaagctatacatgttcctttccttttcccggggtattattttagtctgtccagctaacaccttgttgatatggactctagaataggattgcgctgttatccctagggtaacttgttccgttggtcaagttattggatcaattaaacgtggtaattcgctttgactggtgaagtctcggcatgtgttgctcggaggtcggattgtgctccgaggtcgccccaaccgaaatttttcacgcaggtttgatagtttagggcctgtggacttgttaagtgttgtttgcgttaatgaattaaagctccatagggtcttctcgtcttgttatactatgcccgcctcttcacgggcaggtcaatttcactggttgaaagtaagagacagctgaaccctcgtggagccattcatacaagtccctatttaaggaacaagtgattatgctacctttgcacagttagggtaccgcggccgttaaacgcatgtcactgggcaggcggtgcctctaatactgagaatgctagaggtgatgtttttggtaaacaggcggggtaagatttgccgagttccttttactttttttaacctttccttgtgggcatgcctgtgttgggttaacagtgggggtaataatggcttgttggttggttatagatattgggctgttaattgtcagtttaatattttggtctgatgtaggcttatgcggaggagaatgttttcatgttacttatactaacattagctcttctatagggtaatagattggtccaattgggtgcaaggagttcagttatgtgtttgggattttttagatgacaggtgtcgagcttgaacgctttcttaattggtggctgcttttaggcctactgtgggtattaaattttttactctctttacaaggttttttcctagtgtccaaagagctgttcctctttggactaacagttaaatttacagggggatttggagggttctgtgggtaaatttaaagttgaactaagattctgtcttggacaaccagctatcaccagactcggtaggtttgtcgcctctacctacgaatcttcccactattttgctacatagacgggtgtgctcttttagctgttcttaggtagctcgtctggtttcgggggtcttagctttggttctctttgcaaagttatttctagttaattcattatgcagaaggtacagggattagtccttgctgtattatgcttggttgcaatttttcatctttcccttgcggtactatatctattgcgccgatttacaatttctatcgcctatactttatttgggtaaatgatttggttaaagctgttcggtagtaaggtggaatgggtttggggctaggtttggctcagagcggtcaagttgagttgaaatctcctaagtgtaagttgggtgctttgtgttaagctacactctggttcgtccaagtgcactttccagtacacttaccatgttacgacttatctcctctatataaatgcgtaggggttttagttaagtgtcctttgaagtatacttgaggagggtgacgggcggtgtgtacgcgcttcagggccctgttcaactaagcactctactcttagtttactgctaaatccaccttcgacccttaaatttcatcagggttatcgtagttttctgaagtagaaaatgtagcccatttcttgccacctcatgggctacaccttgacctaacgtctttacgtgggtacttgcgcttactttgcggccttcgtcagggtttgctgaaggtggcggtatataggctgagcaagaggtggtgaggttgatcggggtttatcgattacagaacaggctcctctagagggatatgaagcaccgccaggtcctttgagttttaagctgtggctcgtagtgttctggcgagcagttttgttaatttaactgttgaagtttagggctaagcatagtggggtatctaatcccagtttgggtcttagttattctgtgttcagatgcattaaagccactttcgtagtttattttgtatcaactggagttttttacaactcacatgaattttagctttattgaggggaattgatctaaaacactctttatgccggtttctattgacttgggttaatcgtgtgaccgcggtggctggcacgaaattgaccaaccctggggttagtatggcttagttaaactttggtttattgctaaaggtttatcactgctgtctcccgtggaggtgtggctaggctaagcgttttgagctgcgttgctgcgtgcttgatacctgttccttttgatcgtggtgatttagagggtgactcactggggcggggatgcttgcatgtgtaatcctactaagagctaatagaaaggctaggaccaaacctatttgtttatggggtgatatgagcccgtcgaaacattttcagtgtattgctttggggaagtaagctacataaactgtatggggtgtctttggggtttggttggctcggggtatggggctagcagcggtgtcctgcaagcttttctgacatcttttctatagcactttgtgcttttattacattgctatacttaattggccttttgggggacaaatccctactttcctttgtgtttgcaactggaataagaggcaattaattgtatactggcttaggtttctaaagcaacagtttttgaggcagttatcccttctttatccttaagggctcaagttcactttatgtgttacttcaaattgtaccgctgaaaccgatcgacatcattgctctttgcctcgtgaaaacaaatcacagctcctgggttgtgatttttcacggcctcttggattaaacaagagccgaaagcacttttctcttgctttctctttacttctgagtgttggtgaaacaatattcttcatttcctgcgtttgagacatgactgaaggtgatatacccaaatactctgcctgaactatgatcattataaagaacaagtgtaactaggggaatactaaccagataaacagttccttggaaatttttgcaattagtaagatagaagatgacagagagtaagactataaacagctgcaagcgtgtcaaaacctatctctgcaaaggcttttatgtattttgacagtaaaatgtgcatttctccacagtatgatgatacagtcaatttaactaccaactgccactcattcttatgtccttgcacttttcagcactaagattctacgatgtttctctaattacattcttatattttggaaatgattttacaaggtaaacaaactacaatagggttgagcattttatttttgctgtctgttggggtaggggtccacaacccctgggctgtggacagtactggtctgctgcctgttaggaaccaggccgcacagcaggagttgagccgcgggcgagtgagtattattgcctgagctccacctcctgtcagatcagcagcggtattagattctcaaggagcatgaactctactgtgaactgcgcatacgagggatctaggttgcatgcaccttatgagaatctaactaatgcctgatgatctgaggtggaaaaatttcatcccgaaactattcccaccccaaccctggtctgtggaaaaatggtcttccatgaatgcagtccctggtgccaaaaaggttgaggactgctacagcagggtgaatagacatacgaacaaatgagtctgttgtcagctgcttaggtttgtattgtatcgtcattgtgtggcccagcatgaatgtgagtgacctgttaacttccctcatctgcaagtagttttcttattcccggatagactaagcttgacttcagacaatagcagttaaaaatgcaaattcttcagactaccttttaataaactcaacttcccaatgttaaaaatcactgaatcaaaagatattttcaagcagccttttctcccagatatatattagatataaggaaatcgagtccaatttgaaatgaattttaaaacagcacacaaacatcacaagcccccagcgcacaatataaaatagttctctaaggaatataaacatttagtatattagaatgtgaaattacataggaaaataatctcttcaattagctaaaatcacttgcgaaagattatttattgcacaatttatcagtgggtactaagaataacacagatcctattattctcaacctctaaattcagtacatagtaaaattcattttctcaaactaaggttctatacataatcggagtaaaccctctgttactgagttaggatagggaaaacaaattccttagagttcatgaaaccacttcacaaatcctagaaggcacacattatatttcctatcatagtaagtacatttaagtacttcatatttaaaaaagacaaagctgtacagaatacaaaaagtgtacatttcatccattaaacaaatttacaacttttacgattagttattacagtagaactgacctaacattcacatctaaataattatcacccagttcaatagagcgaacaaagagctgtgctcatttatttatttgataaggctaataacattttatattcacagtagatcagtaagtgtcttggagctcatattgtaaaataaaaaggtttgggccctattgagtcactgggctcattgttaaataactccttgaaaggtgaaggattctgggggataaaatcattggctatccctggaaagatccaaaactctgtaaggtaactctgttcacttttcagaaacattttaaaattaggtaatctgaattaaactcagcaagtctaatctaaaaggacaatttaaaatcttagagctggaaaagatttcagtggatcatctatcccaaggttttcaaaatatgttccatggaatactaagaatctatggaggagatacagggttctgcaaatttgacttgaatttaattaaaaaatttttttaaaaaaaacgactcccactatatgtgtgttactcaccaaattcaaacatgctggatatcaccaatgcattaatgtttttattcattgacttaatcacatttatagtatataaagtttatataataaggaaatttataataatatgacttttatatagtggggtatagggtatgtgtgtatgcacacgtgtttaaaggttctgtaagattttccttgaaaaagtttttgctgctgaaatagtgtgaaaaccacaaataaagtctcagtttctaaagtaagaacacataaacaagagtaagagactttctcaaggtcacacaaccaccaagtgcattgccaggttgatatgatggaacccctggtactctgcttgcataaacctccatagggagtagttagctatttggtacttagctgtcccattatgaatgtcaatggattagtcttcagtatttttgggggcgaaatcaagctacccctggccagatgtttttccttgaaattgatttgaattttatttgctcgcctattaaaatcctactatccagaaattctgtcatcaataagtggcaacttaaattgtgtaccctggtttaggaaaatagtaatatttgcaacttatgaatgataagtcagaaaagttacatggaatgttaaattttaaaggagataggcccttgttttattacatgccgaaatgttaatgttagaaattttagttcataagcaaaaaaaatggttgaggtgcaactgaagatcacaattccattattactatattgtttcagaatattttaatggaaagagtatttcaatggaagtacagtgaaacagtaggaatgccaaattatcttctaattttcataagtattttatgtatatacggtaaaaaagcctcactctattttcttgtgttttttttttgattaggagtctcgttctgtctcccaggctggagtgcagtggtgtgatctcggctcactgcaacctccacctcctgggttcaagcaattctgcctcagcctcccgagtagctgagattacaggcacctgccaccatgcccagctaatttttgtattttagtagagagaggatttcgccatgttggccaggctggtctcaaactcctaacctcaaatgatccacccacctcggcctcccaaagtgctgggattacaggtgtgaaccactgcactggcctcttgtctcttaatctaagaaatttgaggactctgaaatctcagaaagatgttttcaagttaaggaaataaaagcaccataaaccaatattaaatgacctatagtaatttagaaatataaaatttagtatttgtgatgcagaataatttccttctgaaactccaagatgtgtgagcattatcaaagccatttagaacagttacccagctgtgggaaagcatttccagaacagccaagaaaattccccaggagaaatccatttgcaaaggaaagtcacacccaattttgtagacctcacccaaattatacagtatggcaaaaacaaacaaacaaacctttaagtacagtagttccaaaacacactgctaaagttatgaaataattgtggatcatttcaagtaaaaattattaaaggagcaataattaaccacaagggggcatatatatatatactccttagattccagcagaaagactagttttaagtagtaacatgcacgttgaagtattctacattttcagtcacttaaactttcctctctcagatggctacaactttttaatattcgaggtttattttatatctaagtaaaaagattccagaatactcctgccctgcaaaacagtagtgttttagaagcctctggaagtgttgctgttacctttagcaaagaattcaagagctattagttgtaataatacaaatttgaacagataaataataggaaaatatggtctaaaacagtagcaaattttagtaccacaaatggaagacatgggaagtttatttttaaaagggggacaaatgatcagaatagcaaaaataaaagagtggggaaaatggattttcctgtgtctgtgccagtgccacaaccctacattcttcccccatgaccaaatatttgagcccacaatagcaacagaagactttcacttcaaggtcatggcctgtggggctggcctgcctcatcagccatgttaagaatatagttagccatatcatcttcagtgggtgcatctgataccacccaagattcatttgctccagtcatctgtaggcgacaaatagggcaattcctgtgtcgatcactcctattagagaagtcaaaacaaaacagtttgctttcttcttttttaaaaacaggattttatttaaagtaatacatgcacatggcttttaaaaaggaaatagcatagaaatatatagtgaaaaataaatccctccctcctatctcaatcttcaattctctttcccaggggcaaccacagttaccagtttcttatatattcctccagagatagactaagctggattaagcttatgtgtacacacatgcacgcacgtgcacacacacatttctccacttgtcaatatatcttacagactagtatgtatcagcacctgttagagctgtttattctttttaacatacactgtatcgctatgccataatttgtttaactagtctcctgcagaaggacatttagttttttttcccatcttttgttgctaccaacaatgcagcaattcgcatccccatacctaaacaggtaaagtattcctttataataaaaattccttctgagtcccaagaggaaattccctcgcatcaatggaagatttggtcaaagtgtcaagtataaatgcttattcgtgattatttaaatggaagccattactctaggaataacttcttggcagtggcaggggaatatgacaagaagaaaggatattattaattatttttctaagaaatatctacatgactttcaacaatatatctacctgttgcttgcttaaaggtctgaaaaaattcctatggctcataagcaacaggaagacttatataaaaatggagcatacaaagttaaaagataaactttacatgcacagtaatttttctggcaggggaagaactcatatatgatcacttaaataagattatgttttcgaaaaggatttttttctggtcaaacattattttggtaatttaaaaaataccgtatttgagccagagacatattatgcagagaaaaatgtttttcttttcatctctcagtgaaatctgggaccaaagtaattatttgtatcaactgctctttggcttttatgcaaaaatttagaactctgttccaaaaactaaatgtgaaagctacagctggcatatattatttaggttgatttctagttcttcagaggtattttacaagataattatatgtatgctcttctgtgcacaaaacatcacaatttaaaaatagtcaacttctgtttccaaccaacagaggctagatttatcttcccacctaaaattactaaaacaatggtttcatacaatctttcaaataaagcactggccatcagacaacaaaggacagtgatccctgggacatgggagtcaaagaaggtgagacctatacttgcctcagcttacagcctcgagagtttctagcccctgatcaagaagcgggaagcttgatggaacatggcaaactccctgagctgaacacacagagctgagaatcttggggggccaaacagctagggtttacagggcagggtaatggaaagctgcacagagggaaaattccagaggtctacggaagtgtccccgccagaatactcagcagagtgctgatcagtgtgtgcatgtgaagacactaccgaggctgaacaatcaatcaaagggctttgaggggatagtcccctaaagctcactgggcctgggatactgcctgtttcaccagccagactggaaaacctcataactcttggggtatcagtagagttctctaaagggtcttgctattagtgggacataattagttctaaactaaatactgctctggtcctgcctaacaaatcacaaaagcaagatccaaaagaatcaaactgtttccaagtcacttaactatagtccagaaaaaaagctcaagaatattcataggaatacaaaaatatccaatacccaaaaaggtaaaattcacaaagtctgccacaaagtctggcatccagttgagaactaccagacatacaaaaaagcagcagaaaaatataatctataataaagagaaaaatcaatcataaccacccagaactaacacagatattagaattagcagataaaatggaaagttattatagctatattctatatagttaaaaaactagaggaaagctcaaagatagtaagaagagacatgaaagataataaaaacccaaatcaaacttctagaaatgaaaattatctgaggttaaaaaaatacactggatagaattaatggcaagttagacattgaagaaaaatggtgaatatgaaaagagatagcaatagtaactatccaggatgaaacccagagaaagactcaaaaaagaaagaaaaaaatagcaccagtgagctgtgagacaacttcaagtgggctaatacatggtaattggaatcacaggagaggggagagaagatagaaaaaaatctgaaaaaataatggctgaaaaatttccaaatttgatgacaccgtaaatcaacaaatccaagaagctcaataaaccccaagcacaagaaacatgaaaaaactactctaaggcacatcataatcaaagtgctcaaaaccagtgaaaagaaaacaaccttaaaaacagagggaaaaaatggcacattacctacagaggaaaaaaggatgacagagttctcattagaaacaatgcaaacaagatgagtgtgaagcaacattattaacatactgaaagaaaaaatactctcaagtctagaattctgaatcagaaaaaaagtctttgaaaaatgatattcggacattcaagaagagcctatggaatctacaaaaatactaccagaactgatacatgagtttaataagggcgcaggatacaaggttgatatacaaatatctattgtatttccatatactagtatcaatcataaattgaaattttaaataccatttaaaatagcataaaactatgaaatacttggggatagatgtcaaagatatgcaacactgaaaactaaaaaaattggtgacagaaattaaagaagacctaaataagtggagaaatatacagcgtatgtggataggaagatgcactagtaagaaattcactctccctaaattgatatatttattcaatgcaatctcatatgctgctagtgggggtgtaaaatggcacaagactgctttggaaaatagctggcagctttttaaaaagttaaacacacacataccatatgatctagccattccatgtctaggtattcacccaagaaaaaaaccaaaatacatccataaaatgacttgtccatgaatgtatctagtacctttattttgtaatagataaatatggaaaataatctaatttccctcaataggtgaataaacaagctatggtatccacataacagacattactcagcaataaaaaggcatgaactattgatacatgctacaacatgaataaataccaaggtaattagactgaatgaaagaagccagacaaaaaaagcacatattatatgattccatttataaaaattcataacttttatgggtgtgtatatatgccaaaacatattaaactgtacattaaatacatgtagtttattgtatgtattttataaattatcctaaacgctcaagtcttattttgtaaaataatgaacttgactagctgatctctaaagttccctgaggtccagtattcaagaatttattccttctaaacacatacacagaataaatgtagaaatgaggagaaaaaaaggaggaaaaagggaaatgtttgattttagacttaagtcaggcacaaattttcatacagcaaaagaaaagtgtcaaaactaaggtacacccccatatttaataaatgttaggtgtaaaaacaaaaatagttttaaccagtagaaggcatgccataaaattcaaagtactaaagaataaaatctctctcatacttaactacagtatttttgcacttttcaaagtttattcatgtacactatcccactgaccttggcccagcccatgaatgcagtaggtaacttaccatttatcaatacacttctgacaaaagctgtgagcacaaggcaggatgaggtcagcccgcccatccatacagatacaacactcctcctcatcggtcagctgcttcaccctgcaatgtgaaaactgagctgaaacaattatattctctgtcattatgctttatactttttgttgctttaaaaagcattattaaacatctatatgcccacagtataaagcacaatatgactcatgtgcaaaatcagactaaaattaatattatcttttagggatagcaaatatattagggaaaaagtattaagagggctacatttcataaagaaagactagataaaagatacattttgtgataaagaaaacataggcaaaagtggaaatagtcaaatctttctggaaacaatttagcccattttaatcatattggacttaaataaacaaatttaaccgatatagttattgcattaaagacagagatacggtctgagaaactcattgttaggtgatttcattgctgtgtaaatatcatagtgtacttatacaaacctagatggtttagcctactactacatacctaggctatatggcatagtctattgcttctaggctacaaacatatatagcatgttactgtatggaacactgtaggctactgtaacacaatggtaggtatctgtgtatctaaatgtatctgaacacagagaaggtactgtgtaaatacggtatacaagattaaaaatggtacacctgtatagggcacttaccataaatggagcatgcgggcctggaagttgctctaggtgagtcagtgagtgagtagtggtgagtggatatgaaggcctaggacaggagtgtacaatcttttggcttccctgggccacactggaagaactgtctttcttgggccacatatatactaacactaacactaacaatatctgatgagctaaaaaaattgcaaaaaaatctcatgttttaagaaggtttatgaatttgtgttgggccacattaaagcaatcctgggctgcatgcagcccgtgggccgtgagttgaacaagcttggcctaggacattactgtatagcacttgtacagtagtgtacagactttatgaacactgtacatttaggctatacgaaatttataaaaaatatatttcttcaatgataaattaatctttactatagatttttaactttataaactttttacttttaactttttgactctttttgtaacaacacttaccttaaaacacacattatacagctgtacagaaatattttataagcttttttctatttttaagatttatttacttttttactttctaaacttttttcttaaaaactaagacataacacacacattagcctaggcctaaacagcgtcaggatcaccaccatcactgtcttccgcctccacctcttgtcccactggaaggtcttcaggggcagtaacatgcacggagctgtcatctcctttgataacaatgccttctggaatacctgctgaagggcctgcctgaggctgttttacagctaactttttttaataagtagaaggagtatactctaaaatgattaaaaagtatagtatagtataataaatgcataaaccagtaacataattatcaagtattactgtacataattgtaagtgctatacttttatactatgagcagcacagtaggtttgtttacaccagcatcaccaagaacatttgagtaatgcattgcatcacaatattaggatggctacgacgtccacaggcaataggaattttttagctccattataatcttgagaccaccatcacatatgcagtctgtgattaaccaaaacattgttaggtgatacatgaccatataatttattcactatgtgtaacacaaagctccctaaaatatggatcctgccatcagggccttacaatgctgacattgataatgggcatatgagtgaaagaatagtttagtcttaagtatcaggtgctgtgagagatacaaagggaataaaaagcagtttctgtcctccaggagctctttcatcttcttgggaagaaaaaagatttcaaaccttttgctccagccacaattcagagagcccctgaatgagccatatacctttgcagatggtattttcctttcctgaaactgcccttgtgagtttagtaagctccaaccttggtaactcagctcaaaacatcatcatctctctgctctcaaaatcaacacttgcctcaatgaaaagacttaaatattgcatattgattggctggcctttccataaactgtaagctctttgaatatagggtgtttgtcttagattctcaataaatgcttcttgaagtgattttaatttcttttaacctttgtgcttttttgtaatttttaaggttttcttcatcagacatgtattacttttgtaataatataaaaactgactgttccaaagtacagccactagactataaacttcttaaggataggagctatcactaatatgttttccattccctgttgtgcttatagcactgtatgtaagatatttagatagtacttaaaattttgatttgaatgtaaaaataaatgtcaaatgtatattaaatatagtaagtgctaagtaaagaaggaagagatgaatatatctcaaacttgttgaaatgatgagatagaaaaacaataggattttaatagaagacattctaggtgcataaacaaagttgtagaggtaaaaagcaaaatcatgtgtgtttatgtctgtgtatatgtaaccaggaagctggcatgatacttgggtatggaaaactgaggaaaaagattgattagataaagtggagataatctcatccttaaatgtcaaaatattaagtttgaacgtgtcctgacaagcaaactacaatcagtgtataatcaaggggaagtgaactccaactgatatggtacttcaggaagataaattgggagtgcagtatgagggacagtctagaaagaggaaaactggttaggatcttatttcagcaattcatctgagagataattaggtctaagaagcattataaaagacaaatcttttatgtggtaatagattaagtgttatacgttagtaacagggaaaagagggaagtcactgaattggaatgggaaaactgaataaaaacctagatggatatgggtctaatgtatctgagtttctcagtagcagagaatataactgaatctgtacagagtgaaagaatattctgaaggctggactttaaaagtgagaagcagaggactacaaagaagagcattgtggagagagataaaagaatgggagatacagaaatagccagtggaaccagtacaaagttctcttaactttttgctaccttcttagcagcacagtgaccagaaggaaggagagtcttgtgctgtttgttcctgttagatcacctgtagattggaatatttggttctatgcctcatactctgaaaggcacacatactgacagagaaaagaccatctgggaaagcctccagtatgtagacgagacccacataaacaaaggccaaaggaactgggggtgtttatccttgagaacagaaggttcagtgagaatttgatgactgttttcaaatatttgaaaggctggaaaagagaacagatttgtttggaggaattccagagggcacagccattgaaaacaataaatagaatatagtaacaataataatgacagttaactcttatagacaaattattatgtgtcaagcactgttctgagcatcttatgtcttttaattctctcaaaaatcctataaagcatatactacagttatcaacctctgttagaagatgaggaaactgaggaaacagtttgatttgtcaaaaaaatcacacaggagtggagccaggatttgaacacaggcaacttgctgctagagtctgtgccgtgctgcctcaagaaagattttggctactctgaggaaaatgaagcaataggaaaaacttcatagtgattagagccatctgagtatgaaaaggcttgcttttttcaggcagtgagtctcacataactgcaggtgttacttgtacttgcaagtcggacttggcaaaatgtgggtaagcagagtcttgctattcaaagtgttatctgaggatcagcagcattggccccacctgggagcttgacagactctcaggctcctcctcaaaaccactgagtaataaattttcagaagctctgtgtgcaagatctttatgcaccataaagtaataggttagagcacagctgtactgccagacaggcctgaatgtgagtcttggctagaacaatttctaatcatgacacttacttagctaaatctcagattctttggctgaaatgggccgataattgtactcccatatggggttgtgagaatttaatgagtttatacatgtacaacactcatcacaattctataccctgtaagtaatcaataaatgtaaaacatcaatggaattatgcatcagatgtaaagttcaactacataaatatcccttaagacctccttcaatttagaaagtctctttctgtgaactagtgtataagggtattattataaactgaaaaaacacacaaaaacaagaagcacccctaacaagctaatcaggaactgaatttccagttttgagggcacatgaaaagggataacacctttaccttcttcattaagaagactgtaacaagaaaaaaacaatactttcttttcatgtgctaccatacagcttaaatacattggcaaacaccatcctcagcttttaaaacaattaaacaaaacaacaaccactattctggagagaagaaaagcagaaaaatcagatccatctttgaaagattacagaatacaggaaagacaagcctaaacactgcctaccatgttctaaaagtcacttggcctatcagtaacacttgtatagaccaaacctagaaaaccaagtaattctattaaagataattgggaaataataaatggaaaatacagtttaactgtaacatagtgcttgaaaaccagttggttaagaatgaaccagaaaatgcaactgtaaatagagcagtaaaaaaaaagaaaccactggccgggcatggtggctcatgcctgtaatcccagcactctgggaggccgaggagggcaggatcatgaggttgggaaatggagaccgtcctggctaacacggtgaaaccccgtctctactaaaaatacaaaaaattagccgggcgtggtggcgggcgcctgtagtcccagctacttgggaggctgaggcaggagaatggcgtgaacccgggaggcagagcttgcagtgagccgagatcgcgcctgggcgacagagcaagactccgcctcaattaaaaaaaaaaaaatcactgttaagtacattcttaactttaaggtaaaggacacggtgaatatagatttctgctatctacccagtatgacagtaagacaggatgtcaacatgtttggacccatgtaaatctttttccaatgagatatttacaaatttaaattatgatcatgattgtcaaatgtcaagaagtgggaactttcatgtgccaaaagcataacagagaaggaaaagaaagtttagatagaacaataatgtattaggcctgggtaaacaaacatcatcagagaaaactctggctgacttcatttccttctggtaactaagtatatgcattcggttccttcctgaatggactgccaagtcctgaagccaatatataaaattttaatgcttcaattagacattttttaaaaaaagtgggatgattttgccaaattctttgacctaattccctaaaaagctttgactgtctaagaacctaaatacctattataaggaaggtgttaactatctcctttgtcaataaatgcatgcatatagagcggattcctggagaccagtgtgacagaaacattaatattaaagtggccctgccaagccactttaatttagcactgtaacaacatccgaagcacagaataaccccaaaactgatctcagatacaataccaactgagaaaaaaaaaagatttaagatgctacaatgagcaacagcaaaaatattaatagatttcagttgttttcatattagaaaataagtgaaatacaatacttatgcattatataccttcccatccaaagactagcctgacaagatgttacagaggatgagttttcatcaggttcttcagaggtggagctctgtgccaatactcctgctgcttgacttgtgatatctttataaagttgaataaactggtataaattcatgatccgtgatgcctccacaatgccactgcttttgttaatctaaaaatacaaagaacatgaaaaagaaaagttgatcatttctctgaccaatttttcccaaaaagggggaacaaatatttagtcaaacatcctaggaaataggagttttcaggatttgcaaattacataagaaagcaagagtctgaataaatgagtaataccatgtcccctacacttgtggggttcaaacttcttatacaaatttacctcatttaacacacaaaatcaccctgtaagattaattaggcattatgctgttgatgggtaaggtgactttctcagagttaagaaataaattttagagatcagtattaacaattctttcactttaatttcttaaagaatttcttaaccacaggattcatttgactccaacaaccgcatgagattctacaactcaaacaagtactttcttaaatatctttaagttctattttgtaccaaaacttctaaactaaagcaagaaaattactttaaaataaatcctaacaaaaggtggttggacttttcccagaaggccattttgagctttatcaaaaaactcgtttaatatgaggtgaaaccagtggcccaaaggttgtacctttacaggttgtacctctcccccatccagtttacaatctaatgtagaagatacttggggcaagcagaggagattgctttcacaagctttggggagccatggagtgaggcataatgaaatgaccgaggccagtaaggtgaaggtataatgttcttggatgaagaacttgaaatcagagaaagattagagacatgaaagacttcctttcagcacaagacataggatggaagactggggaagaagtaagccatgaaatctattaagtgcatatcagagtaagaacaagcaaaatcagaaaatatttagaaagaaatgaagaatatagggagagagacaaagacacagggccataaaattgtgactttaggttctggaatgtattgatggaactaggggtatcagaaaatgaggtagattacatattttaaaatattattatacatttgaatattgtaaatgaaaataatagttgtaacacgtttattaattgcttactatttgaaaaggcagggaaaaaaatactgagactcaagaatgagtcatgcggccaggcacggtggctcatgcttgtaatcccagcactttgggaggccgaggtgggcagatcatgaggtcaggagattgagaccatcctggctaacacggtgaaaccccatctctactaaaagtacaaaaaattagctgagcatggtggcacacgcctatagtcccagctacttgggaagctgaggcaggagaatcacttgaaccaggaggcggaggttgcagtgagccgagatggcgccactgcactccagcctgggcgacagagcaagactacgtctcaaaaaaaaaaaaaaagaatgagtcatataccatactaagaaattttagaaccatctctaataatcagaaagttgattaaattttgggaaggtaaaatctatctggagatgcaaatatacaaggttctttgtactaaaagactgtacatgaggtagagaataaacagaattaaaaagtaacaggaatttaacaggcttacaaaatagatcttcagagctgaggaaacgggtagtcctttggaactgcatagtacagaagaaattatggaataatccatataaggtcagtacagaaatagcaaagtgtatcacactgtaactattctcatcataggattcctgaaacaagtatttattgagtaccattatgtggatgttattggtactatgtgcactgctctaggcactagccacagtgtgtataaaacaaaatccctgccctcaagcaagttacatgataggtaggagagacaggcaaataaaatacagatacagattaggttagatgaaaataagtgtaatggagaagatgaaacaggggagaaggaacgctgaggggttacagggaaggccttacagagaagttgacatttaagaactgaaaggtgcagaaatgagtcatatagatgtctagggggaagatcattccaggctgagacaacaggaaatacaaaggctgtttaatagaggtgtacctggcaaggagcacagagagtctcacaagaagcccagagtgtttggaacagagtgacagacggacagaggaaggagtggtagatagacggtgaggtgggaatagaatatataggactttgctgatttcagtaataactgtagctttgattccaagtgcatgagaagtcacgggggggggttttgagccaaggagtaatatgatctaatttacatttcaaattgtgatgtggaataggctggttgttgtgcttggaatagactgcttgttgtgctgagaatagacagaagcagggcaagagaagcagggagatcagttaggaggctactggaataatcctggtgatagaggatggtcactaggaatagggtggtagtagcgtagatggtgagagctagccagattctgaatacattttgatgtgacaggactcacttacagattgtcaggtgtgagagacaaagaaaagccaagaatgactctaagaagttggtctaagaaaaaagaaggatgaaataatataattcatgtagttcttaacagccaccttagtacctagtttttaattaatctcttatttttctaatattatttccataaaatattccatttaaacataatttagatcattttttatagtggattaaatattatttaaggataatcatagcagatggcagagagtcaagaaaaagacttaatgtaaatacagagggttaaagtacaatttttttaaagttgtttaacattaagaaatgtgaaactctcaatctcctatcagtttttcatggtggacttgacctctttctaacataaacactgacctctcagattctttcagaaagaacctaaggaatgcaaataaaaaaatttctttagagtagctctaaaatcaagaaaaatcacatgaaaaaatatctaattgcctgtgcctttagtacttttgtttctctacttagaatcttattttaaggaagatgtttaatcacatacagatgttagacatattgaggcaaaaaggaatttgactactaataaaattaaaccttaagtctgtatttgtcaaagagcaacaaaaaacgaagggatgaaaagcctgatatattcgtattcccttagctttctacaatttatattggcctcttcaatgtgagctgagtactttatgaaataaaaatgaacattaagtgtaatttagataatatactgtgtcaataaacaaggaaagcttcaacctatcccagtcatttaaaaagagagtattatttcaacagattttttttgttcacttaatatatactgagttcctactatgtgtaaagcaccgtattacagcctgtaagagatacaataatgaatctagacatagttcctgccctcaggagcttactctctaaaggggagctaagaacctaaacaacttttttcgtaatgcagtattataaagtataaataatgtgctgttggaatctggaagagacaagagaactcctattcaggaagacttaatggatgagatggtatttgaggtggacctttaaagagacatcaggtttagagatgcagaaataaaaggtgtggcagaaactactggctgattatccaaataccattccttcttttcattgccagcagaaccttattttgtttttgtgtccaccattccctgaaatgatgcaggagtcaatcctggttagtctaatctaaaccaatcatgctaatcatattccctctgtcagtgtaggtgtatgaaggggatatgacccaatactgaccagtgagttcagaagtgacatctgctgggtctttaatttaaccaatcctgcagttagtctatagagttaggatttcttgataagtgagaaaataagtattgtttttgtttaaactggtttaacaggaattttccgtgacttcctaatggaaggaatggacatcctagttgagaaaacacaataagcagaagcactgaactggaaaagaaaagtaacaatgatacagtcttaagttagttaagcctgataagaatgcagagcaaaagaaggtcattgtgactaatgcagaaaagatagtttggagtcatattgtaggagttgggactatttggtaggcaagaaggaattactgaggaattttaagcaaggcagtaatctgatgcgagttgtgctttagaaaggttaatctcacagcagcataaattagaatttggagaagagtctagaagtatagagattaatacaaaatctgtgataatctggatcagaagagagagatcagtctgcttgagagcatgaaatctgtcttatttatcatatattcctaatgcctctcacacttgtgctcaaatgtttatctgaataaactggaagcaaaacacagtatgggtaaaactgacaatctactgaggaaataaggcatattatttgggtaacctccagggtccgtgactcaaaggaaaaatctcctaacccagggaatctttatgggtcagtcgggaatgaacttcagagcgctcatgaatgcccaatttatggtttatatgcatatggatgattttgttctttgttttagagccggggtggggataggaggtggcctaataaaattcatgccttcatttaatcaaaaggtttgtagcctcaaaaagttaagaactttctatctgaatctactcagtggtggttgaggctttctaatactcaatgacagctggcaaaaaatctatcccataactaaaaattactaaaaaacaaaaaaactctttcaatggatcttttttctttttaatgaatgaatgtattcttaaaagaaatgatctcaagataacattaatttttaaggtatcatcttagagctaaataggatgtcaccttagcattccacagccagctaaaaacccaaaaacagagatagaagattagtatgatgtaatggttagagatattgaggcaaaaaagaatttgattataaaaacccctgctgtatagcaattagacaactgtaagattcaaacagctagttagaaggcaataacagtaacaaaactatgttttacaaaaccaccgagttattaaaatgtatatgcattatattatcttacagtattaaatatagttctagccaccaaaatagcttaagctcagaggtagaagtctccatcagtctcaccttggtacagaccacccgtacaaccactttccaaaaagcagaggaatcagacccaggttgtacctcaaagagaagatgtttttcctggccagaagccactttagccgttctgaaaagagacaagaacatgttaattttatgaaaaatcatatattaataaaataatacagccatgaaactagattcaagaaacaatttcagagaaggaaatatgaagaaacacaaaaagacaaataataatgattataataactggattcttaaaacagggatagagaatattttgaacataaacatgcaacttaatttctaaggtttttaaagtcaacagcttggtggcatgatatttataaatctctctttgtcacacctatatctcaatggtctttaaatttctaacaaagacatttaggaaaaacaagtcttagaaatcagggacttaaaaaaaaggttggccagggcagtggctcacacctgtaatcccagcactttgggaggccaaggcaggcagatcacgaggtcaggagttcgagtccagcctgaccaacatggtgaaaccccgtctctactaaaaatacaaaaattagccgggcgtggtggcgtacacctgtaatcccagctactcaggaggctgaggcaggagcattgcttgaacacgggaggtgaaggttgtagtgagccaagatcacgccattgcactccagcctgggcgacagagtgagactcagtctcaaaaaaaaaaaaaaggttagctagtgtcatttatcaaaattttttgactgttgcctcagacgtatataaagcatgaaaaacatcttgctcttggttcagtccttgttcaaacaatgatactaacaaacctcttgaaaatttttgttcagataatttggggctacatcaagtaaaacaaatgatttgagacactttatatatagctctactgtcctcccctagcagagtaattttaatttagagagctaaaggatttaaacataaaaatgtatcacttctagaagataattcaatatcatgctatcaacattaatttaaatcagttcgaagacatgcttaagtattgcagttcccttttatcattactaacaactctctctgagcaccagtggggatatcacactcaactaacagctaaataaaatgaggccatcgaaagttaagcaactagccttaggaaacaaagtcttcggtgaaaataattcagccgtgccagtttccagctctgttttctagctgccaagcttcgtcctgtataggtttaattctacagttctcggagatcactgcacgtctgaaatgccaattctgacccatggaaattggttttaagaatcaaatccagtcagaaatatcctgtgctaaataaataaaaggaagacctctgtatcacacagtaagcttagtttgtggatggttttatagggtacattttatctaatacctgtatctttatgctaaagggcaaaacttcatacaatagacagggtttatgaatataaattccaagactctaaaggaatggtaaatgtcattgattactgctcataagagttgaaaatataaacataacaaagcattccactcttatgttactaaattcagaatcctatttttaaaattctttaagaatataatcccagaattaatgctttgcacactaccctttggataatttttaaaaataagtaaaatgctagagtttttaaaaccaatgactatatttttatcataaaaatacataaatacacacagtaaaatgtaaaatctccctctctgcccccttttcccaccatctcccaaccgagagacaagcactgggaatagtttagttcattttctacacacacacacacacacacacacacacacacacacacacaccccacaactatatacagctttttgttttatattgttttgttttaatgaatgaaatccaatcttcttaaaagaaaccatcttctaagataacttttaagacagtctttattcttcccaataaagacagtatgtcttcacataaagacagtatatcaagcttatctaatatgttacagattgctaagcatgtctcttatcacctaacaccatggttgtaatgcctacggagtgggttcatatatcttaccttaaactattaatagtgactacagtactgtaagtttatatactaagtggtcctgaactgctagtcgatttcattcagcctttttagggtttaaggagaggtaatatgggataacaggaaaactgagattcagagaggtggacatgccattaatacctgcgtaatcaacttggccctcagttaaaaggtccaatccttagcagagggccttgcacatactatgtgcttagtgaatgttagctaagttgaagagactaaacagagaacctttaagatctcatttaagaggtgactccacaggttctaattatactcccaggggttagaagatatacataaataaaggtagatgtggatgttgctagaggcagatttaaaagaaagatatgacatctgcccaattgtcaccaagggagaaaataaatagcaaaaaagtcatattttaaaagcacagtggtctgggggcattcaggaacaaagagccctatatattttcatagcttctacatagatcaataccaaaattgataaataaattaacaaatagaagactaagttgtattaggtgtactctttaagaaggcagagaaatttatatttcattttagaaatttagtcaaagagttaagtagaaatttaaaggtgttaattaattagaaaatatgaataaatgaaatatattatttctcagtgatgaaaataagctattactacatatgtattcctctagcaaaatgatgacacagtaaaaaaaagtatatatatatatgcatgtgtgtgtctatatacacacacacatgaatgaattgcttcatgtacagaaaccttctcagtgttacctttgactatcctaggagtctttctctagagtggctaattctcatattccattttgttatgcacccctttagtgctttcaaacaagagtctattggtataaaattgagatgctgggatgtactactgtatcctagaattgcttcaatatgcctgtgctgtgttccaagttccattttaagttctttccatatcttctgtccccattacatacttttaaaaagctacatagaaagtcaacttataatagatactcaataagtatttgttaatgctaactgaaaacattaagtcttaccaatcaacacctctggttatatcttacacagccatgacatatggggcatacatacaacaaggggaaaaacgaaaaacaaaaagagcaagccttacacatcattaagctcagctactctcccaagaaattcttcataagttaaggagccactctctcgaaccaacgtaacatgttttgctactttttctggtaacttgttaataaccaactgtgtctgatccgaaatttgctgtcccatgatgaaaagatgtctttcaaaatccagagtgttgcttcacatagtttctgtcaaatatacagaaaagttacttttacatattatacaaaaacggcaatatactcattcttcaaaaacataaagaaaaactagggatacctttaagtgagagttgagtagacctacatgagtctaaggtagaatttaaatgactctgttttcagattcacatagctaaatgagaaaacaggattcacttatatattattgggagggtgatgaacctctaattcttataattttaccaagtcaaaaaccactaaagcacatgtgcatgtgtacacacacacacacacacacacacacgcattcaagtaattgtatttaagaggaagtttgtctaccttctataattttcctaagaacatttcctgactgcttaccacatgtcaggctccaaactgttttccgtatattatgtcaattacttcttacaacaatcctaagaggtagacaatattacacccctacctatttcccatagacagggaaactgagctaggtgatttatctaaagttacacagctgtaagtggtgaaagtgaactctgaatttgtttttcagattctagtacttacattcttatccactatgacatactggctcacaatatatttacatcagctaaataattttttgttgaattactttatttatagatgtgtaccttagttttaatttttaaaaatatataaaaagacttgtggcttgaaaaacctaagaaaattaaaatgttagatattttaaccacctcacattttctgcctggaaaaagatagctcttttgttcattaactcttttaggtacccccaaaatatatatctaattatcaagtttttaaatgcccccaaaatcagatgcccccccaagaaattctattttatttatccatcaaagactatcattttatttcatccaaattaacaaccatatcacataaagcaggtgaaacagtaatactcttatagaaaaagttttggtaggaagattgctttatcattaatcaaaaaataaagctataaatttaaaatatatataactttatgaagttagtaaccccaaaatatgtaaaatttcctttaggtattaaaatttaatgtactgtatttgaagttaattcctttagttacctaaaataggaaaaggacaattgtaatttaaaaaaaaaacaaaaaacaacagttttgaatctgagcctacttggtaataataaatatcacattatagagataaatgaaaggaagttgttgaggaagatccaggccaaaaaaaaaaaaaaaaatccctgaagtcaaattatatgtaaatatagccaagtggatttacagcaactgtatccaagaagaaacaattaaagatcttagcttagaagaggtctctagggcagtcaacaacagtgattgctgaatttcaaagactagtaaaatctcaaagcaccatggtgttggatacttcttttaattctaagcaaggacagtttccaaaaataaacaaaaattccccaaaacttaacaaaaatctcaaaaagaacttataacctgaaaagtaggatataatattagaaaaaaagtctttcccaagaagggcagtaacttcacaatgaggtataccacatatttaccaggtatactacacattgtccttatttttcttgatcgaatccaaacttatgaaaacatcatcagaagccaagggttgcagactggtattagggagccactgtgttacaggacttttttaaaattaaattcaacaagtagcacgtgcctggtgcttatgttctggagataaaacagtgaacaaaagaaacatggttcttgccactgtggagcatccaatacagtggagaagagacagtaaccacacaaataaatgtataattacaaaatgagaagtgctaggtgaacaagtacaggtgctgtgaaagcctataaaagggggacttgacctagttttgtatcagggaagaagtccctgggcaaacaacattttacttgaggtcagaatggtcagagttagggattaaaaaaaaagtagggaaatggcaaaaggaggacactccaggcagaggttatgaaaagtgcctgagacaggaagcagcacggtgactttgaggtaatttttaaaaaggccacaaggactaaagcagagaggcaaagggagagggaaactggcaccaagagttgggctgtttaacatttttgttgatgacctgaagactgtatgcctgcccaatctgcggatgaccaaaactggaataaatgaatattatctagtgaataataggatcaagactaaaacagacacttacatgctatttaatatgactaaaagttatatcctgaagagccaactgcacaaaaacacatatgtaagatgtgctcaaaagcagttaaaatacagaaggtctgggtttttgtttttgtgttttttaaagagatggagtctctttaaacaaacagagtttgttgcccagtctggtaacaaactcctgggctcaagcaatcctcccgcctcggcctcccaggccgaggattacaggcatgagctgccgcacccggccaagtctggggtttttaatcaaaataagtcaacagtataacgggggcaacaagtatgctaaaataatcctaaactcttgctagaagcaggtatcttgagcaagcagcctactagtccattatgctttgcaatggttaggccacactgaaaagtctgtattcagctctaagcagttggctttaaaggatactaataaattagaacatattcatgggcatagaaaaaaaaagaggtttattctagatagtcatagtttggtaacaatgaagcaatataagtttgtttaaatatctgaggagctgtcatgtggaaaaacaagattcatttacagagaatgggatggccactaagtatagtaagtataaattagaaaggcagatttcagttgatgataagcatgtcgcaccatccagaagtggaaatggctgctacatgtgagctccctctcattggaagtatggaagtgtttaggtaaagattagaagtacatctaataagtgttacagggatttttacctgggtgggaagtggagtaggtgacctttaacctaacattttattcccaaaatgaaactgaaccttcctctaacattcctgtaccaatttaatgaaaatgtaattaagattctagtcaaccaggctgaaaactttgaataatatctacattacttaacaaagaaaaaaactgaacttttgaaatatatagtctcaatatttaatataaatacctatgataatttaaccaacgtggtataggggagatagaatttctctccctctgctctctgaggtctccagctgggcccaagaattaaactaacctaagacagattaacaggagaaaaacacacaaattttatttagtaatttttatacatacacaggagccctcaagaaaaataaggactaaaaaaagtaattaaggccaaaagcttacatagtagattggacaaaggagaagtaaactgtgaaaacatgacaagacacaagggtttgggctgggccagttaatcacagaaaagtgactaggaagataagggttactttaagaaggcttctttgaacacatttctctcagctttgattgcccacttctagtaatgataatgtcttcctcctggcatagagaggacatctttcacatggctgttttatctccagccttcaggaagaattaggagggtcagtgggcacttcttacatctgctgcttttcaatgtgcttttaactcaaaataatccttatgccaaagtggcgtattttgctaccctacattacccaccaaaaccatatttcaaaagaagagttagttgcttatttattgagttattaatagaaaatgatcccctttgtttcagcattgttttcatctgctgccctaactttgagtaaagtttataatttgaggcagcatattaacttgttatcttgtaactgtacttggtatctgggaaacttcatcactaactccttgcattaaaatgcaacagtatctagagactacctgagagagcctgcagaagtggttttcaacctggttccagaaagagggcttgacatttagtttattttgaaaaccataaaatattgataaatattaacatctatcactatatgggtgtgaaaataagatatgactctgtgatctgcatacaatataaaaccacaacacagagtgcatgttcacgaaaacaatctgttgaggccatcctctagtcaaccaccacagcttttcagtgtccctctttggtgactgcacatatttctatcatactatgacattcgttaagtcacttggccatttccctctagtgagcttcttgaggacagcagctatggtctgtcttctggcagatacacaagcactcaatagatgtttactgaataaatgcagtaaataccattggcagtttttgttttattattattcacttagtattcttttgacttttgttaatttggtcagtcatctattagtactaggttggagagaagcagaagttaaaaatatgtatgaaagaaaatgtaaaactgtgaaaatctgtcattaaattaatgcttatgtaaactgggaaacatttactatttgattttaacaagatactcccccctaggccatgcaacagtggtattgcatagaaacataatttgcaaaccactggcacagaattcaacaaaagatgaatttctggtcaagatttctcaaagaactagcagctctcatattattgtgccacctataacacagtcattttttgcaagataaaaatatgctttcaaaaagcatttgaaggattttctaaataaagaactgttattttgaaatgcacaagatcaaggattccaaaaatgccacattctctagtgggtggtacatagtgaatcacttatttttctaacaaatgaattgtggaagttcaaatattccttataaaaatattaaaattacatcatgggtaactggcaaagcaaaaacgaaaaaactgctcaaaaactcctaaaaatttaaaccataattcattcataaaataactaaagcaaaatggaaaaggctgaaaatgcaccaaaatgactaaatgacaagtactgcactgtagtattttaaaaacctctctgaaaccagttctccatcaaattttgtatcaacctcacctaaaaggatttaattgaaataaacatcaatgattttcactgtcaagtcaactttaacatcagtaataaataccaagtactactgactgggtccctaaggatattatttactttattactcattgtttactcaaactgtagatctgtaaacagatatcaacttttttttttcaagacaagttaatatagatacatagtgaaataattaggccagagtcactatagagtccagaatgcctgttccagaatcaaagatcttgatcagaaaaagatacatacatatatattagagagagaaggagagagaaactacaaaaggatagagtgccgtactaggagattaagaatatggatttctcacagtaacagtgtgtttactaaatgcatttcatattggaaaaagcatattagacttgtaagaattctctctggacctcccttgcctttttgggaaggaaagcgtgtttgtatttagatgggaaccaagaaggatcaggctacacacatcgaatataaagttcatttacaccaaatgacaaatattaatttttgaaacatatagtcatattcttgagaaaaagttctagaaactgaagtcaggcaatgtgaaagaaaaggataaaaatccatactatttttgagctctgaattcagaaagcatcacttctcagacgggtgacttcgacatggaggtgactaatttaggatcgtcggccggtggcagctcatgcccccagacaaaattctgaatgggtagaggtcattttatagcaagaagaatgggcagaagggagtgaaaacgaataaattcgtgctgaagatgtaagaattataaacaattgaaagtgttccagcagctttatatatatgccagaggcaagaactgaattagctggcaccgctaaataggacagtgtcagaatataaaaggtacactacctttaataaggggcatagggatcgatttcaataacaatcgtaaatccacattttgtaacgccgagacaaataactgaaggaataatttcaaaagctaacacagaagccttctgctcctgctgtgtaatcactaccttcttattattagcaagaaaacgttcttttcttagccgggtctcaaggtagcagctagtttgacaaggaaagacctttgggaagggtagcagcctaagccaattcataagtgtggggctggctaagtagatcgacgtggctatttctgagctatcgtcccaggcaaaaggtttcttatttgggtgtccagcccggcggagaccgagcccgcgggccaccctagcgctcgctctggctacgccgcctcagcccctcctcaagcgcacctggacatttaaccaacagctaagtccggcggccgaatgactgagccggcggcaatattcaaacaaccgttttgggatagagaaggaaaaactctctccgggtccctcagaaccaccccgaggcgggacaagccaccgccaccccgggcaactggaacccgccgggcagaagacgggcgtcaatagaatggcctccccagccgtccccacgccccaatccgaggcccggggagggcggcggggctaggcctgtctccccgcggaagcctggctcggcagcggagggccctctggggtttctcttcccagacccagagtcctggagcagctagcaagggaaacacgaaaggacagcgccgcggagctcaccccaggttcaaggcatcgcgcaccctgcggcagcggctgcgctgcctcagcccacagctcagacctgcgggtggccgcgactcaggccgggacccggtcgcacctctgtgacgcaaagccccgccccccgcgcgttgccgggagacggcgcccaaccttcctctgcagcgcccctaccgacccgcgctccgcagctcctgagggctttcgagcccagatggtcatctgagacgagaggtggcggcgaaggagagtctcgcctgtcacgctcccggagcaggggcttcatgaggtggccatggaaacagcctggcagactcccatctctcctggtgccatctccggagcggaaagtggagcgccccgctggcgaccaaggccgcactgagagccctggtttggtcaacagttgggctccaaggtaccacttcccagacctccagcctccccactgatgatagatacacaaaggtcatcttgtttctttatgaggcaatggattgtgttcacctagccgagttgttaagcataagagaatgtatgaaaagtaattacaaggttcaaaatcctgagctttgataaatgatagatatgatgatgagcacatgttagtgatattactgctctgcgggacgtctgaatcagtaattgctgtcttttaagcatctgttgtgtgccaaatactgcactaggcactttacgggcattgctcttgtttaagtcgtctggtcaaagttgcctagacaataaacagcagagcaaggattttaacccaggtacagctgacactgctgcctctatgcttagcagttaaactggtttttatgtttcttgtttgtacacccctccttcaccagtcacttgtagattcaccttgtgaagagctaattcttccctctaataataatactctttgaccatttactatatgtcaaaccgtattttaaggactttaaaggtattaattcgtttaatcttcacagcaatcctgtgagtaggtattattaataccttcactaagacacaggcttagaaaagtcgattaacttttccaaggtcaaacaaccattaaggagcagagccagattcaaacccaagcagacagaaccctgaacctgtgtttttaattcctgttttaaactgcctcggtagtacggtaagacttcattagcgctaggtccatgcctgtttgtgcaccattatttccctgacagccagcatggtacttgttcaatatttgaacatttgatgaatatttgaacactggaaaaggaaaaagcttaaaaatgaagtataaataatgatttaataaattccaaaagatatcaaattcaacaagattccatagttcagcctaatccgggcctgggagttagaaatattactctgtaaaaattgccttcaattaaacattgtattggaagttctggtcaatgaaataaaaaaagacaaatatataaaaggcatccaagttggaaaggaagttgtagcactgcatttatttgcataagaaaattgtggaatactacaaaaaagctgctagaactcataagtgagtttacaaaagttgcaagatacaaaatcaaatatacaaaaatcagttgtatttctatatactagcaatgaacaattagaaatggaaaatttttaaatatctcttatcagcaaaaaaaaaaaaaaaaaaaaaagcagcaaatttgggacaaatttgaccaaagatgagaaagacatgtatactgaaaactataaaatattatggaatagcaaagacatggaatcaacccaggtgcttatcaatagtggattggataaagaaagtgtggtacatatacgccatggaatactatacaaccacaaaaaggactagatcatatcttttgcagcaacatgaatacagctggaggccattgtcctaagcaaaataatgcagaaacaggaaaccaaataccgcatgttctcacttataagtaggagctaaacgttgagtacacagacacaaagttgggaacaataaacactggggattccaaaagggtagaaaaaactactattgggtactatgttcaccacttgggtgacctggatcattagaagcctaaacctcagcattgttcgatatacccatgtaacaaaactacacgtgtaccccctgaatctaaaataaaataaaaaacattgttaagagaaattaaagaagacctaaataaatagagatacattatgttcatgaatcagaagactgagcatttttaagatatcacttctgcctaaattgacctacagatttaaggaaattccaataaaaattctagcagatttctttttgatggaaatgaccaaactaattctaaaatttatatggagatgcaaaggacctaggatagtcaagactttcatcaaaaaaaacaaagttttgggacttacactacctgatctcaagacattataataagagctactcaacacagtatagtataggtatgaaaatagatagagtaatggaacagtatatagaacccagagatgtatctatacatatgtcatcaattgattttcgacaaatatgccaaggcaattcagtgggggaaaagataatcttttcaacaaataaacctgaaaaaattgaatagcatatgccaaaaaactcttaatatcttgctcctttcctcatactgtcacaggatccttggagtgttgctctgccagccagaaacctctgtggccggtggctcctttgcccgagttttgctcaggcccactgggctcattctgcccatttggccttgcaggctgcactcggctcatgccactggcccagatcccatgcctgccaaggacgagccaggcgcaaagtggtgaggggtgcgtgagcaagtgagcgcgaggtctggccgctgtgcacagctaggcacgccagctgtggcggggcgggtggctccaggtgctggcatgggcgctggctcctgcaaagctgtggctggaccaggagtaccacaagcggcttccactgctggcactagggaatgtggtggcacctggaagctttgagatgccaggaaatgcagagcccccaagagggtgttacagtcctggctcagggagctcttaggtctgggcttctcgaagtgtcaaagctcttctctccttctctcttctgtccttctcatcgcttgcaacatggggagtgagggggtgtttcagccctgtttgtgttacagttctttcagtcctgccatttggcaggtcccaagttgttgtcccacatccaggaataatgaggtatgcagacaattggagggtgagtagggtgaagaggtgctttattgagtgacagtatagctctcaggagactctaagtgggtagctcctttctgcaggcaggttgtccggttgtctgcccagctctcagctgagaggagacccacagtgggtggctcctttctgcaggcaggtcgtcaggatgtctgctgagccctcagcagagaggagatctggagtgggtagctcctacacgcaggcaggttgtccccatgtttcttgagtctggctgagcctaggatatttatgggctcaagagggaggaagtgcatgctgattggtccatgggcagtagaaaaagtgccataagttctcactccagtctgaggacctggcagcccagcccccaggcttcagactctcagttgcctaaaggtagggtttcactgaggacccacccctttttgcccaggagccagtctgcctcatgccactgtccatggcaccaaggctgtttgtgccagcgggagcctgcaggcccacactgagctgccctcagcgccccctcagcttcccctcccatgctcatcagtgtccaaagtccagagggggctgaggtggcagggggctggcatgtcagtgttgccccaagcatgcacacacctgccagattgtgacagcgtctgggcttggccacaactttgctctgccccagaagcagggagaggccagacagcaggagcaggcactttcaagcctgtgggggcaaggggcttcctgggcccctgagagcacaaggatgcccaggtccacagctgtggttgggcagctgcagctgtgcccaggagggtggggctcccaccccaccaactcagaagcaggtggggctccagcctgttcctgttttcatggttctgtggagtgtgcagccctggccaggcctccctcactgcagcttgcatctttgcagcagctgctccagacgggctgccactgccatcaatactatatgtaaaaattaactaaaaatggatcatacatctaaatgtaagagctaaaatcacaaaacttctagaagatatcttagtgaccttggatttctcaaagacttcttaaagatggcacaaaaagcacaaactataaatgaaaaaaaaaaaaaaggatgaattgtacttcatcaaaattaaatacttctgctttttaaaagactctgttaagaaaataaaaaggtaagccacaaacttggagaaagtatttgcgaaacatatatttggcaaaagacttctaactagaatacataaataactcttacaacccaataagaagacaacccaactttttaaaatgggcaaaatatttgaacagacatttcaccaaagatttataaatgacaaaataagtgcatgaattaataccattaatcattagggaaatgcaaatcaggaaaataataaggtttcactgtgcactgtagctactagaatggctaaaatttgaaagacagatcatatcacatgttgacaaggatgtggaacaacagaaattcttgtatactgcatgttggaaatgtaaaataatacaacaatttggaaaagagtttggctatttcttaaaaagctaaatatacacctaccacatgatctaaccattttactcctaggtatttacccaagagcaatgaaggcatatgcctacacagaggcttatacatgaatatacatagctttaactgtaataggcccaaactggaaacaaccaaatgtccatgagtaggtgaatggaaaataaattgtggcatatccacaaaatggaatattactaagcaataagaaggaatggttgattggtatacctcaacaacatggatgagtctcaaaataactattttgagtgaaagaagccagatcctcccccgcaataaaagagtacctgtggtgtgacgccattcatatacaattctaggcaatccaaactaatgtatagtgacaaaatgcagatcagtggttgcctgggaatgcgggagcagtgttgtggagatgggtgggagggtagtaccacaaaggagtgggaggaaactttttggagtgatggatatgttcatcttcttgattttaaatgatggtttcacagatgcatatgttgaaacttctcaactcgtacattttaatcatgcacagtttattgtatgccaattatacctcaataaacttgtttaaaaaagacatagctagttgaattttaaagggttttgtattgtggcctaaacagtcatgaaaagtgctctgcacaaattgccttcaactttgtaaaatagagccattactccttcttatatctcatggggagtatagtgaggattgacaaggaaaagactaaaagactaaaatatttaaaatcagtattaaattaatattattaatgacatctctagataccttctcatcacaacagctttcttcttcttacctttgcatgagcataatgaattaattagaatgtaaaacagaacaagacagtaataaagattatcttaaaaaacaaaatagaagagattagaaatcctctgtggaataggaattttgaagctactttgcagcagaataaggaaaactttatttttcttacatataaaaaagtataagaaaaatatttgtaggaaaccacatatataaatagtaaaagttatggaagaagaaacctctaagttttttataagaagaaggatcattttgccatgagtcttgtaatttgtaatgtatgttcagattttcatagttttttaaataagtattttccagttaaagaaaacacagaggctttgataaattctagtaaacatggtcctgtagtcaagatcaggaaaattggagacttttggaatggtatattttttcttccatttatttatttatttatttatttatttatgaggtggagtcttgctctgttgccaggctagagtgcagtggcacaatctcggctcactgcaacctccgcctcccaggttcaagagattctcgtgcctcagcctctcgagtatctgggaatacaggtgtgcgccaccatgcccagctaatttttgtatttttagtagagatggggtttcactatgttggccaggatgatctcgatctcctgacctcgtgatctgcccgcctcggcctcccaaagtgctgggattacaggtgtgatccactgagcccagcctggtatatttttttctaggaaagtatgtccaatgtctcctgcttttttgtaaggtcactaagcatctgtgttaggactgtgggaatatatgaggaagaccctgagtggctatggattgtaaacatttttaactttccgtatgtaattcataaaatcataaagttgaaaaaagactgcctaacaatcgcctggtccaatattcttcttttagaggtgaggaagctgagacccaaagatggaaagtgattcatctaaggggtacagagcaagttaattaaactgggttagaatccagatttcctggccactagtccagtgcttttcctaacaatacactactgcttttaattctgtcagtgtagaataagaggaacacctagtcacctaaaattaagacgaaagcttcatcattttctaggactttgaggcttttctatctcattgatttcttctttctggctgcttctactcaaactttgttctcagccttctgctcttattttttaaatgtttggggccggggggcggtggtgctcatgcactcacagctttaattttcaccagtgttgagatggtttccaaatctacattgccaattgttatctttcattggtgttctaatccggtatttccatatttacacataatatctctcataggaatgaatgtaccacagcaagggtgccttgatttccatactaaagtggcttcagaattccagcgtatctgtgctggtgtcagtcaatagcaaccgcaatagttcttggcagagatggcagagcctagagaattctgtggttgctggaggaaaaggcagcagtctccagtggacaagacatcatgtagagaagtagcactgttacttggtagatgccacctaggatattaccagggaatcagcagtagagtctggcagagtcagcagttccttgtgggtgtggcagtgcccagaagatatagaagcagtgcctagtaggggcagcagtaccagctagatgtggtgatacctagaggaaatagttatggaggaagatggacaaaacaaggggaagtggtcagtgtgcctagcgggagatatgatagtattcactggagtagaattagtggaattagtggagtagaccagtgggaaaacacttaatgctatgtggaaggtgatcacacttgcttgtgagcatatttgagtcacctgcttccagataaacctagaagtttgttgttctgcggggagcaggattctgctttaatcgattcagagaaaagttacattggtgcatcccaagccatcattctgggaaaggagaataaaagaagtttggatattacaacaaaaataattatctttgcccccatccatacttcatttatatcaggtaataaccctcagtgcagagttctctgagaaaactcttttaagcatatggcttaagcctggaggcctaagtaggatccacgaagagaaagatgcaacaggggctgagtccagctatctaactccatatgtggaatagaagtaatggtagaaagtggctaacctgcgtctagggcgcaagtcctgccagaggctgagacaggaagcagagaagtgagtgccatgaatgggtgctgagctttaaggtagctcagctaccttgaagtttaaggataacctcatcaatcaataaaatgtgtgtgcctaccattgaaagtcttggtctttgtcagtaggtttagcgactcctcttcctatgagtggggaattggaaaggggacatgaagaagtgggagcaaggatgggaatattctcttgcttatgttacagtccgaactgttccccagctctgattgtcaccacatgacttttttccttcatgcagatgcagattcctcagctttcccactgactactgaatgattattatgtcattttgtttgagtatattagtgctttgatctacctgcctcggggtttcaggcttggggcaagatctcttgcaggcaaagccttgcttctgtccaaatcaggatcaaatttgcctcttgcctctgcccagataccagtcaataccaagggtgagatgacatcatttctgatgcctactaatggtatgtgcctcatcccaccctcctttctggattgaccacccagacatattttccatgctggatcttcatatttaaacatcctctccccatatttttactacatagaaatttctgttatgttctttaacttgacggtatatctttgatacattattttactaatctttactaatggagaaaacataatatgattttaagatatttggttatgatactataacatcgtatcgatgttatataacatcaatgttttataacattgaagtctttgttattactgttatcatttatgatgttgactttgctgaaatgttgatcttcataggtaaaagaatatgcacagtggagtactgaattaggtcttttggtattcttttttttttttttttgagatggagtcttgctctgtcgcccaggctggagtgcagtggtgcgatctcggctcactgcaagctccacctcctgggttcacgccattctcctgcctcagcctcctgagtagctgggactacaggcgcccgccaccacgcccggctaattttttgtatttttagtagagacggggtttcaccgtgttagccaggatgatcttgatctcccgacctcatgatccgcctgccttggcttcccaaagtgctgggattacaggtgtgagccagcgtgcctggccagtcttttggtattcttaattgattttgtctttttttctatcacaaaaatattttcaacttcactgaaggcaaaattcaaacaaaataacagtggagtggtaaaatgagtctggaagttatcaaaaaggattctaattttcagaaaatgatggcaatctaaaattctgcactaaatgctaagaaagcgtcctaggcttcaaagactaaaatagaaatatagagaccaaggaatcaaatttttgccaatacttattagctttgttgttactgagggaactcaatttgtttttaattacccacagtccaaaacacactgcagtttagtttctctattaagataaatatcagtttgacttacagaagtgagtcaatggccaactcagagagtaaagttcaagtatagtagcctttatgcattcttctggcttgttcatagttgcattctacaccaaaataaagtattcaagaagaacaaaatttaagtggacagaaacagttagccctgtactgagtgaccttagcacttaatgcagataactggataaaggtataacttgcagctcatgaaatctcagtgaataaatgtatacatgatgaatgtatatacatgtattcattcaacatttactcacagcctactcagtaaatgtgctagatttacatatactacccaagtgctaagaatgcaaggaaaaataaaatatgtacacaattaacataatacaatgtggcatataacacagatgtgtaaacaaattttaaaaagaaagaatgagaaaaattcattaatgtgataggaggcagccttctaaaatggctcccaatgatctcctcatcttggtattcatgcccttgtataatcccttccacttaagcatgggctggacatagtgacttgcttccaatgaataaaatatggcaaaaataatcggatgtcacttcgaagattagatctaaaagattataactttcatcttgccagcacgcttcctctctggctcttcttgcttattgctctgatgaagcaaaccgctattttgtgagctgtcccaaaggggaggtttgctaggaaagaactgagggtagcctttggccaactgcaaacaaggaattaatcctgtcaacaaccatgcgagtgagcttgaaagttaattctattccagtcaaatcctgagatgactaagccctggaagacagttgaattgcagctttgtgagagaccccgaagcaggggacccagttacccatgcctggtttcctgatccacaacaatgttagataataaatgctgtaaaagtcatgaagtttttagataatttgcttttcaacaattgataactcatacaattaggaagaaaaggaaggtgattaaaatagaaggaatggcagttgcaaaatgagagggcatcgtacagattaaattctagaatggtaaatgaatttgtgtagccatagcatgaagtatccttgcaggaatgaataagatttgagaagaggattcaaggtcaaattgtaaaatgcactcagtgtcatttatttcactgttcccttacagaaaacttgccaactattttaaacaacaaaaaaaagtttaagacaggaaattaggtacttataaaattattggaagggctggagaaataatttctggtctcagccccaggaatgcctcccagagcaattatctctgaatgggtccactagggaagcttccgtctcctctataataagaaaagtggggaagcaggagatgcaactgtaataggtctgttgctcaatgtgcatgggaagtcaatatgccaagacgcaggggttgcagcagagaaagaggtttaatcatagatagggctgctgaacaaggagacagaaggaaacttcaaatctgtctcctcagaaaatttgaggctaaggtttttaagggtttcggagtgggccagagtatggaggtcattgactggtcaaagagtgcaggggaagtcatgtgacaggaaggtaaagaaatgatattctctctctctaaagaaaaggagggggcaagagctcattgaagaaatggttgattctagaaccagggcaaaataagatacaaaaaaagatacaaaataagaggacactggagcatcttatagtgccagaaagtagggaagtgcccaataaaaacacgaagaagggaatatgtcaaagggatacaggagcaaatggaaagagctcccaatagtcccaatagtcagtcttcgaaaaaattgagcaacaacataaataaaatagtattgtattattacctaaagtagaaaatattcttgagtccatactgatatgaataaattatttaaaaaataaattaatgagggggaatagatgaatctcctgtacaggaaaagcccaaataatttatgtagatattccacttttgaggaagcagagcataactcctttctaattaggtgtgggttgtgcatagtgacatcttttcaaagaatatggtatagagaagaataactttacagtggagaaacctgacaaacactacctcagccaggtgcttaaggtgaacatcagcagtgatagatcatgttgatataacatgatgaaaatggcactgtatttctgtggtcttccttcccaaaacatacagctccggtgtagtcataagaaaacatcagagaaatcccagctgagagctatcctatataatacccaaatagtactcctcagaactgacaaaattatcaagaacaagagaagtcagagaagctgtcatagccaagaggacacgtgatgactaaatgtaacgtggtgtgctgggtaggctattagaacagtaaaaggacattaggtaaaaactaaggaaatcagaataaagtatggacttcagttaataatagcatatcagcattgtttcattaagttacaaatgcaccatactaatatcagatattaataacgggaaactggtgtggatgtatgggaaatctttgcactattttcacatttttttggtaaatttattctgaaataagtttttttttttaaaaaagcaaatagtcttctagatgctaaaggaggaaatcttaaatcacatcagcaccgtttggaaatgtgggcatttcctgaggaacatagagagaggagagaattcctatttgattttagtattacgaaaaatgctcttagatcaaacttgaccttatatatagactattacaggagtaacccactaaattttacttattttaactagaaaatccaactaacaaagaagtgctttccctcctgtttagaggctatgatattacgattatataaatattaatatattggttttcatccacagttcctggctcataactcccagagtccttgttacagtcttttgttacaatgttgaggtgctttagggctcaggagcaggtctcaggaaacagaatctctctttttttttttttttttggagacggagtctcactctgttacctaggctagagtgcagtggcacgatcttggctcactgcaacctccgcctcctgggttcaagcaattctcctgcctcagcctcccgagtagttgggactataggtgcacaccaccgtgcctggctaatttttttgtattttagtagagacggggtttcaccgtgttgcccaggcttgtctcgaactcctgagctcaggcaatctgcctgcctcggcctcccaaagtgctaggattataggcatgagctaccgtgcccggccaacagaatctctttctctgaccttctcctgtcctccttttacctgctccaaggcaggactctaatctgattgtgggtcaaaagaccctcattgcagacagagtcctgccccataatctggaggatgaaaagctgcacagagaggccaaggagaacctgaacaggcaggccttgctgggcttcccaactcagtctattagtatgaggtcataccctttttgtccaatcacatttctacacagttgtcaatcatgcctatgtaaaaaacaaaaaggacagggtttggagagcttccggatggctgaacacatggaggttcctggaagatggcgcgggtatggaatctctgcaccccttcctccctacctggccctatgcatctcttcatctgtatccttcgtaacaacatttataacaaacctgtaaatgtgttactctgagttctgtgagcagctccagcaaattaattgaacccaaagagggggtcatgagaacccctacttaaagcgggttgtcgggagttctggaggcccagtcttgtgactggtgtctgtggagtgggaggcagttttggggactgagccctcaccctgtgggatctgacgctacctccaggtagatagtgtcagaatttaattagaggacacccagctggtgtctgcggcttgttgtgtggggaaaacccccttaccttttgtcattgagttcttttgttattgagttgatgactgttgtggtggtgtgagagcagaggtaaaacaaggctcgggagtttttctgaaacagaggcttaattttttttttttcaagcatgatatttattttttgtctttttttattattatactttaagttctagggtacatgtgcacaatgtgcaggtttgttacatatgtatacatgtgccatgttggtgtgctgcacccattaacttgtcatttacattaggtatatgtcctaatgctatccctcccccctccccccaccccacgacaggcccggtgtgtgatgttccctaccctgtgtccaagtgttctcattgttcaattcccacctatgactgagaacatgtggtgtttggttttctgtccttgtgatagtttgctcagaatgatggtttccagcttcatccatgtccctacaaaggacatgaactcatccttttttatggctgcatagtattccatggtacctgtgtgccacattttcttaatccagtctatattgacggacatttgggttggttccaactctttgctatctacaactagaaataccatttgacccagccatcccattactgggtatatacccaaaagattataaatcatgctgctataaagacacatgcacacgtatgtttattgtggcaccattcataatagtaaaacattttctttttggtgtgagagaccctcccattccttagtaaaaacgtatttacttgcatgttattattgtccttacaaacttgtttttccctagagcaattgattttgctttaggtactagctgaaggtctagaggcaatacaatttaggatccttgtctagaaatcaatatgattcaattcttttcaagccaaatgatatctgtagactccagttgtgtgcaagccctgtgtggagcctcaagtcatctgcgttagtccagcttcctattcttggaaatcagctttgcttgattggacctatattggcatgttaatgtttgatggtggcctggcctttataaaagcatacaattttgcagatgactccttctcaggatagagtgtctttgctcaaaggagtggatttattctgtgtgagccagggaggcaggcatgaagaaggggcattctgaaagggcagggaagatcctttgcaccagctgaaaatgccatcacgtggctctccacctgcctcttttgaagactggctgtggcgaggtggactgtaggtctgaagtggggagatctcttgcattcttccaatttctctttgttcagtggagaataaagaaaatttaaataaggaggagatttctagaccaagccctaactttagctacctgtgacattggtagcttcattttatttactctgtgaatgaagggtttagaggaaattattctggatccttctgagccttatattttctgaccctatgaactggctcaggtaggtctttgttgaggctggtgtctacatcaatgaggaggcagttctcaaagttctttagtggttctctttttctccttgtcattgccaacggatttaagatagattctgtgaagttgacacaggagtcctaagttgttttccttacttcacccctgttgtttgtgttaagtgtccaatctcaagcttgcatattggaatagtttacatttctatattgtcatttgcaagagaagcactgtggagtagggaaaggagcatgggctttgcagtcactctgacctttaccatttaactagacctgtgacctcagaaagtgatttaacttctctaaacatccagttttctaattaataaaaatggcagtaattatcctcacctctcagggaaagtgtagagattaaatgaggcaacatgtaaaatgactgtcacttagtagatgctccataaatcagccagcccacccttccttccttccttccttccttccttccttccttccttccttccttccttccataatcatggaagttacattcttatcagtatgtttgcacatgatatttgggctattgagtgattttatgtggctgggcagggttttctcctccccacttcctcctcctggatacggcacaaacctgtttaacaggagaaggtggtagcattctaatatgtagtagatgcccacaagatgggagatgtggtgtgggagatctgttttttttttttcagctaacacacagagggaagatcactacttaggcgctttccctcttttcttctttactccctgagaaatggatgaagctgataaagcttaaggactgacaaaccagtttcaaactcatagacctactggggcaggcaggtgatatatatgagggacgtgggctgggtgtgaagaaaaggccacagtgttacaaagttcataggaaagggcacctttactttggcatgagtgtgcaacagagagtcatgaggactgtggtgaaacaaaaagagcagaccccattgaaaggggacagctgctactcagtatcagataatgattgctatgagggaacatgggttctttacttccagatctttccatttttagagggaacccagaaatgtaaccatgtgaaatctcttgatttttaatgcctggaaatgaaatcaaattttaagattatactccgtgggccaaccggaaaagattatgccagcaggttgtggcatctgggccgaaggaaccacggagctgtggggtcactggtgaggggaagaagacaattagcagtctaagcgggagggaaagagaaaactagagaagcagggcggtcaaaagtgagacgaatgagccatcctggatctctggctccctggtgaattctgaaatggatggaaatggagggccagcatctctagtaaaggactgtttaatgtgtatgtacttggccaactcaaaataaaatgtttggagcatgaatagccccatatgatatatgctgtttggttgacatatgcttgtattttaacaaccaacattgtcccttttatttttgcaaacaatatgatatgatctggtcctcactttaattttacatgaaaggtataatgcatctacgtaaataagaaagcaaagaagttttctaaatgctttaattttttgtcacaaatatttctgcatctctcagtcccttcttgttggaaaaaggagggctagtgatacatttgttaatggcacttttaaaatgtgctttggtatatagaggtaacaatgtacttcttaggtatgttaataataaattaaggttataatggttgccatattagagaaaatgaataagattagtctcagcaaaaataaaaattagtttggaagtagataagctagaaatatcaaaactgaaaaaaatagcttcccagatagcgttctactatgtgcaattttttgaggaataatattcaattacagagtgtaataccttgcacagcacttgacatatagtagctattcagcaaatgtttgttgaattttattactttttaaacaaattactgagtaatcttccttagtaatcatttctgtaactcagataaaaatagaaatttataagagtttttatttttgttacttgtaaaagtatatttcctagagaaaatatcagcagtggtagagaccagaaaaagtaagtgtgtgtgttctaaacagtgattccaactcaatgtgttcagagaaaacactttgaccctgtctgtgtttacagtccctgctgacagtgtactgtcgtatcctcagccttgttctatttctttattttagctttacagagattaggtctcaagttatgagaatctccatggctttcaggggctaaacttttctgccattcttttgctcttaccgggctcagaaggacatgtcaggtgggatacgtgtttctctttcagagctgaagaaagggtctgagctgcggaatcagtagagaaagccttggtctcagtgactccttggctttcaacccacctagcctcagacagccaggaggcctttttaccactggatactgatgagatgttttaggtccttgcactttgcaaaactcctttctcccagtgggatattattaggacatagccaggctagaaaggccgtgggaagctttggaggtaggaggataggatccagacagggttacaataaggagaagggcattctctttggtgcactccatagtccaatggcagtcctgagctgattccagttaggaaccaagggtggactttcttctttggttctttggcccttttgatttccccagctggggcagggtaaggagcatgaaagaaaccagcctcaggtgtgtctcctcatttctgtctcatctaaacttcagcttccaggcatcgcacggtagttttgcttggactcttggactcttctgggtttttatcagttttctttgattcctcattagggttgctatcattggccttctcctcctttactactttggtttcgatcatttccttctgctgattcttgtttgtaaaagggaaggccttcacatacctttaggcagaaacatgaaattaaagtgagagactctcacacataacgatagataacactttttggccatggtacatattggcacagtacactggatacctttatttcagagtgatgccagcacatgcatgctctaatacattaagacatcaccaccttaatggattcatttaaattggacaatatgtttgcaggccagactttaggctgaccacataactcttccaacaaaaacaaagaaccaaaaatcaaataaagcatataaattttccccagatgtcaattttttttaatttcttgattttcaaaggacagtcattgactgatggctggacgacatgcatgtcctgaaatagaaaagattgggctgaagggaaagagatgagatgagggagaaatttatatcagaggactgctatctccattttgatcagcaaaatgccaacagtgaccctgaaaaagcacaggatagaaacatgacaaagattacaagactagcagtgcaccaacaaccctaccttttgacatagcaaaatccaagaccagctgcagcaccaaagaagaggagagcaagcactagcagagccgtggggacacctgcaaggaacagagacaaggcctgttggtccttcacttaaacattgtgtgtaatgctcattgcatgatccaggtgattgagacagtagacagtacaggagaaaaaccttctctgtagccctttatgatattgggcccacaccagcttctttgcttcatgcttgtagaatcattggccttgcttctcacactctcaattctatcagttgcaatatgacagagttcatttctcctccatggccttgagacctactctagtcaacaagcctgcctgagaaagagatgactagaataaagtcataggcctttagggtatatattttaaaaagaacttatgcataggaacagatagtgatttatttttaaaagtcttgagttttcaacagtgaaattcttttatacttacactttttagcttaatcactaaggttctttacagctctcagattctatgacttcatgaaagttgagtttgtgttaagcttttattagtatttgacaggtcctgagcgcctcatctaaagacaggcaggattctatgaattatctgttatacatgaacatacatacacacgtaacatagacacagaaaccatttacctccaaacccagcagcttcattcttgaatgctgctttattttcaacaaatggttcagtttctgtagacatggtgctagtttccataaaaacttctgtgacacaaatcaatttttttctccgtggaatagaagtggaagctggagcaggaggagtagtagtaggggcaggtattgtagagtaaggggatgccaccgagtaggtactgtcactgacaataaattctgttgtttgtgttgcagtttgagtgttgaatatgggatctttggtggtgataatttctggaatgcacgagttagtccaagtatctgttgggatagggaaacatggaataaaagtattgcaacagcctcctaactgttcttcttgcctctagtcttactacctccaaaccccttataccgcagctggaatggtctttaaaaagcaaatctaaccatatcactttcttccttagaagccttcagtggctatctttgttgtatggcctacaaggccttctgtgatttggcccctgctaacatgccagcctcatctgctctttttctctcattgcccctgccatactgaaattacttgaaattccttgatacactttatcttacatccaagccttgcaccacgatgctttattcacctttatgactctttgcctctctttatttagcttactctgactcatccctcaggtctcagattgaccctgtctttctcaggcagacttgttgacttgattggcatatgttcttgtacttccttgtcacagttctcattacactgttccccactggactgcaagctctctggcagcagaaaccccgtctgtcttggtcagcatggtatgagcactgtgtgtggtacatagcacatgctcaataactatttgatgaatagggaaggaaggaaaagggaaaggaaggaaagtatagattggaagaccaaatatacacatgtggtgtcacttcaggacaaagatatgctaagacctgatatttctgggctcattaaaaaaagaagtgaacaaaaagggaccaggagagggataagggtttgctttccaatctgttgcatgtgctagagaggaaacacttgttaaagcatcttaatctgagttgaccatggcagtaagtgtttaaataggtatctcattgaacaatattactaaacccttgtttacacaggaggaaactgaagtttagagaaattgaataactcgcccaaagtcacagagctagtaaatggcagagccatgcaatatattataatataaatttgcatctattttaagtccctaattatttgtggcagtgggtagcatcagctggggttggggggtgggctagcagagggatagcattagaagaaatacctaacgtaggtgacgggttgatgggtgcagcaaaccaccatggcacatgtatacctatgtaacaaacctgcacattttgcacgtgtatcccagaacttaaagtataataaaaataaaataataaaataaaattatctctggaaaaaaagaaaagaaatacatgggatgggagtacaagttaaatgaaaccatgaggaaatagacaaatccaagtcctcttcctctggctcttctctgtttagtcagagggctgggtatcatcacattgccagctggcaggaaggcagttaaaaagcaaagccatttgacaggcatgggctggctatgaggtatgcaggcatatgtagctcaccaattccccagccagtgatgatagaccaaagaggcagagaagggaaggaagatgggaaatacactgttaggagaagccctatgtttcagtcttgattctgccactaactgaccgtaggaccttgaacaagctaagcccgtgttctgaactgtagttgtttcatccatgaagtgagggaactggtcaaagtttctccatgggccttttctgtgccaaagccctctggatcagggaactacttggatcctatattgcctttctgggacagtttttgctaatattggctggtgcacatttatctctcggatcttcgagaatgatcttgaaatctatcctgtgtatgacctctcagccacctaaccttcagaaggtcagatagatgagtatgtgtgaaaagtaataatcagacaggggtccttatgacaaactgagagcaagtgagtatttagtaaaagaaaaactttaggagaagtacttaggtgaagcacttgggctaaggcagccaaggtcttcaagcaaggttagtgggtgacttcatgaccacgaacaaatcagtgctgccctccaggtgtcaatcttttccttcataaagtggagactgggtctggttcttaaaattataaaggaatgtggaacagtggaaagagtgcggtttcagagttagacctgagtctgaacctttacagtaatgagacgttagacaaatgtgtttacatcctttgaactcggtttctttttttttttttttttttttttttgagacggagtctcactctgtcgcccaggctggagtgcaatggcatgatcttggctcactgcaagctccgcctcctgggttcatgccattctcctgcctcagcctcccgagtagctgggactacaggtgcctgccaccacgcctggctaattttttgtatttttagtagagacggggtttcaccgtgttaggatggtctcaatctcctgaccttgtgatctgcccgcctcggcctcccaaagtgctgggattacaggcatgagccactgtgcccggcctgaactcggtttctttatttgcaaagtggggatgataaagcatatctcatagggatctgtagattccatataggtggaagcaaccaaccttggattgaaaatatttgggaaaaaaagaaaaataacaatacaacaataaaaaagcaaataatacagtacaatgactgtttacatagcatctacattgtattaggtattataagtagtttagagatgatttaaagtgtacaggaggatgtgtgtaggttatatgcaaatatgaccccattttatatcagggacttgggcatctgtagatttttgtatatgatggggtgccggaaccaatctcccactgacactgagggacgactgtgcatcactttgtccataatggatgcattacatacatctgtacctttgttccttcccttctgcctgcttatcttataggatgcagggatggtggcagtggtaattgagcctcctgaatgtcttctcgtgtgttgccattcagttatatctctcctaactttttcctttgaggggcatattgccacccctagcctggccagagagacagtgtcgggagaattagatggccgtggctgtgattgcttctgctgctgctcagggttactcttcccagacaggtctcagagtgagagatacccagagaatgccacgtggaaaggttgcagatcagactcaccagatgagttgtaacaataggctgcaaactgtcggctcactggaaccttccaaatcaggacacccaccccatttttcccacacttggggtttgggctaatcctagagatgaccacgaatccatctccaacccagccatagctgtaaaagaatacacactagttgaacagaaaaatgattagaaggcttcatctctattgctgaacaagaacacagagctaaaaaagaactccagcagtgacagtgaaaccagctttttctcacctgcaagtttcaaagctagctttcaaggctgtttcaacttggtccttgccggccaaacttagtcccagcagcctacaggcctccttagcttctgtgaaattcagctgctggttcgcctttttgctcacaagggtgatccccataattctgcatgacacctggatggaaagctctgcaaaggaatcacataggtcctcagtttgctgctgtccttgtttccagcccttagactctccttcccagcagagtatatcgtcctgatgcgcagggaggtctatctggctgggactggggtttagaataacaggacacagaccaggcattttccacaaggaccatctgctgggctagatggatgcttgttcttgtccaagctgtaaatgtcgcccaatcaaaatctatcccatcccactgcattaagatgccttgctcaccatataggggctttggctacctgttgttggggtgcagtctaagggatgcagttactgcaaacctttctggagtctgtaaaatgaagcatctgagactttgagaaagatagaattcagggctctagttcatagaatagttagcaataccccaaaccaatgtggtttggggacactactatttgtgagatgggctgaaaatgtcacacttgttataaaagaatgtgagtgctctcagttccaggtcttttggccactgggggacaggcttactcagaagttcctggaggagctggcagtaaactttgaatggcagaaaaactaaatgaagaaagcagaattttagagtcagacttgggcttagatctagcatatgtcatttgctagctctgtgaccttagcctagatacttcatctctttaatcttcagctctttgagcctccttgtttataaattcaagggagtaacagtgtctactgaatagggtagtgaaagttaagtgagtaaattctaatacaaatgtttagcatagtgcctgccacatggtaggtgcttaataaatccacataacattatcattatcgttaaagcattttggttttggtctgctaatgattgattaccccacagaagctgaggctgttgaataggtaagatatgaataatatttctactcaaaatctaatggatttgggaattcttttgaacccttttctctgggttctgggatgtacagacctgtataaaattgccaagttgtattgtattcaaatacattattcctactgggcttcatccacaaacatccataaaagggcatttaaatctctcaagtaattgcttgtacgcagctctgtgtattggatgctcagtcaaatgctttgaccacttcctaggttgatatctaatggaagtttctttttgaaaacatggaaggagcatttctaagtcctccatatgaaccttgctgtggtggcagattaggagcacacactcaattatgcctgattctaaaaccccagttcctcttttttccttcttctttcccaagagatggatcttgctatgttgcccaggctggtcgtaaattcctgggctcaagcaatcctcccacctcagcctccctgagtagctggaactacaggtgtgcaccagtatggccaagcaagaaccccagttctttttttttttttgagacggagtttcactcttgttgcccaggctggagtgcaatagcgtgatctcggctcactgtaacctccacctcctgggttcaagcgattctcctgcctcattctcccaagtagctgggattacaggcatgtgccaccaaacctggctaattttgtacttttagtagagacagggtttctccatgttggtcaggttggtcttgaactgccgacctcaggtgatccacccaccttggcttcccaaagtgctgggattacaggcgtgagccactgtgcctggcccttttttttttcttttttgagacagagtctcgttctgtcacccaggctgcagtgcagtggcgtgatccatgctcactgcaacctctgcctcccgggtccaagcaactcttgtgcttcagcctcctgactagctgggactacagacgcgagacaccatgcccagctaatttttgtattttttgtagagatggggtttcaccatgttggccaggctggtctcaaactcctgacctcaggtgatccacccacctcggcctcctaaagtgctgagattacagtcatgaaccaccgtgcccaacccggcccccagttcttaacaatgacactgttttacctttcacagtgctataaggaaatgaacacacacagacacacacacacccctaggctgaactccctgaacacaccgtttgctctgaaatttggctcttttagctcatgagcttgctattgctcaggtctcttatagctacttctttgggaatggattgcagaggtttatttgtcacattatcaattggtcttactaccctctcatcatatgtcatttgtactctaaatactattatttagaggagtgatagacttattctaggtggatagacttagctttgaatattttttctattgttaactggctgttgcgacatcaggcaagtcagcattctcatctgaaaatggggatggatatatcttcttcacatgatttttatcagaattaaattagataacttgtacctagcagaggcggggcccagtaggaagtcaacaacattagtcattttatgctttcctatttcatttagggatcaaaagagggagctggaatttaagggagtactccagtaactccttccttaagatttctcaggaaacagcaaacatagtagaaatagtgtatgcttaggagttagatataaggatgtggaatcagataatagcatatgcttaggaatcagatagggctgaattcaaacccaatatttattatgtactgcctgcatgacattgggcaagtcacttcacctataaactgtctttttgagaggattaaatgaaattgtatatacacacctagctctggatcactatatacttggccctcaaatatagttcccacccctattcacttaccttcatcaactactttattctgcagtcatggttatgctgacttttggttgtttccaaaaatgtaatttccctagaaaatctttttcccttgctgaggatagtccagagtgtgatggagtcattttcaaaaaacagtgtccaatagtttgaataatggcagcattgtggggaaaaatagtctccccagaggatttcaaagaggaccaaacttatttgaaagtaacagtattttaaaaaactaatcatataactctgacctttcttataaaatgtaatgcaacaacatataaatcaactctgaatgtctgtttctagcatattttatatctcaggtcatcttccagcataggaacacacattttcctattaaagtgctcagattttcatttgcccagagctgcaatgagtgatttgtggttacaatttttttgcctacagtgcaaaatgaggtttccatttaggcatctcaaaagcccagcgatcactttaagtcattcctttagtagacagccgatggcttaattttcaaacttatatttttacagatttttttcagctaatttgctatttactgaatatttttttaaaacattgcacctcattcatggtatgataaaatcaaaattaaaataattatgctaacactcccaaaaaacataaaaacaggccaattttagtgaaagttacccattattcccaagcttagtgattgctttaaattttttacaatcatggtttgcgtcttcaatgaaatacttaaaaaaaaattattacttctggatgcagtggctcatgcctgcaatcccagtactttggtaggctgaggcaggacgatcacttgaagccaggagttcaagaccaggctgggcaacaaagcgagatcccattgctacaaaaaatttaaataccacccatacaaaaaagagtaaaaatcaaatggtttctcttcagtgttttatttcaaaatgtcctcattaaaaatattccataaccaaaagtaaaagtccagatgatacaaacgtaaatgtcaatcattttggtgaagttgacaatatggtggtacatttttggcagagcagtaccaccaattagacctgctgttgacactgagggtcaccctcattcccagaaatccatagtcaacagcttaggaggcttaggactgaagccttgcttcagtttggaaatctggtgagaaacctaccttctgcacgcaaagagccttggaccaggagcctcgtggtccagatggaagtgagaagcaacaccaggctgaagcacctggccatcgtgcctaccccttcagagccagggaaacacctcagatggccactggtgatatgagaggcagatgctcaataactagtccggatggagagttctggaactatgttgaggctcacactcactgctccacttcataaccgagacatccggatttccctgctttcaagcttctgacttgtcaaggtcactgggggaaatgaatgacgtcccttgaacgcccaggctgtactttgtggatggccttctggaaaatttagctaatgctgactcagaaaacacacaaatgaggaaggcagatagcacagtgtgaactgctaaaggttctcccaattcccatattccctgctgttcctcctcccccagcagctcagttctcacaccattcactgttactgcctgtggagtccatcgtttatgtactcctagaaacatctctgtccctaaaggagactgagcataggttgtgcctcttttcctcccgcaatcagtgatttttccacccagctgttcggccttgtgatctgcagggtatgatgctgaagctcatgaaagtaaatgtccacttaaatactgagtctagaaccttctgccttcctttgagtctccttttacacatttgaaatctctacaccactacaggtgattcctttttcaaagaaaccaggcacatataaacattcacatttacataacacaagtaggagggcaatttacaaaattaaacattttacactttccccaaggatttttaactttacaatagtaatcaccacaggggtcttttatgaaataactttctcttaataactcctttcatattctggtaggccagaattcaagtcagactccacctttgttgttcgatgaacatgaggtttatctgtgctgtgtaccagcagagtgtattctatgtttttccagccggattttcagtggtttttgcttcatggtaattatggagttctggcttgtaagcaatgtcttgggcaaaggtttatgagatttttccaaaatgaatgtcttttataggaaaagtatatggataacgaattcttttttatataagtggtactggtcataaagttagatatttgtgtgaaaaatatcaataacaaaaagagaatctgctctaaacaaatgcagggaacttctaaaagaccagggtaacagcccttacacatctccaataccgacctcatgatctgggtgagcacaagccccagtttctcagaaacatgcatgactctatcatcacagcaccagggaggcagacaggcagagtcctggcctcttcatgattattcttaaagcctaacaccatgcccgaaagagagctagctttctagcatttgttcacttattgcaaaaagaacgaaggaagacaggaaggggaagaatgaatcagggaaggcaaggctttgtgtcaaggaggagaatgagagtcacagtgatcaccagccatagaatttctggaataccaatgaagaggccttagaaaggtcgctgtgccagctttctattgctgtccaacaaattaccatagacttagcggcttaaacagtactcatttatcatttaacagcttctatatgtcagaggtctgagtgggctcagttgggtcctctgccctgggtctcacgaaactgacattaaggtgctggctgggctgggctcttacccagaggctctggggaagaatccacttcgaagcacatttgggttgttggcagaattcatttctttgaggttgtgggaatgaggtccctgtttccttgcagggtgtcagccagggaccattctcttctcctagagcccttccattttcaaagcagcaatgacacactgagtccttctcatacttctagtctctctttcacttctacagttagccagagaaagttctctgctcttttaagagacacggtcttgctctgttggctggagcgcagtggcgccatcgtgactcactgcagcatctacctcctgggctcaagcagagctctctactttttttttttttttttttttttttgagacagagtctcactctgttgcccaggctggagtgcagtggcgtgatctcagctcactgcaagctctgcctcctgggttcatgccattccttgcctcagcctcccgagtatctgggactacaggcgcccgccaccacacccagctaattttttgtatttttggtagaggcagggtttcactgtgttagccaggatggtctcgatctcctgacctcatgatccgcccgcctcagcctcccaaatgctgggattacaggcgtgagccaccgcgcccggcgagctgtctgcttttaagggctcatgggcccacctggataacctccctatcttaaggtcaactgtaccatctaatgtaacacaacaaagctccatacccctggagctcctattcaaaggctccagggattagggtgggacatctttggagggctattctagaaattctgccttccacagtcacttaaccttgatttgattctgatctgctttctgagagaaacttccacatccactgttttctgcggccctttgcatccctctgggagattcatttgcatataatcttgcttgtccacatttgaagtggatattagggagtatgccttccttgggaatagcacagcttttgcagtctgcttcctgccggcataagctaagatcccaaaagttttcttaattttaaaaaaattttatttttaatcaatacataattatacacatgtacattttgatgtttccatacaaacaagatgtagtgatcagatcaggctaattagcatatccatcatctgaaacatttatcctttgtgttgggggtgttcaatatcttctcttccagctatttgaaaatatgttattgttatctatagtcatcctatagtgccataaaacactataacttgttcctcctaattttatgtcctttaacaaatctgtcttttcctcctctcttccctttccagccactagtatcctctattctgttttttacttccatgagatcttttgttagcttccatgaattagaacatgtggtgttaactttctgttcatggcttattttacttcacataatgacctccatttccatctatgttgctgtgaatgccaggatttcattttttacggctgaatactattccgttgtgtatgtacaccatgttttctttatccactcatctgttgctggacacattttaataccatatcttggcgattgtgaatactgctgcaataaacatgagggtgcaggtatctctctgatatattttctttcctcctcaaagctgtttcctcacctgaacaatgaaaggggtttttagtcctggcttgtgtttctttgtaaattccctcacaaagttagatttctgcttccatgtgccaataatcataccccaaatcctttcccagtcataattctcaagaagtatttcctgtttctcagcaccatacccctcaaatttagtggtgaatacactaagttcatttgaactcacaaagggccacatccttaatctagcctttgccataaggctgagtcgatctgttcaactgagaaattttattggctcccactcaaagctctttttagtctgtctgggatttagaagtggtcaggttttctcacccttcaatctttcacatttctgaatactctatattctttttcatttttgctcccacatagccaattatttctcctgccataccttgccaaaggcagccaagagaagtttccataccccaacgctgattctttccaccacttataaataggctaaccatgagatgctttccaagttatcacaggtaagactttactatcttaccatctttctagcagttttgtttcttgccatgtaactggtaagctagaacctcatattttggaattttgctattaaagtacacaatttctggttcaaatgtatgcattagggtaggctaactgctataaacatcctggaatctctgtggcttaatatactaaaatcttatttcttattcatgtcacagttcaatactgggagtgctcattcaaagacccagcttccgtctagtggttctgccattttctcgggtctcagtgttctcatctgaatcctctggctttggtaggcagagaagggagtaaaaaaaggtgtgaagtattgggcaggagagtttatttttagggaactagatttggaaagtccacattcccctgcagctagctgtaagaaagacaaaaatagttcagctgtggaaatcaggttggttaaaaactcagcagactcaatcacagcaaactgtgttaattaaaaaaatcatagaccaggaagatacaggaaaccaggatcaggaatggggaagggaagaggaggaactgatccagcccctgtgaggtagcccatagtataacgaccaagggttggggacctctgacttggttctggaatgcactaatatatccaaaggcatctaattctgggttggggtaagactgtaattcaactccataaaatgaggaggcatttggctgctgccagaggtttggaaatgtgcttttattttcaaactcaggtatgtgacactctacagttcaatgctagcacacctgtgtgaggcttaacaacatgaggaactgatagccagtgatacacaaatccagcacttcctctccatttactctgtcaggctgtatatggggagcaacacatatggctttgtggcagccagaaagtgaaggtctttttaggaggtgacatcaacaatgacacaaacacatcactctgcaactgaaggcagggaaccagactcctagggctaagcagagatgtcagacttcagaggcatttgggggactcttcagatccacatcctcactgaaaatccagggcctgtttctctccagttcactaccgcttgggcagcagctcccactgcttcaggctggtctttgctttccagaaaagatggactcatgagcactttttcagcccctgtatatatggctattcttatgctcccttttggagatgtccttttcctcgacctcccttgcttacaaatggaatagggtgggagagggcctgtgcctggaagtactcttgcaggcttttctgtggggcagctggaggtgcaggagctctccataactgccttcctggcctttgactcatccagaaacaaaggtaggaaacttgtgaccaagtgaacaatggggccagctgagcctggccctgctttaagggaggcagagattgaacattccccacctggagttctgcttccacggccactctctagaactctatttgcatcctgtctttggctctgagggcctcatgtagctaaagctccttcagttgtatccagaccccctggaagaggccgggcaaatcatccacttctgcccccagagtccctctgccctgctctgtaactctttaccttaatggcacatccttgatcaaccctggcttgggcctcagtcattttctagctactgtaaaggatgcccccttcaataaacatgctattttaaagtggggcatgcttggggtggggggtctctctgaaggagtgactgcattgagcccagtccttgagcttggcaatggtgttgctagtctggtctcattcctgctctctcacagagtagactgaaaaacagaataagctgaggttaagaaagatgttgctttttgcattgtgatggtgctggtactgagaagcatgcagcatgtcagctgtccccaggctgctctccaccaccttaaatgtttgcttgttcttttgagcaacatttaatgacaccctcccaagcgtcagccaccatgctaggcacttacccaagagatgggtaagacatggttcttgtctttgaggaaaaatgctaggggagatggatacataaataggccatggtatactataggtaaaggtcaataataataatgtttaaaacgtgccagaaagcacagaggagtgtgtgacctattatgttgtgtctggtgaggagtatggaaggaaggtcatcaaagctggtatggaggggataatttttgcactcggtcgagaagagtgacctgaagaaaagagaagaacagctggaaaaaaaactagtgagtggaggtccagcactatgagagaaactgtttagttggggagccagagatggagtagctgatgggccacttgggggaatgagactgaaatgtgaggcttccagctaggagaccatcagaagagtcaaggagagcacagctctggagccagcctaccctggggttgagctccagccccatgatttactaccggggtgtccttgtcaagttacttgttctttttgtgcttcagtttccttatttgaaaatgggaagggtaatatccacttcgtatttttttttctttttcttcaggacttaaatgaattcatacctatgtaatactgagaacagtgcttggctcatagtaagtcgtatatgagttttagcaatgaaagcaaacaatatcaataacaaaacaaaaatgcaaaacaatgacaacaaaacccacatggaaatcaaacctctacaaaactgatgaaggcagtggctgtaaaagtggggagagaagtcaaaatggagaggggatgtgctccttcagtgttgtgctaaataactggggatgctctgaaacacccctaattatactggggttggaaaccccatttgaactgaagcactgaggtgcaagtttactcttgcatgtggtcacacacagagtaagagactgaagcagaaagcacatcttctctcctcattcacctgtgaggtgggttaactgttttcaaagagagaatagggaatagattgtgctgtacagcagctcagagttggcatttgaaatggagactagtaagtctgccattgaagccatgagttttctgtgtttttaaaacatcttcaatccatgtggacagctcattgaacaggtgcctggtgactgccccacactggtgaaaatctgtgggttggcttggcatgcatcttatttatccagaggtacacacccagagcacacttttgaagggttgttggctctgtgcacaggcatgttgtgtgtgtgtacacaacagtatgtgtgtatgtgtggacagatgcgtatataataattcatatcttcccatttcaagcactgagctaaattcagcctatacttttttttttttttctgagaagcctttcctacttctgtaaaaagaaactctcattccaaaggaaagaatgggaggctgaagttattgaaaatgagatgggaaatgggaagatagtcactttgcaactccaaattccaggtctgatgcttagggtgttagtcattaagcaaattcttcctgataaccaattacagagaggaaaaaagagagtaagttttttactgccccctacctcctcctcccccgtgccccgctccttacccccaaccaccagtgaaggtgttttagttctccccagccacctgagctaggggcaggagaccttcccttccaatagagttccttggtgaaggtgacttcttcatccactggatgctttcccagggcagttttgttgatcctccaagaacatcaagtcactgtgtatgaatagctcccacagaagtgccgagtgttaaaagaacccttcctcatgacctgatgggatgggcggcagtgtgtccacacttgggcctgacgttatacttggggaaagggtggtagtctgagtgtctcagagcagggcactggctaggtgtgaggtttcctactgctctgtaggctgctcatgctggagtcctgagctccaccaggagtccctctgggctgccgagcaagtggatcttccaaggggcccatcagcctgctctgcacaagagttataggaattgtagagccccagcacaacagtcaagaccagcatcactgcagccatcatccagatcacttgccagtgctgacacagtttgggatacatgacttgtaagaaatggaccaattcttcaagtttgctgtcaatgaaaaaaaatatgcagaggctttagtatactgggcacacatatgatacacagacccacagttctctctgcggatagcttccatgctgtcttgagcaatagttctcaaacttagctgtgcctagattgggttggcagcaattgttcaaaataccccaagcatactaaatgagaatatccaaagttatggtccaggaatcattggctaaattttcccaggtgattttgattccaccagtccacagccttgaagttgagagctacttatctagatcattctacttaattgtttgatcatccatccatacatgccctcatctattcacggggtgattactgatatctgcactctcccaagcccgggggtacaggattggttggccatgcatctttttagcacctagctgcattaatgatcagttccaagctctaacctgtgccttgcctcagatgcgtaattcattgttctcagttccacatctaactgtgtccagagtagaaggactgtgctaaactctaagcagcttgatatccagtgataaatgacaagggactagatcaacctcaagagttcacttcaaaccatccaagagcaggcagaagattagaagcctctagcaatgtctgggtggtttgttcatgatgttatctcaacctcattaatatttattctctaatttctccctcttcctcctcttcttccttcactctctccacacttctttctctatccctttcatctctctcttcctctccatttttgccccttttccctcttgattccttcccaactgtctttcattttgtcctctctctctctctgtggtgtggtaaaaagacaccgggcagatggcctgctttgacaagttcattctagagctctctgaagaagccctgagccccttcattaagccaggatttcctgatgtttttaacctctaacccaatttaaaaaataatatgaaaaatgagaatactgaggattcctgaaccaaggaggtggggaaagtgatagaagtgctttctgaagatcctgaggctcatacacacacagcaatgaccaagccattggctgagaagcggagagctcaaattttgaggtagcagaaaatgcatgactaacaaaggattgacagactcaataaatgccctccttagaaagggaccagatgctcagaatgcctgccttggatgctagggccacagagaacattgacaggtttccgttccatgcgggaaccccatcagatcatttcagtcacaattaaggaaagcacgaaagtgaacacattcgctgatttgaaaatcattgactattttcacaactgttgggaaggcagggtttagaagtagaaggttattttctctcagccctttgtagattctctagattctatttagacagagttggatgctaaaatggagcctttggggctgtatttccatcctccaaaacaaggtgccagagtggcttctccctactctaaccccactcttaagtgtggctctggaggaagagaccaagatctgtctgtgtgaccttagctggtcacccatgcctggcctataaaagagtttagaaatagattagaaatagaatttctttagaagtcaatttttggttataataagtaaacttctgtttcctgagagttattggaaaagtaaaggaacctaaatgtcctcttaaccccatagaactggtttgaacagccgttaggagaaaagacaaaagttttatcttgtcccttatgagtctcacttgttcaatgtcagaagactgtgctttctgttttaatatggttaaaatattggggtttacccaaagtttatttaaactgatcctcaagagagcaatatttgtaacataattgttatatataacagatacgtgactcagacaaaaatactttaatgtgtgatgttgaatctcttaagcgatcagcagctgggctgaacccagtgttttaaaaatgcaataagtaggacatggaactcttaataacctcaaaccttgcttgttagtgaggcaccaacatttcagggaagaaatcatgtttgagagcaggtgcatgataaatgttacaggcaccattgccactcactgatgaccaggagctggacagaaaggaaccaagctaagccttacttcccctggggtttcatgaaatgggagggagctgacaattgcctgagattgaattagctagataagacattgagccccttgctttgcaaaccagactgtttatattccatgtactctctctctgtttatttctcttttgttctttctcagtgtttggaagtgttagaagttccagtctgtctctgctgtattcacgggtgccagaggaaaggctttttgtctagggctttgcttgactgcattaaaggggaggaaggcaatgtggtggactgagaaatatcagcagagaaccctcaggagggagatgaggcctaaggagaacaggatctggttgcttggagtagggattgcactttaattgttaaacttggaggttctttcactggggagacagtgtgtgatttgttttcagtggagaagcatttctccagttctcctaacggctcttcccctgaacaatggggtcgaccagcatgggctgagacctctgactttagttgaattctccaccaactgggctctattgatagctcctgtgtgcctatccattttgcttctaatcttcacttcattacctatttgttgcatgcatgtggtttccagagttttccagcaatgaggcacagatacatacccagattagataatatttcagcagctgattagatattttgtctggagctgccctggaccccaagatatcccaggggtctaaaaatagattttggtgaaggttttccaaggtggctattactacattttaaaaaatcaaaattcaagacttgtggtttaactatactaatagagacaacatagctgaatatatgaaattgggctgtcctgaaaatccagaatgttggcatggttattatatctgtggggtagagtaacacctcatctatgggtgctagtttatcctatccctaagcgtgaacttctaggggataattcaggccaggtggggctgagacctcattcctataatacttcattgcatggagtgccctggaactaaattaggtcatttctacgattctgcatcctaaaggccaggcaggaaccacaagtgggacaagatacaggtctatattctctttatctacatgttatattctccttccccaacttaggggaaagtacctttgaaataggaagtattttaaaagaaaaccccaagtatttccaacctaaagtgaagaccaagcttgattggtcagcatggtaggcacctgctggagactcacctttgccactgagctgagtttgccctctattccgtgtgtcctccctgtccctgttcttgtaagaaactcactccagggcttcgagtcaactctctttgtcttgggcctcttcatggggatggctacccataatttcatctgggaaatgagctaaccatggctgggctgggagggactccattcagggcccttcgcccttccttagctcctggagctcttgattgccatcctcccttcccatgactgcccctgacctctcaagctcttgcaaacttctcattgctagctatcttggctctttgggatttcctctacctccttcccaacatgtgtgccctcttggtttcttgggctactcactggggccccagattcactgctgccctggactggcatttccagggattttgtgcatttaaattagatgaattgtaacccccatttcagcaacggcaaggactccaaacacaggcttcccacctgcttcttgggcccttttcctcttcctcagtttcttctacctcttcaggttcctcaggactctcactcttctgttcttcctcctcctccttcaggtcttgaagttctttggtcttctttagaccttcttggaatctggggggcaaaaaggaacagttgagtctggaaagggcagatgcagtgcatcctttcctgagttcctaggggaggggacttgagcagcacctccaataattatgtgcttcctatggttccacaaaacaggaaaaagctgggaagctccactgaatcctaaggcagctcacgccagtaccatttcccctcactcctcagtcatccttcctgtttatgtgaaagtgtgacaaaactgacagggaaaaaatgtggtgcagggtctcctgactgggttcttaacccacaaaacattccgtagggctaagattgtatttgttctccatgtgaccgtggagcttcagcctctcatctgtaaaagagagagggtgacactcatttcacagggcgttggaatgatttttgcaagtgccaggcacatggcttgatctagagaggtactcagtaaatgtttacgaaaccaatgaaggagttcatgcccataaattccaaggatagagcacagtggtgggtgagaaaggcacgctttcaaagagaaacccttgtggtttttctcccccagggtcaatattaccccaaacatactctgttcacttgtcctatgctgagtgtctaacactagcagtttggctgggcaaacccaccactgaagcccatgggttctgtgccagtgggaagctatgtcttcctcatgagctatggagacaggagacgcatagggcaccatacatggttggaggtgattctctaccttgaggcttggtacctgctcaggacttggtctctccagtgctgacaactggccatgggtgctattgaagctcaaatggaggaggaggcagttcgaagttgaagagactccatttataggaggaaggagtgaccaaagcagttctagggagcagagctgcagctgctcctgggcactgctggcagcaacatgactgctttgagcacgtgtcaggaagcctcaggcaccaccaagaggaacccatccaggacccctgatttccagactattctgagcggtggcattctggtggctctctgcctaaaaagagggcagtcttgttattgtctaaccacaccctctgaccctgcttcctcctgtccttcctgtggaacagtcttgctctttcctatgtagttccttcctgtggcaaggaggtcctgcggccactggttacttccctaaagcctctaagaaacaagaaagacccatgggaaggcatcttctgagaactgccaggtgcccttggggtggctgaggtctgactcaccccttgctgtaggcttcttcctccatcctggccttggtctcctgactaagctcctccaggcagctcagggtcagcgcaggagcagaggcttcacaatctgggtccccatttgtctttccactagtgagaagagggaagtacagggcatcatttcagaaaaaggtggaggcctaaaaacaaaaccatgtttttggcccgattcctgattaggagtgaggaaactcaggctttttcagtaactttcagattttttcccaatccttctaccctgagacaagattttataaaggtcctagtccatgaattttccccagcccattaaatacctcaccagctccccttctcctcatgctcccaaactggcgtttattcttattccaggagatgctgtaatgggtgatctacagcgctgagatgaggaaaatgggggcagaccagcacgtttaaggtcattccattcctgttgtctatctttcacctgaagacccccactcatcttttcaaatatccactcagcatgactaagccacaggcacattgtaatgtgctgggggcacattagaaaataaagaaatggtttttaccaacatggaacttagcagaaggaaaagccccaaaaaaggaaagaaaaaatatgtgattaattacaaataataacttttatgaaagaaattctgtacagtgacagaaaataacaaggagagaatgtgtttagagtgaatagttagaaaaggcctctctgaggtgctgaagttgaagcacaggcctgaaggatgagaagtcagatgtattaatagcagaggagagggttgggtgtggtggctcatgcttgtaatcccagcactttgggaggccaaggcgggcggatcacctgagatcaggagttcgagaccagcctggccaacatggtgaaaccccatctctactaaaaatacaaaaattagccaggtgtggtggcacacacctgtaatcccaggtactcaggaggctgaggcaagagaatcgcttgagcctggaggcagaggttgcagtgagctgagatcgcaccactgcactccagcctggatgacaaagcaaaactcagtaaaaaagcagaggagagatcattccaggaagagaatgcgggttatgtaaagactctgagacacaaaaggtgctgagttgtttgagaacttaaaaagaggcagtgtggcaggagttaacttttggacaagagacatttgcaatgcctgtgaggtatccaaagggagatgtcaagtagacagttgaattcaccaaagtgagtcagggaagttttagctggagatattcatttggtgtcatcagaacataaatgttatttaaagccacggggatagacaagattgcttagggagataatatgaagaaagacaagaggaggacccaggaccaagtcatgaggaactccacacttgtctcaggtggaaaagaaggcatcttcagagaaggctgagaagtagcagccagagaggtaagaggaaacctaggagcaggtggagtcttgggagccaggagacaagagctcatcaaggcggaagagtaaacagtgccacacacttctgagtttgaagcgtgcagacaaggtgactattagatttgataatacagaggtcaacaggagcctctgtgtaatgttgggagccaagcacaggtttaaagtaaagaaggggaggttggaaaggggaagccacagacacagcaattcgagtaggaaggagagtagaggggtgtgttggagggagtgtgcagctgaagtaggtcaagggaggatgcacatttgaatgtaggtagaaatgatccagtagaggatgagagaaagggatgcccgaaggaactcagtctttgcaaaaggaaatagggacagaccttggaaaactagagaatctctccttgtttgtaacaaaggtaagatgatgatgaagttgttgggctggagatctggtgaaggaaagtgagagggctcctatgggaatgtagcttaggtattctctataaagtggaaggcaaggtcatctgctgagagtgagaggtagaggggtctaggaaggtctgtggagagaggaggggtgtaaaagagttatatgagaaagaaggaaaacagacatactagaacatcttggtaagatggctgggaggtgctgggagatcattgcaggtatgggatcacaagtttaaaggaagtatccagatggctatgctttccctagaaatcctgcagcccaccttcatgtcctgattcccaatgggagcaatgtcgtcatggaggagtcctccaacaaggcaacactgtgagcagagctttccagccaggactctgaaagatcacagctgccaccctccctgaactctcagacagggtttatgagtgagccttgtatcttctcctcattcttggcatcagtttcccatctcttagttttcctcagaccttttaaaatttacatttagtcaggctggaaaccacaacccattgtgaacaagaaagataacgctctaaaaataccagctgttcataacatttctccttttgcaaattacattatccactcccttccatgtgaccttggcctaatgtgcagtttcctatttatccaaacgactggagcaagaggagaaaaacatagctacagccaagggcagggaaagtaattctttcatgaaatatatatatatatatatatatatatatatatatatatgaaatgagatattggtatcagacttttgatttatatacaactgtcagccttagaggttccttaatgttaagcatgcgtgaaggaggacagtgtagtataaaggaaaagaactcgcctgaggcaaacttggattcaaataccagctccaaaacatgcaaattatttaatcttcctgaacttcagattcctcaactgtacaatggggatagtaatacatacctgatggtggaggtgtaagaattaatgaagaaatgtcaataaactttctggaatatggcactcaacaaattatatctgctattattattgttatatagtaaatgtattggtacattttgggagcaatctgagctacctccaaatatgactcataaaaaatccaggcaattatttatatcatcaagggagagcttgttatatattactgagacacttcagagtcagaggaaccctaaatgtgaactaatttaaggtatggtaaattaacattacattttcataaaatggctttaggaactttctcaggtgcatgtctattgtgtgtcatcacacattatgcaccttagaattttgcagataagtgactgtaaacaaagctctcattgtccttgggtcactgatctctagagaggaaaacttttccctagcagggccaggaagcccatttcatcgactcttttacatgcagatcttctgttcatttcagctcccctatagggctctcatatacattctctcacttgatctttccaatgataagaagagctaaacattaacttatatgtatcaggctgtggtctaacatctcatttaaggctcacaaatgacccaagaaggtattagtgttctctgtttgacagatgaggaaaccaaggctcaaaaagtaggctgaggcatgagaatcgcatttcaagtgatttcatatctgtcaaacagagaacagtaataccttcttgggtcatttgtgagccttaaatgagatgttagaacagagcctgataagtaagttaacttttagctcttcttatcattggaaagatcaagtgagagaatgtgtatgatctcgggaccagcccaagatcatacaaccagtgtgtggtagagctcaaattttaccctgtgcagtctgatatgtgcccattcttctgactgcactatctgccacctaggtggggtattatcccatttcacagataagaaacccaagctcaggttgattaagtgacttgcctaaattcacgttattggtgctgggactctcaccttggtcttctacctgtgtgtcaagatggactttccagccctccatgaacccccgcttttctttcaatagaagccttccatgaacccccacctttctttcaatagaagccctccatgaacccccacctttctttcaatagaagccctccatgaatccccctgcctttctttcaacagaagtctcttcctttcactctgctgagtgaagcccttcctgccctcaggctggaccatggcttccatgctgcccctcttttcaaggctgcttgtctacagtgtaagtggctgggagggcctttgtttactgtgtgtgtgtgtggagggtgggtaggggggagtggaggggttgtgggtagggtggcaagtgggggaaacacaacatgtaaaatgtttgctgttctctcctgacctctaaactgagcttgtagtttcctaaatatcttctctaactatctggaagtttctctctaagcatctttaagactaagctcaaatgccttctcctctgtgaaacctttgctggtgttctcccctcccccacaccctctggttaaagttgatctctcctttttttttttttttccttgagacagggtcccgctctgtcactcaggctggagtgcagtggcatgatctgggcacactgcaacctccacctcccaggttcaagcgattctcctgcctcagcctcccaagtagctgagattacaggcgtgcaccatcacgcctggctaatatttgcatttttagtagaaatggggtttcaccatgttggccaggctggtctcgaactcctggcctcaagtgatccacctgcctcggcctcccaaagtgctggggttacaggcatgagccaccgcacctggccctctctctccctttatgctgccaccgcacctctgtgacagcatgactcacagggaggcattgatgtatgttttagatacctgcatatgactgtcatcacaggaagaaggactgtgtttgggtcagaatagtgcctggcatacagtaggtgcctttaagtgcctgtcaagttgcatcggtttcactatgacttatccagtccctactaggaatgttgtaaaaggcacaagtcctctctgtaaatggttatttcctgagaacccagtgtttgggttggactaaacgaatctgtaatcatggctataaactggagctgagcacagcctgtgcccaccctagggatttctggcccgaaggctcatggatcttggcatctgtcccctgcctgaaatcctatgtgctttctttctgggatgattcatgaaaatgaggctcattattctcacacgtgcaccaggtcaaaaatgtttgtcattgtgctcagctctcagtaatgtgaagaactatttagtcaaaatatatttttggacaggcaggtatattagattcaacttttcccacatggtaaacaatatttgaaagtggctactatcctttgtgatcggcatatcttcttgggctcagcaatatttccaagtcacccccactgccatggttccctctgacaagcccagcccagggaacccaagcttccttactccgtgttactcagttctagatacctggggtccgccacaagtttattggggtgggtggcgggagggaggaattcactccaagataccatcagcaaaggggagttgcttactgtacaaatttagtgtcctgtgaaatctttaaggaatttaccctgggtgcttcaagagtatagaaacatggttatttttagagattcagagttaaaattgctctgtgatacattaacataataacccctttttgacactaaccctgtgcatcatctacatcctggttttgctgatcgctctgtgaacggttccacacacaccctgtctctcaccccgactctgttctccactccatgcccaaccggtcaccatgctctttcaaaaatagctcttaaattcatcctcttctctatggtcacactgaacttcgttttgttcttccagttgggcggtctattaaaagggtaagggcatgtgctctgctatctaccagctgtgtaacctcaggcaagtgacgatttctctgagcttcagtttcctcatctataaaacagagatattaatagtacacctacctcatggaattactgtgaggattaactgagattattaatacaaagcaattagcaaagcacttggcatacagcgaggtgcagcaaatagttaacagtaattaccattgtcatcagtgcagtagttaacagtaattaccattgtcatcagtgcagtaaatagttaacagtaattaccattgtcatcagtgctgtaaatagtcaacagtaattaccattgtcatcgttatcattatcatcattccttgaatactccatactttgtcacatggacaaagcctggaatgttgttaacctcctgttcacctagttgattatgtaccctttagatttttactttaaaagtaagttcctagagggaaacttttttttttttgttttttgagacagggtctggttctgtcgctcaggctccaggctgcagtgcagtggtgcaatctcagctcactgaaacttctcccggctggggtcaagccatcctcccacctcagcctcctgagtagctgggactacaggtggacgccaccacgcctggctaatttttatattttttgtagagatggggctttcgttatattgcccaggctggtcttcaactcttgagctcaagtcatccacttgccttggcctcccaaagtgctggggttacaggcgtgagccactgcccagccaaggggaatcattttctaagctctctcttccccccacttccccagttcccccaaccttacaccaaaatcaggttaggtgctcattttctgtgcatcattcccttagcaacctacacttccttacgatcccacccatcatgttgtattataataggctgcttcccatctgtctttcccgctagactgcaagctccttgagtacattctatgtgcctggcccttggtgattaattgctgaaggaatgaaagaacaaaagactacaattacatagccatttctacttgtggaactgctcttgagctttgttttctcttcatcttcaggactaactttaaatatcactctccacccatatgtttaagtctacaggtttctaggcccttggtgagtgaagagcagttcattacgaaatgacctccaagaacaaggctcagcattctctgaaatctcatgaagcagtgtaaccagctctcaagtatcttcctgtgaactagccacagggtatttgatcttatcctttgcttagccagtgcccttcctgctttgtcactgtatgcttaggaaaggtgaaatcattttaacacaaagctgaatacaacagtctccaaagcaatgtatattaaactataacacattatttctctttcacgatatggatagggcagttagaattgactgtatttgtgtataggacagaagatacgaattcacttttactcatatattgtctcattgttagtctgttgggaatcaagtaaattttccactttatatttatttatttatttatttgtatttttagtagagacagggtttcaccatcttggccaggcggtcttgaactcctgacctcatgaaccacccgcctcagcctcccaaactgctgggatcacaggtgtgagccaccgtgcctggccatgtttccagttttaaatggaaatcacttaacatctttgagaaatccagaaggggaagctgttgttcatcctgaacccctcttcctctaaagatgccctcacctctttgcaaccattcttacatgggtatattcccaactggcgagtcagccccagtgtgcttgacttgccttaatccccactctgtccatatctctccaggttctataaagcactggaaaggtgatgccactattgatcgtcacccattgacactcctaatttggggctgctgcttattgtctccaattttgtacctcagtttcccttaccaaggataattcatgttttcatgatccccactgccttggacagaagtgctcaactggcctggcataagttctacagagttcaggccctctctgtcatgattaagagtctgttgaagagatcttctgccttgagtggctctgcaggcctagagttgggaaaggggctagagttgagggttctctgaagtagggatctgtgcacccaaagggaaggttggcagggagaattttagtgggtttctcagtcagagcatgaggtgaccatttctggagagattcagagaccctggatgaggtactatgactctagggacttggtaagtttctgtaaactcggttacttccatgtggtggtggttgtgttgcctcttgacaatttccctgtagtgatcaagaaaagacagagagagagaccccaagagaccctctataacacgaaggacctgtgagcttatgggggtgaggtggcaaagagacgaaatgctgggcaaacttcaagactaacaaatcactgggtgataagctggtggctatacagaatgacagatgtaggaggcaggctgagtctggagatgggagcttgtctgtactgaaaagggtcccaacatacaggttccctgccagatagcaaaacttttctaacagcaaagaaaaacaaaggactaaagctgtcttgaggcaaggaagaaggaagaataaggtatatgttttaccaagtgagaaaagacacaaggggaaaattctgagaggcagcaggtgtgatccagatgtttttcagcaagcaaatgaaagaatttgaaaagtaagctataaaatcctctgagtgcatagaaacagcctgccttactctggctgaggatgaaaagatctgcaaattgcatagatgcctagaaaatcacagaaactgctggctgctaatccaatatgcattttccttcctacttcctaacagcaacatgattctgttcaggaatttactcttcttcatggagtcattttgctttatgggaagctgaccctctcaccaaccccagggaatagtttaatcccataatgacaatccctttcccaaagtgattcttttagaaagggacttccttccagatttgtcaatgagataatagagaagactggtgaaaggcttctgggtttattcctaagaaaggaacatggcaagaaacagtccctttcttcctctaggtattgtcctgtctggaggggatcccaggaactaccagccatttgccacaatcctgatgatgaagttaacatacaatgtggccagaggcaaggaagttgtagactcgctgagctagagccctgctgtgccataccaggagcagctctacctctggacttaattaagtcccattgagttggggctttattttgtctgtagcccaaggaatcccaattggcagagaaggctccagccttctctgggctctctaagattgggtacacttggcctcactcagggcatcttcctggttcaagaattttgcaaacaggttctgaaatctttgtgggtttcagactcccattcatttcccttaaaacttaatttgctttccactgcattttggggataaaaatgggaggaaggaaagtaaaatggggaaaatttcctgagagatccctgaagccaagaggaaaatcgacaaacttacttttccaaaagtgcaggcagtgctgaagtgacaggtaggctgcctttcccattgggtgattccgactgagtgaaaaacagaagacagagaattgaggatgcgctatggaaggaagaagccagagctgctggatttctgatgatgctgggagcggggctgctgcttctcctctttcctccatgcccccactttccaatcttcatctgagcccaggacttggccctttccctcaggccttccctgtcctcctttcctctagggcacatgcagcttcctccttttccttcacctctgctaagtttccttaagtgaagaggaaagtttacatcttgaggctccattctggagaggagccatcagtttttctctgtcccgtttagcaactgtgactgaacaccagtgggcctcctacaaatgcaggtctcaggctccttacaatagattcacacaagcccatcactgtccctagagacatagctccaggtacaattctcaggagatgcaaatcactactgaaagctcaaaccatcagaaatttctttacaatacgttccccaggatttccaggttgtgttgttgcaatggatttggtttaagtaatggttctcaatgttggctgcacattagaatcacctgggggaggttttaaaaaagtatcgatccactccagaatcttggtgtggggcctgggggaataatggtttaaaagtaccctgtgtggtttttaatctatggccctgattgccaacccctagtctaaaggaatatatatttggaaaataaatttatgcttttaggcaaagtatgggaaatagatctgttaaaatacactaaccagtcctctccaacattcttaaacatttttttcaggttgttttattttagtgggtaatttgggaatttaggttgatttcatagacgactgaaatgcttgaggcaggaagcagtgaataccactcattggtattacatagagcttgaatttccagttgcttacacaatcagattgtttccttatagggtagtgctagtcataggcaggggatagagaaaccactgaagaaagaattagagagaattagccagatgcacaaaggcctgggatacagaaaatattttgttatatccaaacgtctttgtctaaaagaaatggaaatgtatttttcctgattattaccaatacattcttattatagaaatataaaaaggcatcaggaagaaaataaaaatgaactattttaccattgcctagagataaccattattagctgtttcacatatcttctaccagaaatttctatgtctacacacagaaacacactcttttaaaaagtacaaaacagaattatactgtttatacactaggttttgtatattctattttacttgcttttgattcataataaattatggataattctacagaaaccccttataggaatatccatttgcttaaccaatctcttattagtgaacatggagttgtttcccacttttcattattatgaacaatgctacaatgaactgaggcaggagaacaatgggttgaagaactcaggctgtggaatcagagaacctagggttcaaagctgttctaccacctatcacacattacaaacttcagctacttaagcccactgcagagtagaaaaaaattgtaaccaccttggcagattgtggtgtaagcacaaaaagagttatcatttgcaaagaacgctgagctgccaacaccatgctgagggcagtgggacttcccagagtagtagaatacatgcagcctggtgtatattgagtttttgagcctatcactcagattctattctggaaatttcctctccttgttgaccctgcccccatttggtcaccctccctgccctaggactgagtacgaaggaaaggttattctactattctgtgctgggaggcagacatcgtcatacttaccaaggctggtaaggagggaatggatgatgagctgggagtttggccaggcagattcagggcattaaacttaggaaccacagcaacgctgaccctccggcgaggcatattctgcaggaagagaagtgaccaggctcactgtcttggaggtagcaatagccatagttcagaagggctgggaaaaagcctcctcatttctaatgctgtaatggcattcactggatattttggttttgcagtagcaatgatagaattggtgtggagagagtggccaaagttgacccaaattttctgttgttggtgagtgaacgctcaatctgttctattttagcttatgagatcttggagatacagaatggaaatgaccccacagtctctgggtaacaccctggagactgtattcaagctgcctgtagcaatatgaaggcttatgatcacttcatgttcatttaagggatgtatacatagttaaggaaaccatgagcaagaaaggtaagatgtcagaggctaaacttgagagtgtggaaagccgaatagaaactctgttcagagattctctggcatccatggatcccagaatgaatgattgtttgggtgaccatggaaacttctgtcatactccttccaggagccctggtattccttgaacatgcatacctttcccagcgtgagggacatggaccgtgccgtgcgagggaccccatcttctgcagcaggagggagcagagaagagaacacaggtaagtttcaggctaggcaccagcaggaaacagaaactaggctatcgtatccatgggccagaactggccctcaagggatagcccaagggtctgggtgttggggacactgagtttggcacttcatcctttgagatggggctgcagagtgggggctttttttggacaaaacctttatcctaactccccttctcactataggaagccccagtcttggacctctgatctttatctgaccccactaaacacgctctgcataacaccctagatagtgtatgaaaactactcagcaacacgaagacttattgggttatttcatgctcgttcaaggatgtacagtcagagaaactatgagcaaggaaggtgtggtgccagtaaataatgaaaacttgctaacagaagtagtttcaatatgttacctaccaaatgactcagagcaaaggaagctaccaccccaggattttcttctccttactacatacattaagtgatataactcacgtaatatgtttagcttcatacctggataatcctaccaccaggaaacacctgagtatgtgcagagaaaggtatttgctagttcaattcaatttgattcagtttaaccaatatcatttagcctgcatatctctctctttcatatccatatatttttggtgagtctcttgaaaagcacatagccgtatgtgttttttcaaaaaaaaatttttttttcttttgagacagtctcactctgtcacgtaggctggagtgcagtggcacgatcttggttcactgcaacctccggctcctgggttcatgtgattctcgtgcctcagcctcccaagtagctgggattacagatgtgtgccaccacacctggttaatttttttatttttagtagaaacagggtttcgccatgttggccaggctggtctccaactcctgagcttaaagtatctacccgcctcggccgcccaaggtgctagaattacaggcatgaaccaccacacctggcctgtttttttcataatctaatctgagattctctattaaccaatagatttatactagttatagttcttgtgattaatatatttgtatttatttctaccatgtaattttatattttctatttattttgttttattcattgactttttctacccctcctcccacctgacacttttgtttggaaattatacattctatttttaacctttagcatgtcctcttaacttttgaacatactgactttaaatttaaaattaaacaagctctctattcttttcttgaataaatcttaaaataataaccctccctcttaattatattgctttccaggatttttatttcaccttgtgtttgtattcttaaattattcattatgtttgttgatttctacagagagtgcttatttagatttacccacgtttacaaatgtctttgttgactattctttcttgtatcctacttgtttcttttgagctcaattttttttaacttttattttaggttcagggtacatgtgcaggtgcattacataaacttgtcatgaagatttgttgtacagattatttcgtcacccaggtattaagcctagtagacagcattgattttttctgctcctctccctcctcctactttccaccctcaagtaggccttggtacctgttgttcccttgtttatggccatatgtactcaatgtctagctcccacttcttagtgagaacatgcagtatttggttttctcttcctgtgttagtttgctaaggataaggacctccagccccacgcatgttcctgcaaaagaggtgatctcattcttttttatggctgcatagtattccatggtgtatatgtaccacatttttctttatccaatatgtcattgatgagcatttaggttgattccatgtctttgctattgtgaaaagtgctgcaatgaacatttgtgagcatgtgtttgagttcaatttcaatcttccttaggtacatcctctagttgttctttcagcgagggtctatgagaggtaaactttctcaattgtctccaaatagtctttaccaagccctcaatcttgcatggtatcttagccatctgtgttatctctagattgacagttattttctcttagttcttttaagaaattattccattggcttcttctattattgccattgagaattgtcattcctttgtaagtaatcttctctttgatgacttttaagatcttccctttgtctttactgttctgcagtttctctttggtgtgtttttatttttcctgcttggaattcacgtattttctgaatccaatgattgatgactttccttagttctagaaaatccttagccattctttcttggcatattttctctccttggttttccccttaaggatggcctaataaatgtatttgggactttctcattctgcattctatatcccatatctcaatgcttctttcataattttaatcaatttatttctctgaactatacattgggtaacttcctcaaacctatcttcaagttaactaatttttcttcaactgtgcccaatttgatttaaatgttataatcaatcaggataagctaggttatactagtttaatagcatagtaataataagcaactccaaagtattagtggctgataacaaggaagatgtgatttgcttatgctacatgctcatttacttccaagtctgcagcaagcttggttctctgtttcctcactctggactcagcctaatactggccttctactattctggagcaatgatggttatcatgttaggaggaagaaacagggcaaactgcattctagttcttagaggcctaggttcagatgtgacatgtccttctactcatatttcattcaccaaagcaaatcccatggccttgccttgtgacttcaaggggatgggtaaatgtgcccagaagaaggagatctggaataatgaagaatagcctcaaatatagtaactaccacatctaaactcttgagtttttgatttctgtgactttattcctcattttgaggagttctattttattcttctttgataactgtattcttttactctgtttttgatccattattttatgtctccaataatttttgtttaagttagagacggtctcactctgtcatccagaatgaagtgcagtggcatgatcacagctcactgaagccttgacttcctgggctcaagcgatcctcccaccttagcctcctgataagctagaactacaggtgcccaccaccacatctgactaattgctttttatttttattttttgtggagatagggtctcactttgttgcccaggctggtctcactttgttgcccaggctggtctcaacctcctggcctcaagcgatcctttcaccttggcctcccaaagtgttaggattacagacgtgagccactgtacccagctacctgtaacaattttaagcttatcttaaaaaaattgtcagatcattttattttccgaggttcttaggatataatcctattgttttgtgtaactgatgacttttgttcatgatgaattgttttcttgtgtattttataattttaagttgtgaagtcatcttcagtgaggctttattagaggaatcctgtgtgtccagatgcagggtctgtctctccagagtacttttctgcttatttctaacatatcttagaagcaccatcttgctgttcttttcaaatcctctgcatattgcatcatcactgctgtcactttgtgagcacgtactttccctatgaggaaggagaaagtgttttttcctactacagtccagggtgaaacaaatttccttgtttctctgctggttggtgattattatttttccttatccaaattccatctgaggatatagtccttggacgcccttaactttctgtgggaatctgtgtcaactctctaccataggtgttccaggccttgtctcagaccacaggcaagtgcaaaagctcagctcccagataaccaaggctgacacttgtccctaaggaagctgcagggtcagcttggtttcagttctcttttcttttcttgtatctgggtatttcaatttattttcttgtggattcagctatttagacaaaggtttgctttattttgtccagcagcaatttctaagtgcttgtggtcaaaagattttcaagttttccagtcagccaaaatagcagaaccagaaaatattctttacatgtgaagagttcatataaattagtaaactaccaagcttacaagtggcaaaggtcataaatacagaatttttaaaagcagaaatacaaatgttccataaacatttggaaaggccaagaaatacaattaaaacaataagacaagacacaattgtggcctatcaaagtcatggatatttacaaaaagaaagaacaagaattgtgtcaatggcacggtgaattgagtattgtaacccattcagtgaaaacataaatgggttatttgaaaataatttgctttaagagccttaaaaaatttatttcccctgagctagtattcatacttctagaaatctacactaaggaaataatctaaaatgcagataattggtaaatttcatattcagaaagaaacatgttatttttaaaaaatgtatatcaccttccttgaaatcagggatattttatttactgcagtcttcaaaaccccaggcatagacaaagattgcagaggttgtataaaggcttaagacacaaacactattagggaacagtcatagagtatcttatggaaacacctgctgagtggttacggccactctgcctagcccaagctgaggtatagcttggaagaacaactggagtggaaacaaatatcagaaaaacacgtacagctatcgttgacctttcctacggtaagcgttttctcatcctcctagagtgaatgtgggactctgtggtgtattctcctcggaagtctgctttcttctgtcatagcactggctacactgccttgacttcccaaaggttgggagctcctttgggtctgtgactgtgtgccctttacctctatattccagtattatatagggcaaaccaaaggtactcaataaatgtctgtagaatgaacgaatgagactcatgggtaactgctcatcctataaatcttaggtaaggtggtttgcaggaggccttgtgcagcaataaatgcaggagtccacgcattaggattcctttggcggcaacttcctcagcttccaacactgacggaaaatggttagaggcctaggtgcatgtgggtcaggagccttgctgacagatccaaagctgacagtctggagcatgtgtgcatgctgcctttggactctgggacatgtcactgatattctccaggaaacttgtgaaacctcctgtttataaaggtttctccatctgttatactttctgtactttcccttctgcagctcttggtaacacggatgtttgcattccacagggattcctgttgctaaaaggtctgttttctcctgctagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaacttaccaatgactccccgttgcctagaggctcaaattgctagcatggcctggcgtgtggccctggtcaaccaagtctcacttccacaccctgacactgccactatgacaaactgtttgtttcatcttgttttcacccccaacctccacacctttgtccatgctggtttctccacttgggatgtgtcttcctctattgactggagaactcctatttttactttaaaacaccaacaagataccatccctctttgaaggcttctttgtctcccttcaagcagaatcaggtgggccctcccccgtgctcctatagcaattcgtatagaacttctaaacaagagtatttctttgaaacttctgtcttacccatgagtctgctgtttttctccgtaacatctccttcagccagactctcactccaccctaactgcccaggtttcacccctcacctggactgttgcaagaacatcttcatggggttttctatccctgctttgtcccagtaatgtaactgccacaccacagttaaagggaatcttcttaaactacatatatgatcaagtcattttcttgattaaaatcattggctggatccctaatgctttccagaataaagcccaaattccttagcatgtgctgcctaaaaggggatcccaaagcacacggactgacagggtctagggtcactctcagaccctgtaagtccaagagctcttgtagcccatgggctttgtatccatggtcagccactgtgatttattgctttgggagttaggaagtcactttggaaaggctcatgtttcctggttccagactgccctgccaggcccactgaagcagctgctgggaggcccctgtgggcagcactagacaggagtgctgctcaactggaaataagtcctggggctgttctgacagctctaatcctagccaagagctcttggaagtccaccttgtagggccaagatggggcaggagcctaggtccttaccagaggggccacagctgcggcttgaattctgatttgcaagctttttaaactccatgagctccgcatggtccttctcatacgtcctctttagattctccacatactgcatcatcacttccgttgctttcgacatgcgcttttcctgcggggaaggagcgcatgagtgcatgaggccattggaggaaaggctccgttggcacttatttgctctgacctagggtctgggctaggagaatcaaaaggatacagggacaagactctgccctctgaagagtttgctgtctgccatgtgagctgagaggtggactcagcacctgcgcttagggagaatgagaaaagcacagccaccacactgcaggagatgacaggcagaggagagttgtttctgcttgcagagaacgggtcaggggaggcttcatggagagggaatgcagtggatgtaggatgtgagcagcatctgggcccatagacaagggcaggagggacacagcgttcaggccagggaactccaagaggagtctagaggcagggaagcacagggcttatatgtagatgaggttttatcctctgaataagagtcctctggagagtgaagaaaggcacgacgacaaattatgctgggacaatcgacataataaaccagggctgtccagaaagcccagacactgcaggtcctcctacctatgtagggatcagcaagcagttgggtctatttgtaagtctgggttgtgaaggacctcgaatgctagacaaaggaatttgaacttattctgaaggaaaagggaagccattgaatatctcccttaaagtaagagagtaatataatcaggtcataggtagagatgggactcaagggagtgagactggtggcagtgagggcagcaggtaaaaacaggatgaagcctgacctggcccagtggagccagagaggaaggcaaagactgagacatagcagccaagacgagggagccatttggagaagggagcagatggcgtgagtgacaggtgggctgaggcacaagtttgggaagcctgcacacaatgagaacaatttctctctgctcataccccagttagatccctcagaggatctagctcaggccctgcctggccacagagggacacacccagtggcttcgcaggaacaggtcccacagtcatgcgtggctgagaccagctacttccctagagtcctcccgtgttgctgctcccagctggagtgacttcctgggcaccactgctgagtcagatgtccttgtcctgaaggacacagggtgggatggcccagcgacaggtctttcttttatttaataggaactgctcagggctgcaccaccccaggaacctcctctcatgtaaccagagcagcaggacatagattcatgtcatagcaacataataacaacatccaaatgctttacaagtacggcagcaaccctctatggcagatactgtgaccatcctcattttatacttgaaaagactgaagcagagaaacctcagtaaggggcccaaggtcacacagcgaatgaaggttggagccaggattagaactcgggcaatgtgctcctgctacaacatggggggccggggcggggctctgtatgcttcaggacttcaaagtggccaagagagagccagacctgggcctgtgccccgctccgccactaacgcttttactttctgagactctgcatcttcatctgggagacaggatatttatagggttgctgggtggatttaatgagacaaagcaggttttcctaaagtatgttttgtcaaatactagctccatgggagttgaacaggtattttttgagaaaaataaaatggagagctgtggggggaattcttcagttaaatacgtttgggaactatgtaggtaaagtgaaccagccttctccaccacaggagttaccaaagccttgattaggccaatgtgttagaaatttccaagaaagaaagatagtatgcagtagtccccaaacttgtgcgtccacagaaacctttttccacaaagcaccttgagggttcagtgatctgccaaaaatactctgaataatactgcaatgatgtgcataggatgcctggcccagaggaagccacctctaagtggtatctgtagttgccgctgcttgggtgattgctctactttacgtaggtggaacagagttggcaagaccgggggctggagagactcacctggcggacggcgcctaccacctcagctcggctggagaggcgggcagccaggcggtgcaggacagcgatgtcctccagcaacttctggtaggtttcccggtgctcacagtggtgccagagtgaagctgaggactgaacaggagtaggagcatcacctggggtcctcaaataatgttatggactaaatcagcagtccccaaccttttcggcctcagggactggtttggaagacaatttttccacaaacctggtgggggcgatggtttggggatgaaactcttccacctctgatcattagattcttataaggagggtacaacctagatccttcgcatgcacagtttacaatagggttcgtgaccctatgggaatcgaatgctgctgctgatctgacaggcggcggagctcaggaggtcatgctctcaggcagctcacctcctactgtgcagcctggttcctaacaggccatggtttggtaccggtttgcggcctggcccaggggatgcggaccactgggctaaatgtctgtgccccccacaaagtcatctgctgacttttggggggacatatcctaactcctcaatgtgatagtgaagtggggcctgggcgaggtgattaggtgaggagagtggagccccacgaatggaattagtgctcttataaaagggaccccagagagttctgttctctttccaccatgtaagatataatggaaaggtggtagtctgcaagccagagatggccctcaccagaacccgaccatgctggtgccctgatcttggccttccagcctccagaactatgagaaataaatgtttgccatttaagccacccagtctaaggccctttgttacagcaattcaaactgactaagacacacaccaagcctagactcagctctcatgaaagcagctctgggccccatccaggctgagagaagtggcctctgcagggcctgggccacagtttcttctggtgcttggagaagcccaatgtgaacacgctatccctggcgcctgaaagtaggagtcacacccaggccaccctgcccccttctgagaagctcccaaggctttggaggacctgtccacagccctgagggaaccaggcctttgggatctctgcctcagttccccccaactctctgaggaacactgtcagagtcttggctcaatttttcacttcaggagactatacttggtacctgagagaagcatgacaccctgtatggcccttggggacagtctctgctccagggattcctcacatcaggctccacaattaccgtaatggaagctttgaagttttccagttctttctcagtgttctcctctgtcaggttgcgttccctttcagcctggttaattctagattccagagtgtagctgtcatttctaaaggccaaggacagttgcacaaacacgttctgttgggaacaagggtgtgagagaggtgctgggaggagttactgcagaggacaaggctgcagctgtgctccttgcacgagcgttttgcaacggcccctggaacagccgccaaagcaccaaagcagccatgtgcaagggaaacgctcacttcacaggaaaccacaaaaaagatggtaaagcagggaccaaggtccacgctaggcccttcccagaaccggaggtccaaatgtattctaccaaaaaataagaagagaataacactttgctttttcctgaattttaagaaaataacatcctgtatctgggtttagataaactcaggccagtacagctaattgtgtaagcatctggatttatgctgggatttattgcatgaggggttttggagattttgcaggaaaatactgtattgaaagaaactccatgtgagatttaagcattgttgacgtaaagcaaacttcaatcagcatctagcccgagtattccaaatcctgtattgatagaagctttaagtagctgccaggagattaaataaggccaggtatgattctgttcggttaagctttctggaataaataaatgtttcatgctaaaattgcagcctgcatgaacagactttgaaaagataatattggtcatacatggaattcccagaacagtaggaaactactagggagaagaaatagacagatggacctcactcaggaaggaagcaatggtcttcaattttacagccatcatctgccctgagtggtagcagatttataccctgcagggttagtaaccacaggggcttctgaagttcatgtaacatggcccatggaaggcagtcatctccagaagaattgaaggtacagaattgacccaatgatgatgatgaaggcaatattgaaaactactccttattgagcatctactatatgccagcactgcttttcattctacaaattcatgtaatctcacaataaccctctggggtgggaactgttatacctgtttatgggtaaagaggccaagaccagaacggtcattaacttgttcaaggtgacacggagtaacggagccaggatttaacctcagactgtctgatttgaaagcctgttttatttccaccatgccgagagctgtgtccatatacatctgcggtcagcatttggacattaaacaaaccgcccatggcccatcttcacaaatgtcagtgggtaggcttagagctcatagcccagtgatagaaattttctgccttacccggccttggtcaagtctatgaataatgctcaatgcttaattttctataccttgattatccccttaacagcagtgtgacacaatgagttctgaattcagtgagaacacttggatctaggtcttggttttgccaactacagtatctagaaacttggtgtggttatttactcactcagttttctcctttgtgctgattcctgctccacctgcttttcagagctgctggttaggatcagctgaaaggatggctatgcgtgtgttatagactgcaagtgcaatgcctgtgtgcaagttatagatactacctgtggtagatacttcatactgtctgtcttcctctgcttatctggtccacatcagcagttctcattgtctcacctctgataagttctctttgtccgctacagaatgaaatgcagattcccctcagctcactcacaaccccgctgggacaaggaggccccagtgaggaaaccggaaggctggattgctgacagcacagcttcccggctccgctgagctggcattcttgtagctgaaaccctgaggaggccagccccctttcccactaaactaaagcttagaacttgaaatctgaccatttttcagtaattttgaaataaatttgattcaattctgcagcctcccagctggttttgtgtatctaagtcgtacatttaaagaatataaacaatccttacaggaatgtaaaatttccaactaccttctcccttttgcccaaatttgtcaaaatcttccatgaacggacgtgggaatggggatctcatggttcaagagggctggtcatgaatgttcacattaccccacagtcactctttctcatttttgtctaaaaatgtcagagctagagtctggaggaagaaatgttttgaataagcccagtcaagcacgggcactaaatttcataacacacttgagtcacttacctcaacttccttttcagtgagtggaggggcactgtgaaaaagaaaacacacaattgaactgtgtgcaacctagtcaatagacccaaaggtgactctgaatgaccagcagaccatgtgtttccaggggtggagtaagctgtgttggtgagaaggaaaagatgcaatgtccccttgcctgtgctctgtcacctgtgagatactgactcttacggcaccatgactatctctgtgactttggacaagttatttaatctctctaagccccagcgtgctcatctgcaaaatgggaatcatatcacctaccttgcagaggtattataagcactatatgtactcatgtatgtatgtgtatgtgtttgtatgcataaatatatggcatccacactcagtgggctctcgggaaatgtgaccttgaactcatagccttgctgtgagaaataagaaaatgcatgtgataaggactttataactcatacacatctaagttgccattataattgttctggggatatccacccaggtctgcaaagcctcaccctcctctgtctctgagggctgtgacaaaggtgcatgcgggccagagaataaatggtaggagagagtgaccagggttcttctccacagcaagaacttctgatggctagaatcacagagtggcaagaaagccccagccgacacagaggcatccttttgagcagctcctcgtctgtggcgttcccacagccagggctctccagctataggcagtccctgcatctgcatgtccactcgatgctgctgtggctgctgctcttgctggtaactaaagctggccccatctgaagtccacacaatgtaaataatgcacaggccctttcctgtgctggggcggggaggcctgggaggggtcctaccagcgtcacagaacttggcaacagagcatgccatcaataagcttctcaggaaacacagcttcctctcttgaacgggtgtgaagggaccccaagagcaaaggtaggggtcagccatctctgcagggggctggttctcacccctagggaatgatatgagtgccttcctgtcaggatgagaagaccccatggccatgaagtcagcggagtccagaacacgggacaaacagctgcagggatgtttgacacttacagtccttgtcacaaccccacccatcaggcccttgccttaactgtcatctacagcatacacatatgatttaaatgatttggcaaaacttgccaagtttgtttctgactcctgggtttgttgggatattatgtgaaatgcacatattttcataaattataaaccaaacatttttctatttcaatgactcacattctgcttttttgctgtagaacacacccaccttatttttattttatttatttatttttggggacagggtctcgctctgctgcccaggctggagtgcagtggcaggatcactgcagaggtggcttactacagccttgaactcctgggttcaagcaatcctcctgcctcagccaccagagtagctgggactatgggtgcatgccactatacctggctaattttttatttttattttttgtagaaacagagtttcactctgttgtccaggctggtcttaaactcttggcctcaagtgatcctcttgccttgagcctacaaagtgctaggattacaggtgtatgagccaccacacccagttagaacatacccaccttaaaaaaaaagtgggggtctggggggaaactctgaggactcagagaagtatgatttaggcagagaagccacatggtatgtctggtgtctgatgcagataactgtgccttacaaatgggcataggtacccgggggcagagctgtgagcctctaaaaggacacagcatcttttttaagtgactatttgtatatcttctctgaagaaatgtctatttaaatcctttccccattttgaaaaattggttatttatctttttattgagtgtaagccttctttatatgctctagaaacaagttccttttcagataagtgatttgcaaatatttcattctgtgggttgcctttcactttcttgacactgtttgcagcacagaagtttttattttgaggaagtactatttatttttaaaatcttgtctcttgtgtttttggtgccatatctaaaaaacccaaagacatgaagatttacttatattttttctttgaagagtcttatagtgttctctctgacatttaggtctatgatccattatgagttaatttgtgtgttttgtgtgaggtaggggtccaacttcactcttttgtatgtggctatccagttgtcccagcaccgtttgttaaaattacaatttttttcctctgtaaatcttaccaaaacccttgcatgagtggctttttgtcatttgttatttgcacatctcaaattattactttatcacagaggcctttccttgacctcctacccaatgccccactctcatgtcattctctagatgtgccctattttatggtctttctaccaactttactctttcaaatcattcatttggttacttaaatgttatttgtgctttgggaggccgaggtagaaggatcacttgaggccaggagttcaagattatcttgggcaacatagcaagaccctatctctacaaaaaaatatttgaaaacttaactagtcatgggtaaatggtgtatctgggattgaaacccatgtctcctggctcaaagcccattctctgctgccatgagcttctggtgacccttatgccttcatgaactgtgctcacctaagaaccccacctggcctttgagttgaaaacacccagcctggcctttcattattctttttgtttcgaatgcattatccctatctagacaattggactttggcccttctgggttcaagaattaagactggtgttcctctgtgtcccacctagaatccaacacaggggccactcggtacagggccttctgtaacccacatcctgattttaccttccagggagactcctgtggacccgcagtttgcgcagcagcacatcagaaatattaggcatgacatctaagccactctttgactcttcttcctcaatagctggggagagttcagaaggaagccctgaaaaaaaagtgcttacttataaaatgtctctttgaaatcacagtagtactgttggcagctagcttcaggagctttgacatttataagtatctagttctatgttaagggctttttaattgttatcttacattattctcacaatgagctagaacttagtcatcccatttcacatgtagataagccaaggctcagcaaggttaagtcacttgctcaagattacagaactagcaaatgacatggccagacctcaaggtctacctgcttcaaatgttatgttcttccctttgcttcccacagtattaagctggcaattggaagctggttggctctttggctataatgtttgggaaaaaaacctgctccttggcaggcttctcaggagacctgttgttcaattattcctcctcggataaattaaaatgttctatattatgtatcctacttagaaattaacatctgattccataccccatagataagagattttccagagtaaacctaaggttgctagatcttttacagatctcagaaacataaatgcctcctagtcaacagagacaatgaacagctttttgttttttaaacttctaaaactatcttgggtctgtgctttgaagacagaatgaacaaaccaagtattctcttttccataaatctttctcctgtttgaaaacagctcctgtgcctctctaaagcttctcttctccagactctagctccatttttccaacaagctcactgtgctccactgtggcccatggtctctagataccatcccattcctgcacacattctggtttgttgctgttacagaggcccagatgttctctaacaagatcttagcacaggaagactttggtaaatgtccctggcattgatgtttgttattcatgcagcatagattttgtgtgcctgactacgggcttacagtacacttagcattaagcaaaactctcaacctctttagttgacccaaatcagttatcctcatcctgtataatggttactttccatttgcatgtagaacttcatatttatccatgttttactctttctcctggattttaacctggtagctttccaatctgctcaatcattttccaggatcctaggctaggctagagaccaggactataggcatagttgtagccacctgaagagttaagactgggaatcatgtgaatagaaagaagtctcaccaaaggagaccatgaagagacaagaggctatctagtttggctcaaggtaaaatatgtttaaatactttgagcttgccagtaagagaatggtaggcatggattccttggtactcaaggtagccaagtaagctggaggatcatctgtcagagatgggtcagtcagcaattcttctttggatatgagattcaactagaagttctcttagctacctgttacctctctggttctgtcctggtatttatagctctctgacaaggtttctgtggtaaaccttgtgtcacccctggcatcattctacctttatgtatgtatccctaccacactcaacagagagtcaactgagtagcaagctcctgagatatctataggatgatcgaaacatatgaggtctaataatcaagtgaaatgcatatcagggtttttgcctagaaaagtttcccaaaatggtgcttgaagagtaatgccagaattggtggattctaggaaccaaccaccttcctcctgaattcaaccaaattaacaacaaaaaatttcagaacaaataaaaaatacacaagaaactctaagatacaagaaaaggcaatagtctttaaaaatagtgactagagaaagaataaaaattactaggaataaatgtagagcttccacccatgataaccctttcttcttctccaaagaatcagtactgaaaggaagatgggagagaaaaaattcttacaaagagttcaataccacagaatagagagggaaagggatggagggggcaagtaggcagttgtcagaggagattcagaaagtttccctagaatagaaggttctccattccatcttaccagcatttcgaagagagaaaaaactgcctgggctgcctgccattttgcttttcttactgatgagaagaagagaggaaaggcagaatgatcgcacagaacacagagtggattttcttgaatgatatgaagggatttacaaggaaggaagactaacggtaaagtaaataaaacacgtccctctgaaggagtgaatggcaggagacacatggaaagccccaaccaccatgttctcccccgactcctgaaaaacagtggctaaactccttggatttgccgttttttccttcctttcttagcagaggagtagccgttgggaagcattgggtcaagtctggaaaataaacctacggacagcttgtctctacaattccaacctaaattggtgaaacaatctgaaacccactactaaccacctccaaaggaataagatatgcccccgatttggtataacaaactcacgttttggactatgaacagagttacggaaaaagagaagaaaccaattctacaaacagctctatcttaacttccccttttccccaccacctaagcagtaacaaaacaaacacaaaatatacaatcctcaactaaagcactaaagggaaggctaagagatcccagctaaggtaggaaggagtcaacaaaaactaacctacaatacaatatatctagggaaagggaatcaaggtagaaatatacaaatcagaaaaaaataaaaggaaaacagatggcatggcaactatacaaaaatactatagacaaaagaggaaggaaggtagaaaggaaggaaaagggaaatgtgcaagagacagatgtcaggatggaaacatagttgcaagaaacacatcaaaaaatgcaaaagtatgcttctgtgcaaaatatataccataaatactttgactctagaaaaaataacctgaaaaaaaattaagaaattagagttgggatgagaagatcatgcaaagatggaagatgattgctatttaaggaaacaaattaaagaccaaaataaaaggactaatcaagaaattgggaaatatacaaccaaccaatttattggaaaaatgaaggaataaagcagatatagcttcaagctgaattagaggagggtggtagagattgagtaatcataacgaatgcaaagaaggaaagaaagattgaagtatatggagataaaataatggacctggagttgagactctgatgacccatctatgcattatgttgtctccgaagcagtgaacaaaacaaatggaacaaaggacatattcaaagatataacagaagaaaaatgttcctcacttgaggggaaagttgaacccttcaggttgacagaccgcatcatgttaaaaaatatatttaaatgcttcatacaaaaaaaaaaaaaaaaacccagacatctacatgggaaagtgaagattaagaggtgctggaaatcagctggtcccagctttctccataactttaaatacaggggagcaacatctacgcagttccaaggaaaacagtcaaccaagaattttgtaaccacacaagctgtccttcaagaaaagacaaaattttcaaatgtgatagaactcagggaacacagcacctctgaactctttcaggaaaattgttggaaaacaaaatccagctaaacaagacataaatcgaataaatttgggaaagggaccagtggtgaacatgaaatctttttacatttaagtctaaggctaaataactgtggaaaccatggttacagaatatggaatgtaaatgttataaccttaatgatgtacaaagaagaattcaagatgtgtagaggtagaaatggaaatgtaggaagaaatgtgaaggtgggaagatattcggccattctcatcttttcctgcaggaagtcagtaggtaccattgtagtgactacatgttcttatcttccgtattcttgatgttctgtcacttggtgccttaatcctggagtgacagcccctctcaaggctagctaattcctagaaacaactctccttcaagtgtgtctttgaaatacaaaccagccaatccagaacccacacctgtaaacatcacctttatcaaattctcacgcaccaagccaatactccccctaaatcaccccagggccagtacctgacaactacgggccaccctatagcctaggtcctgccaaaattattcaaactagccaaccctaaacatactgaggatacctaccctgcctctacctttcctttccaagaaaaccccagtaaaggcttggggccatctctcccctcaccacttctgccttctgacccaccctagcccttccccaaggggctctgtatgatgtgccacacatcctgctattagggatctgtgagtataaacctattccttcatgagaatcatttgtgggtctctgtgtcataccatacctgattaaaacaaatgccaggtccaaagtttagattaaatttaaaacctataatgcaaaaaaactacctcataatttatagatttcatgccatccccatcaagctaccaatgactttcttcacagaattggaaaaaatactttaaagttcatgtggaaccgaaaaagagcctgcattgccaagacaatcctaagccaaaagaacaaagctggaggcatcatgctgtctgacttcaaactatactacaaggctacagtaaccaaaacagcatggtactggtaccaaaacagagatatagaccaatggaacagaacaaagccctcagaaataataccacacatctacaaccatctgatctttgacaaacctgacaaaaacaagaaatggggaaaggagtcctatttaataaatggtgctgggaaaactggctagccatatgtagaaagctgaaactggattccttccttacaccttatacaaaaattaattcaagatcaattaaggacttcaatgttagacctaaaacctaaaaaccctagaagaaaacctaggcaataccattcaggacataggcatgggcaaggacttcatgtctaaaacaccaaaagcaatggcaacaaaagccaaaattgacaaatgggatctaattaaagagcttctgcacagcaaaagaaactaccatcagagtgaacaggcaacctacagaacaggagaaaatttttgcaatctactcatctgacaaagggctaatatccagaatctacaaagaactcaaacaaatttacaggaaaaaaacaaccccatcaaaaagtgggcaaaggatatgaacagacacttctcaaaagaagacatttatgcagccaacagacacatggaaaaatgctcattatcactggccatcagagaaatgcaaatcaaaaccacaatgagataccatctcaccccagttagaatggcgatcattaaaaagtcaggaaacaacaggtgctggagaggatatggagaaataggaacacttttacactgttggtgggactatgaactggttcaaccattgtggaagacagtgtggcgattcctcaaggatctagaagtagaaataccatttgacccagccatcccattactggatatatacccaaaggattataaatcatgctgttataaagacacatgcacacgtatgtttattgcagcactattcacaatagcaaagacttggaaccaacccaaatgtccatcaatgatagactggattaagaaaatgtggcacatatacaccatggaatactatgcacccataaaaaaggatgagttcatgtcctttgtagggacatggatgaagctggaaaccatcattctcagcaaactatcgcagggacaaaaaaccaaacaccgcatgttctcactcataggcgggaattgaacaatgagaacacttggacacaggaaggggaacatcacacaccggggcctgtggtggggtccgggggatgggggagggatagcattagcagatatacctaatgtaaatgacgagttaatgggtgcagcacaccaacatggcacatgtatacatatgtaacaaacttgcacgttgtgcacatgtaccttagaacttaaagtataataataaaaaaaagtatattactaagtgaaaaaagcaaggtttggaacaccttgtataatatactacgatttatgtttaaaaaatccacttttggctgggcgcggtggctctcgcctgtaatctcagccctttgggaggccgaggcgggcggatcacgaggtcaggacatcgagaccatcctggctaacgtggtgaaaccctagctctactaaaaatacaaaaaattagcccggcgtggtggcgagcgcctgtagtcccggccgaggaaggagagcggcgtgaatccgggaggtggagcttgcagtgagctgagatggcaccactgcactccagcctgggtgacagtgagactccatctcaaaaaaaaaaaaaaagaaaaatccacttttacatatatgtctatatttagaaatgcttggaatatatctagaagttacactaaaacatagtgacagtggttgcctctgctactgggggacagagatgtaatgagacttactttttcctatgtctcattttgtactttttgaattttgtactatggacatgattatttataaaaattgaattaaaactcataccaaagcaaaaacaaaaaacaaaaaacaaaaaacaaaaaactacctcagtaactccaaaccctttatgcatttcataatacattttttatacttttagaaaccaatttctcttctttggaggaagcagttaccaaaattcagcaagtcttatagtttcacttcaagttcaattaaattctaatagttttaatttcaaacaagtatatctagtataatctccctctttttcccttcctccttctgtattagtggggaaggaggtgtttagtgtaagctatttttactttcttccttgtatttttcactattggttgaatttttagatatgaacataagccactttcaacaaaaagtaataaatttattttcaaatatatctcccaggactagctcattccaatgaaaatatttgtttctgaccatgtcagggacttggaaaaattacttttggagctctgaaagatgctctgagtcccaggatggttcctaaaagtcaaagctgctagttggggataaacttttttttacctctttcttctcagggaggcctctttcctgcccaagacctgaggctctgagtctagactgggggttttggaaggactgtccattcgatgtacttctctgcctcagcctacgtgtccctcaaaatccaggtccagatagccaactaccttctagacgttgccacctggttaaggagaataaaaatcatttcaagagccaccatttactgaacatcaactatgcagtagatacactttgtcatttcttacaatagtactgcaaataaaaaatagcttaaacacctccttccccacaaatacagaaggagcaagggaaaaagagggagattatactagatatacttttttgaaattaaaagtattagagtttaattgaacttgaagtgaagtgaaactgtaggacctgctgaattttggtaattgcttcctccaaagaagagaaattggtttctgaaagtacaaagaatgtattatgaaatgcattttctggagaaactgaagctcagctgagttaaagtgatttactagggtccagcttatcagcagtacagccagaatgcaaaaccaggtttgtctgttgcattcaagctgctttccgtgggcatttgacatgtccaaactcaaattcactgtcttccttctcaagcaaactcctcctcctgtctcacaattcatcaccctcacaaccatgcagacaggtgcctggtggtattcctggtctgcctctcaactccatctcctcatcaagtcctgacaagctgatctccaatagctgtcaaactatcctgtccacatttactaccacctcattacctctcaccaggctatttccctatccttttacctggtgtctccctgtctctagcctctgctgtttcaggccagctctcacaatctgtccagaagaattattctaaaatatagatttgatcctgatgcttccttacctgcaggcttctctttccaaagtgtcctaaatgaaattcaaactcattaattggccttcaaagccttcaatttccttggtctcagcccactgttcccaccttgttgcccatctctctgggacgtgtagctcacacttagttcacatgacattccttctgttcctgaagtatgccaagcactagaagatgcctacatgcttttgcttctgctgtccccctgcttgggatgactttctcttccccagctcaaggtggctcctcctgaaaaccttccctgactcaaccccactgagctagctgcttcttcctctttgttcccaggtactttatggcctgttaaagttttatcacaatttatcgtagtgactttgtctattcttatgtttcctctcctagacagtgagcttattcgttcatacatttgtttaatgtttattgagtgtttactatgtccctggcaatgagctgggagctaaggatacaatgctaagcaaaactgacatgccacatcctctggagctcattattcaggggaacagagattaatcagagaaacatccaaacaatttcacactgagagattttacaaaggagaagggatccgaaggtaccagcaaacccttcccaagaaaagtgacatgagcagatatctaaagattgagttgggagttcattaggcaaagagggagagaggaagaacattccatgcagaagacagaatgtgccatgcgtaagaagaggaaagaatgagctgccgaaggcaggccaaaatattgtgagtgagagtgagtgtggccctagaatatgctggggaagtgggtggggttaactattcagggccttgtaggttctactgaggattcaagtgctcttcctaagagcagaatgaagcctctgaagatgctgaaacagatttgccttctagagatccctgcggctgctgtgttggccatggtgtgagctgggttgggggttgggagtgcagggagaggggaccaggttgcaggctgttgagttagccaaggggactgataatggtagctgggacaaggccttctccctgatggtggggcctgaacccttttcacttaatgcatccccagcacacagcctaagaactggcccacagtcagtctcacatatttggcttgaaataacctgcaactgatcaaagatcaaaacagcatacaatatagttcctgagaagggaactgattgggttgttggaaagactagatgcagcacagaaatgagcctcccagtcctcacaaactgaaggagagccaaaattcttcagactccagaatgttctgataagtatcttttcccatttctcaaaggaacagccaacaaccatcataagagactggatttttccccatgagttcatatgcagggctgtatttagtgcctataaatacaatctgagccagctctcataaaatgctcccaaagccttttatcctgggtatgggaggggacggggctctttgatggggctttcagaatataagaaaagaaagtcacaagtctgcaagtattcattaaacacggagggttgcccaccacatctctagcactgtggagcacagtgtacaagaatatcccatttggttggcaagatagagttctacaacctaaatgacagaaatgaaaatgtatgccaggttcctgctggaataaagaccagtatcacatgcaaacattacagcagcttagtgaagtaggtactgttattaacctcctttaaaagatgaacaaactgaagcgtggagagaattagaaccttgaccaaggctatgcagctggtaagtgatgaagtctgagctcttaagcatccagaccctagaactgagagaaaatgagagggagtgtatattgttggacactgaccatggttaattttatttttaaaatttggtgcttataggagtcacattcatttgcctgataattttacttctaagatccatcttatgccctattaatattggataataaagttttgctgtaggtagtggatgtctaaattggtataattttgtaagctaatctggcagtgtgcacatatacatttaaaagtaaatacttttaaccaatcaattgcaagtctagaatagtagcccatggaaaaaacagatttctataaagatctatgtaagatagtattcattataacagtgtttttaatagagaaaaaaagtggaaatattattacaactggggagaagtagtatttttataatgattgaaataatagaagacttctcaaagggaaagataggcaaacatgattatgtaaaatctttacaattcctctaaaataacacaaaacgtattaaaaagcaaaaaaaagattgaatgaaaatatattaaaatacagccccccccaaaagaaagaaagccaattaagggctaatatctataatgtatcaagtttacatatattaccaacaaaaaccaaacaaatcaacgaaaaaccccagacctaaatgggtacacgggcaaagatgtaagaagttaagtcacccagtaagaaaacaaagtgactattttaacattttaagtttgagcttcctagcaaattaattgaaataataatgaaatttcacactaataataataaacttaaaacaatgacaattattgattattcttactatattctgaataataaggagcagaagcaaacaccagcacgggtaatgcgtaagagaaagatgtccattcagtctttgtcagtagcgttattcattgtaagtaatttgggaaatgcaaatgtttctactctttaaccttgtgattctcaagtctgaacacttatctcaagggaatgatttaaaggaagaaaaaagaacaactaacggtccataattgtttatactagcattgttaatcctagttcaaagaacaatagataggtcaatacaagaggaactatgcacccattaaatcataactgaggagaaattgctgagtataaaataacaagtaaaaaaaagaagctgtatctattcatcaaatcaactgaaaacattataaatatgggcaaatattgcaaagaagaaaaattgttagtttttcagaattgatggggttgtgggtgaaattttaaagtgttttttccagtgttttaaatatgctttagtaaatttaaaattataattagagaagtatatgctgcattttcaaaagatctctttaaagatggttatttaaaatattttgcccttgggaaaaaacactgtttgaaattttacttctgggaaccttcttattaatgctgaataaataggtaggtgtaagttactacagttcagaccaggggcttccaccattgttagtgacatcctggacacattcacccaagaatccatagggctcttatgctgagactggcccccagcagcttgaagcggggcaaggattttcaaatggtgctctgtgaagcctgggtccctggaggtaccttgggcccacagtctcagaagatgaaggatccaagcccttctatccccttcaaccagagcagccccatttgcatctccccaacacgctggcctcctacagatcagcttgtctgaaatgttgtgcagcttaaaaaaagttttaaaactgttcatgagatggccaaaccatgagatttggagtcaggagatcctcgggcctcagtttcctcaactataagagcaagaatccctgcccctcttagctgactgggaagattacataaaatcagaggtaacaaaatggtttatactgtggaaaatgctatgggaagtttattaattaagattgaattaaaaggactaggtgacacggatgaaccttgaagatgttttactaattgaaatgagctcgacacaaaaggacagatactgtatgattccatttctaggagggatctagaagagtcaaatacatagagacagaaagtagaaggtgatcaccaggggctggggagggagggaataaagagttattgttttaatgagtatggcatttcagtttgcaatgatgaaaacgttctagaaatggatagtggtgatggcttcataatatgaatgtacttactgccactgaactgtatacttaaaaatggctaaaatggcaagttgaatgttatatatatttacaataaaaaatagtcccccaccccctctgaaaaagggagtactatatagagtaaaatacaaaagaaagtcaagaaagtagaagattgcagagctggtgggactaacccactgctttaaggaacaggtaccatatgactcagagaggagggagatagcccagcaggagggagatgccgcggggacagaggcacagaggctagagggtgagtggccacagagaagaggctctgggaagagggaagagccaggagcctggcctgttggaaacactcatctctctccactcacccatgcctctttgcccacctcatggcactatggttacagttacaaattattttcatgtacctatctcaatgctcctgccacatctttttaaaaatgtttcttttgagacaggatctcactctgtaccccagagcgagaccctagagtacagtggcacgatcacagttcactgcagccttgacctcccaggctcaagcgatcctcccacctcagcctcccgggtagctgggactacaggtgtgtgtcaccatgcccaggtaatttttgtattttttgtagagatggggcttcgtcatgctgcccagactggtctcaaagtcctcagctcaagcaagccacctccctcccaaagtgctgggattacaggttcacctagccccctgccacatctcatacaatttcattcgttcattcaacaaatacctatgcaggccctagtagtgccaggcattgttgtaagcagtggacacacacacacacacacacacacactcctgcccttgggggcttcttctctagggataatagctgacacctagataacacctgtcatgtaccaggtattgttttaggtactttatagatattagctgctttaatctccataatcacctaagaaggcaggtactgttcttagcctggttttacatgcccagggaggttgaatagcttgcccaggtcacctgagtggtagcagggcttacagttccaactcgtggtggggctcgacatactcatgcaggagaatggggccgaggaagggtgttgggggcactgggagcagggctggacttgcccagctagatctagaggggtcagaaccctactgagaacatcggcagaggtgagtgcagagagggaggcagtgcgggggctgaagcctcattttcagaaccattttccccgccatggttctggcagaaggtggacagggaaccagaggcttggaggaaggggcctgcagctacccagcagggcagggctggggtatggactttgtggtgacagcagattagtaagcaagagatggccgtgatgccttgaaaagaggaactcttcagtttgggcagcttcctgggtgtacgaggaaaaggaagtgtcaaaagttcaggcctgaggcacccttccaggcccactagatgccagcatggcttagggagggctgacagcgaggcctgggggctggttggaaggaggcaggtttggaggtgctgagcgggcagaagacacaatcggattcattcattcaccagcaaatgtttcctgaggaagacacaggaagtcttgtgtttacacattcaccttccttgatctggcacagacaaatcagcactcgctgagacagcatctgccccaaccccacctacctttttcctgctcagctgcttcactaaggtctggaagcttgagccccactaagttctgatttctcatcaggatgtgctcctttgtggtaaaagaaagagataacaatttcagatgatgacactgggctgggctgttctcttggctctgtctatggttctgcgaccactatcttaggtgggaaagcggggcagcctgagaggtgggtgggcaggcatggcatggtgaggcctgagaagcaccaggaaatagttcctctcccagtccgtgaaggtgcctgaaacgccactgtcagcaccactttccatgggtcagggactacccttggcatggtctttttaaacaagtctgtgggcttcagggtaaatgaactgcttggcctcactgtggctgaggtttgcaaaggacacacaggggcagaactaagggctctgggacaggagggtcccctgggtgtgtatggcgctgctcctggaaacagctttggcgatctcatggctggctggatcttcctgccctgtcattccgggcagtgactgctcacttccaggagctgcgattgccccacacactcaggtcatcaatggccttttatggcacctcttgagtttttaaactctccagaaaagtgaggcctgagaattgctggcttagggcctcagctggcagagcccggggagagatgggatgtggcccaagtgggctcacacctgctctaagccaattagcaccagaccaaggacctgagtggaggcacctggcagagctccttgcccctgtgacttatggatcttcagtctgctgtgtggcagagggcacttgggaatggtttgtcccccgagaagggaggaaaggaaggggccagcagagggtgctcatgatccaagtggaagtcatggtcaaggaccctttacccatttggttagcaagccagaggcccacagcccatcagcttcagcacactggagtcgggtaggggctgggcactcaggtgccagggtagtggttagtgacatggggcctccaggttccctgtaacttctctgggtgggcgaaatctgcaggagtgtagggagtgaggaggctctgataaccagaggcccatgaaggcaaatccctggctatcggccccttggctccaacttccgctagagatccgggactgtggcaactcctctgggccctgtgctgtttgatccgctagttagttgggtctttctgactaggaggagttttgtgtgtaaaatgttaacatcagcagccacgccccagctcccctgtgcctccagttcagagcatcatgaaggtatctgaataggatagtggccagcattggaatgtgtccctgccagcacacaaatcccctcaattgtgcttgagtgctatcgggcaccttcttttcttccctgccccacatttccctctgtagaggagccaggagaagcctcctgctctgagggtgctgggcctcactctgtggaatccaggtgccttggtttatattccaagtgggccttctggaggagacaggactggtcagaattgctttgtcctgttatctggtctctatctctggatgcccccaatcataccctgcatagggtggcaaccccacaggagaccgctgtgcctggtttgatggccaacagaagctgaggggacaccatgggcactggaagaaactcaccatgggcggagcagccttcacacttgcagatggacttaaagcttttgttaacaggcatcaggaaggaaggcttgggggcatcacaaaggaaatcactatttcacccttgctagctaatcctaggcatgactgggcactccatcaagggattcctgtttatgagccactgactccggttggaggaggaaagcagcccaggactgaggggcccacatgtccctccacacgtctgccttcccctgagatgtggctttgtgtggcaactagattttagactgagctctgcctggtaactggcataaaaaagcacctaaaactggtatttaggaaagagatgccacataaataggcctgacttctcagagtgggaaaatttacgccctcacaaggcccaagtccaggccagagctgccctggccaggggcccagactcagccctgaggtcttcagcccagggagtacctggagtacacactctgcccaactggcccccaggaacccacctctcggagcttggtcagtttctgcatccgcacgggctgcacttgtatctgaaagtctttgagaccaggggccttggccagcttgccgccggccttgcctgcaaaacgcttttcttcctctgccagtggcagcttggcaagcactttctgcagccgggggccaggttcttcagggccactgtcccaggagagccctcgcagcagcgggggccgggacacagtgggtggaagctcagctttggagccagcctcgggccccatcggctctccagctgggcctctcccctgggaggctgggggacccactcctgccgcatcctgggttggacttctcggcagagggctgccctcccagcccgttttcaagagctgcttccccagctcgctctccacggggccaggctgagggctgttcagggccattttcccactgctgtttgtaacaggagctaggcctttgggtgtggtctcggggtactggaggggatcgaagttttccttttgttctattgcaatctctttggacttctcaactggaggaggacgaggagccagcctgccctgagacactttcctctggtcattctgcttcctgtcagctagccctttggggacgttctgaaaaagacaaggtagagctggaaccctcgggggcaggttgaggggaaacaggtgaggccacttctgctgtggagtctctgcccccacacaccttgccaaggggcccatttgtataagtgtgtatggggtatgagtggacgatgtggaaggagagggcttctgcccgaggtttgtcaaacagacaggaaaatggaacctgcaatccaaaaccagccaagaatttcccaagggataggagctgaggaaaactgaatagaaggcagctttggccctaactcagttgccccagatctagccttggtgctgcttagcaaggcccttaactcttagggacccaggtttgtgaaccctctgaaattatgtatgtgtatgtctgtgtgtggaggggtgtttttctaggaaaaacatccacagctttcaacaatttctcagagttccatgatccaaagaggttagggatcattggatggggtgattcttgcaaaggtgatgtcttcctgctcagaagctctaagattctgcagtgttagtttactttgttcattccccaagggaaacctgggccgtgagcagcacgtgggtctgggggtctgtgtggctgcctcgtgtgtgctgagactcttccagaggactgtatcccagacccagttccaggtgacactaaattctactgctgcccttgaaacactgagcacgtgggcccctcgatgtgagcagggtggggcgcttctgttgctcatcaacaaagatgaggttttcccggcttccccagacagaatcccaggcaggggctggcgctttcctgcccttttcactggagctgacaggagccacagtctcacctggcctggaggtcccccttgtctccaaccagcagcctgactgggggtcagcgctgtgagtattgcctccacggagttcacccccctgaatcctgcctccccacccctccaccttagacttctagtcactataaggcaggggaatctgctgtttccccagccctgaccctccactcatacgtgtgcatgcacacacacttgaaggctgcccaggagccagcctaggcttctaggagactgtgccccccacactcaaatcatccaaagggagcaaagctcaaactcacaggctcgccagggtgaggtgaagagacgtcggcctcatcccccttctgctggagaaggtgaacaggagtcagtcagcaatgggaagagaccgtgtttcctcttgaaatatccccaaggaggccccctagcagtggtgttcatgccctccacccagcaccctcatctccagtgggtcacgaagggcctcctggtgttcggggtaaggggagagacccattggcatagaaacagcacagcaggtggggggtcctgtcacctgtggtggtgctccaggcagaggggatggcgggccactgcacacatccaaacctggaagggtccagacactagtgagtgaggcccagcagcccaggccctcagctgtgctttcagccacatctccctccccgggctatcctccctttgcaatctcaggcctggaagatttgctgactacctcccgtgtgccaggttctcaggtgggccctcacagaatgttcacagagaccacaggaggaaactgaggcacagggaaatcaaagtctcatggccaggaaatgtcagcactgagatttgggcccaggctgcctggccccgacctgagcgtgccctgccgcactgatgagggccggttgcccttcctggcaccctccccctttccttgttggctggagggtgtgactctgggtacagcctaatgaaagggaagaagtcagaccccaaagaggcctttctgtataagctcttgagggcttctctgagcctccctgagccagagaggctgtcctagtcccctttcccacccagccttcctgaccctggggtacacctgcctcccgacacaagcccaagatgctaacagaaagtctatctgcctcctctgggtggcccagcaaatgccccccctggagaggggtcttgctctgggtgtgaaggggccatcagagttcttgaaggggaagcctgcaggctgggaggcatgctgatctgtccaggctgagctgccacccagagcgagaggcagggcaggaagtccccgggcagctgggcctcacctggcggggtggggactgtaagtgagttgctccgagaggatgtaggagaagcgctggggctgaggttcggggaaacagctgtgaagacagacacaaattggctggcattcatgaaggtttaggacttcaacctggcaaaggcatccttttaggtattcccaggccctgggaactgggtctgccttgctgggctcaggggctgatgctggactgcaatatgatgctcctgttacagcccaacccctccctgctgctgctcaagagatgggtgccctcaggccatttgggggttcgaggatagagtcacacttctcagcctgcctggcctgacctcaaggcactgtccagaaactgaggcctggcgttggttggcaggtacagctccagaggctgctccttctcgacttcccagggtggccctgacttcaaaagctccccttgtcctcctaagtacacttacacacttgcccaactttttgctcaggaagaaaagtgactctagcatagaggaagcaggaggatttctgggcccaggaaaaccttccctctaacccagaaattccccaaagaccatctcctcttccccagagggcctaggatccttcccagcacccacagagatcaagggaagggagcccaggacagaatcctgacctctgctgaggagagcaggtgagtccaaggcgacctcctcggaggtgaggcgcccactgcagctggtgccaggcccttccctcccgaccctagaggggctcagggcagccacctgtacatcctgccaccctacctgatggggagtctccggggctgctcctggacttcctcccacggcgggtcaggaatcgctcactcaccaacttggcttcttccagcagcgccaggtttttcttcttgtcctcctctgagatgctgatgtctggcagctggtcattcaccaggtcaatgatgtgccccgcggggtctgcagaaggaggatgagctggggtgagagccactgcatccgtggccccaggctgaggtcatgccataccatgcctcatcccagggactctgcccacagctgacccagccagccaaacctcagcccagtgccatcaagagggttgcatggggacagacagtggcttcctctgcaggcctggcccctatggcttatggcctgtggtcctccgtcacaaatggtcctggagccatctcaggttcccagaattttcctaaactctgtcaggaagggaaggccacccaggagccttacctccggcaccatctgcgcccccagtgcattcttgcttctggcctgtttctttcacaagctaatgcgcttaaggtttgtgaataaaagaaggagaccaaagatcattggccacggccacaaccccgtggccaccttccctccagtcacattgttcaccccatttttctccaaaactgcccctctggatgaggtgggtgaacggcaccacctctcacctggctgctcaggatcacaggagtcactccccacttctccctcttcctccctcccccaacatccaatcagttgatcaagtcctccctgcatttacctataaacatctctggagcctgttcctcatctccattcttgctcattagctcttttttttttttttctttttttgagacagagtctcactctgtggcccaggctggagtgcagtggcacaatctcggctcactgcaacctctgcctcctgggttcaagtgattctcctgcctcagcctcgctcgtacttgttagctctttcctggacaattatgtcttctacctaagaggtccctgccctcaggcgagctcctccatcccatcccccactgcctatcagagtggctatcagagccacatctggccatgccattctccacctcatctcatggggatttctcatgctcctcagtgtggtatccaaaccctaaactgggctcagccagtcttgctggcccccacatactcctcccaagtccctccacttcagctgtgtctgcagtgaacagctcccatttcacctccatcgggttccattcgtctttgggcagcagatccttggttttcacttggtaaaaacctctctgattccccattagctaacccccctcccctgtgccaagagtgggaatgtggactagtcttggccaatcaatgaacagaatccccttggccacagggattggctcggggatggccatgtgaagccattgaggggcaatcctggtgtggagtatatggggaagaagaactctccactgatggggcgtaagcttggagttgctggtagctattggctaccatgtgttgaagagtctgccaagaagaaagctaacacacaagaaaaaaggttcaagagatggaatgggacaattgctaataacccactttgagcacctggatccagcactacctgaaatcacaagccctggcttttgtaaatttttttttggtgtgaggtagtttgagttgggtttctatcatttgaaaaagtcccaattggtacacatggcagagtttcagttgccagcaacatgctccagggaggttcctgctctttcagtgtgtttcctattccccctggaatgcctttcctccctcgcctatctgtccagctctctaaggcacaactcaaatgccacctcctctggaataccttcctaaaacttcctctcctcagagagactcggtccccttcttgccttggctggcctagctcttctgtgcagtctcttatcatacagtgtcccaattatctgttcatttctcagtctcttcatagtctatgagcagcatgaaggcagggaccaactctatatgagatctatgttccaacagcccagggcagatcgtgagccaccatctggggatgagcagatgaccagggcagccggccttacactcaggcacctactccaacctggatgtgggcctctttagcagaggctggaggactctgccccctaaaccccagaaatgagtttcactcagctgttctttctttctttgacttctgcatcttcctcttcatgccctggtcttgtcttttgagcaatgaaaactgaattaaatatgcttctcctagacccagacacggaggggctgatctaccctgtcctgttggacttatcgggagggagcgccttaaagagcaggagagaggaaggagtcaagcccagccacgctgccagacctgtctttctactcaacatgccttagattgccctggtccttacccacagatgtcagggaggcagtggacaccttcaagtgtcggtgagaaagcctcttgtggggactgtgaactctgaaagacagaacagtcatcttgttcagaaaatcaatccacaacttgaaaataggtgaaaagatgcctgtatattctttttctttttctttctttctttctttgtttccttctttccttctttctttctttttttttttttttgactcagttttactctgtcacccaggctggagtgcagtggcgcaatctcagctcactgcagcctctgcctcccaggttcaagcaattctcctgcctcagcctcccaagtatctgagactacaggcatgtgccaccacacccagctaatttttgtatttttagtggagatggggtttcaccatgtcagccaggctggtcttgaactcctgacctcaggtgatctgcccgccttggcctcccaaagtgctgggattacaggtatgagccactgtgcccagccagatgcctgtatattctttcaaagtcatcctagaacatcatcttacaagcttctcgagggtttctctgactctcaacttgggaacgtcttagaaatgcaaattctcaggccccaactcagatcagaaattctggaggtgggcccagccagctatgattttacagctctccaggtgattctgacgcgtgctaaagttttccaaccactgccctaagaggatgtgactttgacttactatttcctactcattaggtcccagactctgagctaacatctaacttgtagaagcctcataaaatgtaaatcattgttgtctgacaaagacgcagatgatttctgtttgggaaaaaagacaaaaatatggtttcattgccctgtagaacattcacctattttatatctaacttagcagttttattccagcactttcctccccactgatgatatatgtatatccattgcttgtatcctcctttgaaccggctttgttatccagatgcttcttgtattaatgaggtaagtaaatctttgacatatgctcagtatatttatatgagaattatctttttccttttctttttctttctttctttttttttttttttttgagacggagtctcgcactgtcgcccaggctggagtgcagtggcgcgatctgggctcactgcaagctccgcctcccgggttcacgccattctcctgcctcagcctcccgagtagctgggactacaggcgcccgccaccacacccggctaatttttctgtatttgtagtagagacgtggtttcactgtgttagccaggatggtctcgatctcctgacctcatgattcacccgccttggcctcccaaagtgctaggattacaggcatgagccactgcgcccggccgagaattatctttttaactttttgaaaattagacagtctcatttcagcgagcccagttcgtgggctagtgctctgtgaaaccaaggcggagacattcctctacctgtgagcccatgtccctgccaagagatcatatttcacacgttttggccaggggcaggattctacattcaaacacctgcacctttcatgtttggctgcaaatagctggacagttattatgggaaactctcctgcggtgatttatgcttttcttaaaggctagccctttccatgggggaacaagtccttctggggcccctgggcattaaatgttttaacctccactagccctgctgggggaggaggctgcaaatgggctggagccgtcgcagagccaaaaggaccacatccaggagaggaaaaatcattttaggaggaagataatggaaaaattcctatttctatcttgtattttgaaaaactgcttgattatagtttagtcaataaaatgatacaagaaaaaagaaaagatttatttaaaaatatagctgtctgatcctcatgttctaggaaatattgtttgtcacaatgcaaggatcaggcacctgtacctgttggccaggtttttgtcggtttctccttctggtgaagtggcatccccagtcaggacaatcgtgggagttggactgcaagatactcctgcggcaggaggaccctgccggtttagaacaaaaacacagagttaggcttgggctggtgggacttccagggacaggagccagagcatttattctcacatcatgatgctcagagccatcttgataaggggacaaatgcagtttactctttattcccccagctttattgaggtatagttgacaaataaacattgtatatattcaaggcacacaatgcgatgttttcattaccttgatacaatgttttgatacaatgtgacatattcacggcatacagtgtgatgttttgatgtgaaatgattaccacagtcaggctaactaatatatccaccaactcacatagttacctttttgtgtggtggacaatacttagcaaattccaagtatacaatacattattaactacagtcaccgtgctgtacgttagatccccagaacgtattcacctcataaccaaaatagtaagttgaattctttgaccaacatctccccatttctcccacccccagtcactggcaaccaccattctactctctgtttctgcaagtttgaccttttaagattctacatataagtgagatcatgcagtattgtctttctgtgcctggcttatttcacttagcatagtgtcctgcaggctcacccacattgttgcaaaaggtgagatttccttctttttttaaggatgaataatattcttgtgtgtgtgtgtgtgtgtgtgtgtgtgtgtgtatacagacacaatattttattgtgtatatatttttcacattttttaattcatccattgacagacatttagattgtttccataccttgtctattgtgaatagtgcacacatataggttatttggattactcagaaaacaaaaaaggcagtttctcctttattccccagcaggccctcacctgagcttaacacggtccactattcatgcactaagattagggacactacaagctatccctggttagttctcactagcaatgcaggaaaagaatggtacagagtcctcagattgaggccagcctggctggggaagaatgatggcctggggaaaaggtagtggcacccacacacccctgaggttccacgacagtcctacctttgggtaactttgacatttcagtgatcgtaatttgttagaagactctcctggggttttctcttaggtccttccatcaacttaagagggtgcctgtcattttccttctcctccttcccacccccttgactggcatgtgctgccactgctccctctgtgagcacctgactgcctttgccaaaggcctgcctcctagcgtcccagagcatgttgctgccacctccactattggtgctgcctcccgcagcttcaaagcagtgggtgcccactgtctctattgccactttccctggtgggccaaatccttctagagcccctgcatatgaaatgttttcacctccactagccccactggcggtgggagctgccaatgggctggagcctctggcagagccaggctgtgttcttgagccttcagtgtgcaggtgttggttccctgcaaggtagggaggaggcctgctctccttttgacattatgccttgttgtgaaatgggtctcatacagtgctatctggacttcttacgtcccacaatttttagtgaacccagcttttcccattttcattttcatctcttcccttctttggccccaagcataaggccacatgagctggagaagtctctgggtgagagtccagctggggagcaccatgctgcttctcttgtggaaaggatgcttttatgtggaaacccagagccagatccttgaggagatgttcattgggctctgtgttcttatccgggagcgattcagtgcagaaagctacagtggctgaaggaagaggaggcactcagaatctcccgggacatggaagggaagcttgggcagggacgtgggctgtgtagaagcagaaggaagcagcattgcctattggaagggtcagacaaacctgggctcaaatttcaactactagctatgtgtcgtggacaagttatttaacctctctatgatccatgattataaagtctaactcacaaggttagtgtgaagattaaaaataacattgataaggtacctatgcatgattgacatttttatttatttaatttatttagtttcttcagtgcagtggcacaatcatagctcgttgtagcctctgcctcctgggctcaagtgattgccctggttcagcctcctgagtagttgggactacaggtgtgcaccaccacgcctggctgacttaaaaattttttttttagagacagggtcttactatgttggccaggctggtcttgaacttccagaatcaagcgatcttcccacgtctgcctctgaaggtgctgggattaaaggtgtgagccacgatgccaggccatgattgatattctaaatgtgctaagcatctagcatatgattaatgttttaaataaatgtgtacattactttagatttctttctctttcaacaaacactttatggttatccaccatgtgccaaaagcaacttgagatatgaagagaagaccctaaagggctcgcagtcaagcaagggatacagggaagtaactcataataaatataaggaaacaagggatggaccacattctgtgaaagctcagaggaaggaaaagaaaactctttagtgaggggagttaaagaagactctatagaggagtggacatttgagctaggtcttgaaggatgaataggagcttgcacgacaaagatgttagaggacaggatttggccaaagggaatcgcattagcaaaaggcattactgggaatcagggatttgtcagtgtagctggtgcaggtgcatggactatgacatgtgagataggagaggtcagggctgggggaattgtgaaagtacaataagagattgagccagcttctgaaggacctcgaagctactctaatgagtttggtctttatggttttggagatgggaagccctgaaggttaggcttgagaataacttaactacccaaagggaaatacagaaatgttgacagcagatcatccatgcatccctctattcacactggttgagatgacagaagaggcccagttattagaacatctatcatcccctataggaattctgaggagctccctggtaaataggagctgtgtctccatttggaaacctagagctggccaagagggagtgacaagaagtcagcacgtgcttgtggctgaaaccaagactggctgacctgtcctcatgatcccagagctccagtccctctgaggacacagatacccatccttctgtcaaggactccccctagaagagacacccagggagttttctgaaaagcaacaactcattctctggatagtatgccttgatgggctggtgataagcttgtcctcctgtggctttatccctccgttcctataatggcacaatggccaaaggcctgctctctctcacaggaagattatgcaagtaaaaagaaatgacgaatgtgtatgcactttgataagtgtcatatggtctacaagtacccttgagtcatgattattattaaaatgaatgatggctctattcaaggtgagccagtttttcccatcttttgttcagtgggctcccctggtgggaggccagcaagcagcagaggctggggtttccaggggaccagaagagaagtggaacaatgatctggggccccgaggacatgcagtggaacagtattcacaagggctggggaggttaagaaggggaagcagtgtgtcaaatggcaggtagccagatagagggggcagcaggcagggccaggggcaggtgccaagctaaatgggagagccagggaagaagaaggaatagggagttttctactgtgtgggttttctggtgagtaggaagagctgaagtctttccagaggaatctcttcacatcattaaaaaggagtagcattagcaaaaggcattactgggaatcagggatttgtcagtgtttctggcaggtgtgatctcttggatgtcaattaagcaatcagcatcctctgatgcatattctgagctcagaggtgcaaattagagacccatgtgcctgtttgctagtagtgtttacaagtttttaaattagttatcaacattccataattgtaagaattcacataaaggtctggatagcctgcttttccttaaactgaaagatcaaacaatcttaggcccatatttctgcagagtaaccaggtttgagctatcctaaattggctttcttcagtgatttgtgctccctggccccaaatgcatctgagttactgccctgtgtcatgtagttttcatcctggcctggttttccagagcacaggaggtttgtgcttaaaatctctcccacccacatcatctgggcagcctcatgcctatcaccatgggaacgccaatggaaactctgactgtgcttatagcatgcgcgggcttctttccctggattttattctgactgtgaaaatttgagctctgaaagttgcctttttcatgtctgtcatatttagagaatttctttcttgtatgagtcctctgatgaacaagaagaaatgcattttgtctaaaatatcattttttacatgcattctatcatatggtttccaccaccccttgtggtggggctttacaaattcctggcatgcattgatgaggataagctgtgtctatttaaaggggcaggatgggccaaacatgagctaattccatgttgtattctgaaaaaataattgtggtggtattaggagagttatagcatatatccatttctaacagtttcatatattcaggctgctaaataagtaaaatacatattttattttatttttatgtattgttttgagatggaggctcactctgtctcccaggctggagtgcagtgatatgatcttggctcactgcaacctccgcctcccggtcaagcaattctcatgcctcagcctcccgagtagctgggactacaggcatgcaccaccatgcccagctaatttttgtatttttagtagagatggggtttcaccacattggtcaggctggtctccaactcctggcctaaagtaatctgcctgccttggcctcccaaagtgctgggattacaggcgtgagccaccatgcctggcctttgtttatttttaatcttattgacactatctacttctcaaagcaacttgaagtaaccaacaataaaatataagatataaaaacatgagactatataaatgggggaatgatggatgatttgacaaacataaatatccctagcagacaaggagaacctcatgctcctaacagtctatggttgggagttgtggttaaactatttgccctgaaacctaatgaagccgtgatccacgtggcgcagactctgagaaggctcgccttacggaactgttcaacagaaagaaaaccagcatagaaggaacttcattctttactctcacctctcaaagaacatgaaaggggaacaaatcttcactcccatcctgacctctcctctgcccttttctctttccttaacgattctcacgccccctctctgatgactcttcccctgcttgcctccctgcccagatcctctgtctaccttctttctctttttctcctgctccagcctttactcccccagctccatccagttattttttgtgcagattgtcttcatttgtttgtatgattgactcacaaacatttactgaagagtcttacagagcaaagaccttcttggagaagagaggggcactgggctggcaatgatcagattctgtttggcgtccaagaaagggatgtggtctgtgaacactcccacattattggaccttattctgtccaatcatccggcaaacatttattgaatgcctattgtggccagggtctatgctaaggtctgggaagacaaaggtgaactgagcgggcctctgcaatgcttcccattcattagcatgaaggaatggggagagaaggggaagtaacctccactgctattactaatagtgccctcggtgttgatacctaccaggtaaatgggtacaaggcacgggagtgagctgccttctgataggagctttctctgcttgctggctaatggttacctgaagcaaagctctcctgactgtaggcatctcactggggaggaggaccatggcagaggtgcccatacaaaaaggcagaaacaagccatgggtggcaagtgccaagcaggtaaccgcagacactcacaattccaagtggcttacaaagcaggaagcataaagcgattaggaggaaatcctctaatcccttgatggaacatcctggaaggttcttcacacttgccttctaatgtgtgcaaaatacacaactcataaaatcatagtgttctttccctcatcagctgacagaatcgttgagcaagctctgggcaacttctccttttctgcaaaactgttttggtgggaacattcaggtcttgtgggggctgtttttcactctatcagggactggggagacagtaatccaggagagagtgtgtgggaagattctaggggccctctggggtgaattctgccagattttcatgcagtgcacacacgcatccctgctcccattctgagctgtcaaacacaaggcaggccttcaagaaagcttgggagagcagtaagaccaaatagcgttggccagacaacctactggcttaggggcttcagggcctcaggctcagaagccacactaccttatggtatactttttagctggataaccttgggcaagttaccttgcctctctgtgcctcagttacctaatctataatggaactatctcacagggtagttataagaattaaacaagttgatatagaaataggatttctggataaagcacaggatgccccagttatatttgaatttcaaatgtacaacagataatttttagtatgtgtgtctcaaatattccatggacataactgtattctctctctctctctcgactgaatcttgctatgtgcccaggctggtctcaaatttctgggctcaggtgatcctctcacctgagtagctgggactgcaggtgtgagccaccatgtacagcatataatcatattttcattttccaaatctggcagccctagatggcaagcctgtggaagtgcacctagcactgagcaaatgctcactaagcattagatgttatgttcccttattattcccttcgggattgaattaatgactttggcatttggttttgaaaagatggttgctcttagttctgggtctcctcaaccatctggagttaaattgggagagcccagccactgtggtcacggcgcaatggagcatctctcctggggcatctgaccacataagcccaagtgatcaaggacccaccaccaaggccaccttcacccggctccactccctctcaccctctgcctctcaaaccaatcaatgccctttgtgggttacagacatggaagcacagaaacaaacatggctagagggaattggcagttactcaggcccactgtgtggtgggccctgtcccagacccccctcgtgttttctcaccgaatcctcccagaaactcagtgggtaaacctgaggacaccacctacaaattgggggtgataatgcctcccaaactcatagaattgtgaagaggaaacgagaagatgaaagtgaaggccatgagcatggggtagaagattgatatctttcttttttctcttctgcttttctattttgatctccactttatcaatgcaaaaactgacttgtccagggctgtgccgcttgtaaataggggaagtgactgaacacaggctgtgtccttcccacgacaccacgctactcttaaagctgcatccccagtttttggtctcacctcccctggttcctggtgccctgctggcctctgacactcttattcttccaagctgcactctccttcacagaaggtacctcttcctccaggaagccctcaaaccagcacaaggctgaacacacagctggagaaaaggacagcatgggcagaggatgcccttggctcactgcccttctcactcctccatgggcccagcctccctgggggtccatttcccttccctggaatcagccaagcactgagggctgggtcatctcccagcaagctcaccctctaataagccagcaggccacattttgttctccttaaataaatcttatagaaacatttaaatgtttatttcactcatagattctcaggaatgcacaatagttttcctaaccgcctgggcacagggataaatataggccagtgtcatagatgggaatattagcttcctttccccagagtcacatggctaggcccaggctaggaaactgtaaggaacacccccagccccagctccagcccactccagctcaggcaggcatggggggtttagatcctgtagatgggcgctggcagacagcccaggagaggaggaccctgctggaaggcaatgtgggctagtgaagaagtcgggtaggcctagaccagaatcccacctgggtgaccttgggcaagttactagttactaaacttctctttcatggtctaaaacattacatagagctaataatcactattctctaggcttgttttaagtattaaatgagagaaagcaataataatgacggtgaaagtggtggtggtgggtgcgtgctgtgagactgtatccccagatccctgtcttgtagcctggagggcaaacagggactgccttggtagagaggagatccagcagcaaaagcagccagtgctcttacaacaggataaaaggactctctgggccgggcacggtggctcacgcctgtaatcccagcactttgggaggccgaggcatggcctcggtggatcacaaggtcaggagatcgagaccatcttggctaacacagtgaaaccccgtctctactaaaaatacaaaagcaaaattagccgggcatggtggcgggcacctgtagtcccagctactcgggaagctgaggcgggagaatggcgtgaacccaggaggcggagcttacagtgagcctgatcgtgccactgcactcctccagcctgggcgacagagtgagactccgtctcaaaaaaaaaaaaaaaaaaaaaaaggactctctggggacttgaaagaaaatgattatcccagcggcaagtcctaggggcacaggagagagcagaagtgcctctgctgagttctgctggacatggggctcctccctgccaagcatagagggccagttccctggctccccaaaggctccccggtgtcttccctataggccctcccttgcaccaagggcctgctctgcctctggtggatcctctttcctgccattgtccatttatttctagaagtcagatataaagaacaactgccttgttcatcactgtttttactctcatgccaacagactctgggagtgtggaaaagcacacaatatatgttagctttattccaaggagagtaactcagctagtcgttcatccgtcatatctactatcctcccttccttcctcccttcctaacactactccaccctccatttcttctgccttttaatgcagtcatttagtcatctagccagccaattatctacccaacctatcacaacacaatcaagcatccatccacctttccatccatccatccctccctccctccctaagctccgaccgcatgctggagcctatgcttatgggtggagatacacatgtgaaaggcacagtctgtggcccgcaagtagctcacacatagcctgatgtgtggagacagaaaaacaaagaacagcaatctgtttcattgctcacaataggaactaagggaaaacaatttttatatgcatttccgactgtctgtaaccgtcaacatttctaaaacactttctgccttgttttaggcacttccacgctaaattctcacagctcttaccctgtgaccagaaccactagaggccagcctggtggaactgtcctcttgagctcttttttataatgatggagcatcaagcacctgtttcccatgcatggggcctctggtgtcctagctagggccaggaaaggaaggaaaacctggcaggatgacatcagtgggaaacttgagtttgaatctctatttgaccacagcacagctaggtgatctttgacaattacataaactctcagagactccatttcttcatctaaaaaatagagataataatatctaccttggagggattagaccacataccaggtgcccagtagttgctaccattatcttgtataccagatactaatattttattgataatttattttaaattattttattgaaggccttaattgaggctgttcttgcaaaggatgtgatgagataagtagaaatgaactcagagaagatgaattcaaaatcctcgatgggagcatccaagtacttcctggtttctggtgagtatagtgcccttacctgcctgttttctcatctataaagtgggatagccatcatgcctgtgtcttggagttgtcgtgaggttgctatgtgtaaagtgcctagagcagtgcctggcacatgggaggtaccgtatgagggttctcactggggaagctggggggcagggggatccctactctacacagtccttaccaggttccaagtgttttacatgctttatctggttcctcttcatctcattcctgacagataattgatcctttgggtcacacaccttttctctagtcgggcagcacacggttcccaaggagtttccagggaggtacaggcagaacctctctgttggccagtgaggacagggcttgaacagccaaaaggagtcaaatggatagagaagctggcaatctgccttcagcagtaaagtatatggctaaactcgagatattcccatagacagcgcagaacaagtctcctccaggtcctgatgggagaaggccgtgggagaacacaagagcaaattggatctgacagaactggcatttggtagtaaatctaccaggaagtgagcttcctgagagcaggaccttagttagttaatgctcaataaacatttattgagcaaattcaataaacattgactgagtaaatgtacttcaattcctcgattccatatttattgagtgcctaccatgtgtatgtgaataatcatcccttgcctctgtgctcaaactctattgcatataatggggtatttttggaatagaaataggaaaacaattaattatagcccatttcctcagcttacaaccatgagacagtggaatccgggccttgctatttccctattatgtgattttcagcaactggcttaacctttccaagcctcagtatcctgatctgtgaaatgtgcatagtcatcactaccatgtacgactgcgttctgaaggttaaatgctagaaaacactaggaacctgtgtgttagtttctttcccttcatctggataagatacctaactgctctaaattcgcactttcatgggggtgactctctctgctctgtctacctcacagtggttttgcacttgcaatgtcattgcacttgcagtgacacatgtggaaactttttgcaaaccgttttgtgctatagggactgagcgcctattgtgagctaagtactttgctcatcactttatatatattattccagtaattaaagtcaagctgcctgggtttgaatttagcctcaaccacttccttagctatgtcacccactgcacattacttttctgtgcttaaattctttatctgttactggaaatactaatagttttcccaggagtattgcgagaattaaatgagataatgtaacatataaaacaagcctaatatggtacctggcacatagtaagttctccataaaggttagctgttgttagtggctattcctataactcttagtttctagatgaggaaactggggcaaggaataatgaggaatcacttatccaaggtagcagtcaaggatgtgaagcccaagttcttcctgctctgccatgctgcttataccttacatttctatgagcctttcctgtaccttctggaactccctggctgcttggtcatcctcctcttcttaaaggacagacaggttggctctgagcccagcccactgactgagggtgtaagccaggataggcctcctacaacccttgtccactgtttttactctcatgccaacagactttgggagtgtggaaaaacacagtatgtgttagctttattccaaggagagtaactcagctagtcattcatccatcatatctactatcctcccttccttcctcccttcctaacattagccctccctccatttcttctgccctttagtgcagtcatttaatcatctagccagccaattatctacccaaccccagatttgttatggtggcacttacatcagtccctatttctgagccaaaacaggaggaaggccagcacctccatagccagaggttctaggtgctccacaagcagatcccttcctataagggccacacaaacaagactgcttctccagagcacactccaaccacatctcagttacttaaaagttacgggaggggaggggtgcagatgccactcatcagtggagtgctgcagtgaccttaagtcacaagagctactgcgtaacagggctgagcatccatgtctgcctagagcatcaacgaatgaaacacaaagtggatgctcggagagacccagagtgcctcatgcatgtggcctaaaccaggcaatagcatggtggcctgtgtttctaggagttaatgtgcccttccccttcctcaatgtgtccatgtcccttcctcattctccttcagctaagcaatcagacagcccactcaagttaaagttgggctgtttgattacctgactgaaggagaatgaggaaggggcatagacaggcatgtgacatgcagctttggttgctggccccacgagcttgtgctcctgaggggctggcaggcagaaggggtttggtggtgctttggcattcccctgacagcgagctctgaagttggcccttctgaggtgagtggctttgggaacacaggacaacgtactgttggcccaggtcccagagctctcactgaggacccaggggcagtaacagtgctcagtgcgggtatggactaagcatgggctttggggtcaggctgcctgggcccagatcctgggcctgccacttatgagctgtatgaccttggaggaaggtagttaatttctttgtgcctcagtttcctcagctatgaaatgggaatgataatacctaccgtaaggctaattatatgttaaatgagttaatatggtagacgagtatctggcacagggttagctattattattaagtggctttgtgtgcagcggaggtaggggaacaggggaggtggtagctgggtgctggaatgggtgatatgaagaggtgaagtctgcttatgagttcacactgacctgcccctgggggcttctaaaaccctttggaggaggatgggagttgttcaggtggaagctagagccggtgaaaattgggctcttacagctaacatgagcctctttgtaccctcaggtttacaaggcacttcagaggatgctgcactgtctgggtgagtcagcttcctactgtggctgctggtcacagtccaggaactcatctaggcctaggtaagattgcatctggagcctggggccaggtctggggccctacagtaaggcggagatgggctggtatgtgtcctgagcggaggttaggaaggctctgaacactgtcatgggagcaaagactgaagaaactagagaaaaagagactctgagaagactcagaactgcctttctgcatctgtaggatttcaccccactataggttgtatggagggcagaaccgagggagagtcttgggggaggcagattccagcctgaccaggacagagctggccaaccagtgcacaggcttccttgggaggcggtgagcttttcattatagaaatattcctacagattcctaccctgggcccggtggctcacgcctgtaatcccagcactttgggaggccgaggtgggcagatcacttgaggccaggagtttgagaccagcctggccaacacggcgaaaccccatatctactaaaaatacaaaaattagccaggcgtggtggtgcaggcctgtagtcccggctattcgggaggctgaggcacaagaatcatttgaacctgggagacagaggttgcagtgagctgagatcacaccaatgcactccagcctgggtgacaaagcaagactctgtctcaaaaatacaaagatatattcctacagattcctaagacctacctcaagagattccaattcagtaggtcttggatggctgaggaatctggtgttcaaaaaattcccagggtgactgagtggggctcacgttatagagagctttgcctgcctgggcggagcttagatgtgacctgggattcttctagcactggcagtctgtcattctgtggtcccctcaggtcccaggcttgtgttctgacagcttctattcctgctagaaccccttggctacaaactcttccctttgagtctctccctgttcaagggccaatgcagaaaaccccactcaggacatagccttacaaagtgcattgttggggggctttttgtggtatttgattgcagcttctgattaaggacctgaagagtacgtctgtctgtgcatgcctgtgtatctgcgtgtgtgtctgtgtgtgtgtatgcgtgtgtacgtgcagaaagagaaacaggatctagtcctacagattttgtgtttgtgtgtgagaaggcctcggctagtgctcatgccagtgatgggaaataggggctgggacctgaggaatcacaactagggctggaccccggggagctgtaaacttagaaggatgctctgttctttgcctgcttcacagactgggaattcaggcaggattgggacttccagccgagtcatcctggccaaccccgcttccttggctgcctggcctcggatgctcccagggactcaggttccagccccctgaaggctccaggccagctcctgaggcctgaccctcccgaggccgtgactacctgagaaacccaatgtgggtggtctggtgggtgcaatagtgggagaagcactttactcaccatgcctggttgccttctgaaaagctttgaaatgtccagggcgtggcagtaagggaagagggtaaaagaaagttgagtttgatgtggcctttggttgggggggtctgaactgccccagcttcatggtccctcaggctatagaaggcacttgagggctgggctgaacaggcagagtctaggaggcagcaactaacccttgtactgggtaacacataagaaaccagcagcacagcaaagttaacagacttggtctcaaagtttcttggccaagacaaggtctcttgaccagaatgtagaggagctgggattgaagcccagcttggtatgactgcacagtttacattcttaaatcctgtgctaggtatcctccctgataggacctgggcttctcggctcccggctcccctgaattcctgctggccttcctaaccatcacagcttcaaaatgcatataggtacagtgccattaggttggcatgatgaatttctagaggttgccacaatggggggagggttccatgagcttgcctgccacaaagttgagagtaagcgatccctgattggctagtgggagctccaaattccagttccccacaagttcagtctccctgtgaccctgagccagaaccagactcttattaaataacggatggtctctgaaggcccttcaagtgccatgattctctctgtgcccatgggaaatcaagactatagagagaatgtttgcaggtactgatagcttctgcattattggggcccagcagaaggacccatgagggaagaatgcatgagtgaacattatttttacaaatgggtagattcttagtgaatattctcatgttatgattacatttgttttcttacacattacaactctgggaacttaagtaacaaacactttaaaaagaatggccctttggatctccatatcccaaacccatgggatcaagatgttgtagaacttggcagtcttgtgggtggggagatgcccttcccttgaatgtctaagtgacaggtgtctatgttgtcttgttttatgtttcctgaggatatactctgaaagaacttttaattataaagcattgtaagcaggaagaatttaatataaaagcctgtcttcactgacagcaggggtgcatctttgctgatcttttattatcttatattttaggaatgcttttagtcttggggcagctgtttgggggagttgcccaggatttaagagctacattttgcctgagaatctgattcaagggtactaccattgttagtaaagtagaaggggccagggatggccattttcagaggagtccagggcgaggaaatagggatgctaaggagacagaggccaagaaagtcatggcctgagggtctggaagcagtcgcatttgaatgcagttgtgagtgttttgtctctcctttccttaatccccaagcttttggaacttggcaccctcagcagcaggacccactatttcccagaatgggggcctggacttgataaaaccctgggctgggctgcctgaggctgaagggctagggggttggcccactgtcacttagacattcaagggaaggacaaccccctcacccctaaggctgccaagttctgcaacatcttaatccgatgagcttgggatatgcagatacaaagggccattcttttctaagtgtttactatctaagttcccagagtcgtaatgtgtcagaaaacaaatgccatcataacatgaaaatactcactaagaatctgcccttttgtaaaaataatgctccacttatagattcttccctcacttaaaaagcgtctatcccacctggctcaggtcagtttggatgactgtccgatataacaggacaataccatttcaatgcaaatcaactgcaaagttcatgaagtcaaagaaaacagtgatggagaattttacatgcaaggtctttgaccaaggagatcagatagagcttatcaattaagtgaagaaaatacgacgaggatgatgctcaaataggttcttcaaaagggaataatttgaatatcgagggactgaaagagatccttggggaaatggatgaagcccttaagtattaaacagacgtagactcttaattaggtgctgtaaagtaaaatgtgaagagcgagttactatgtgaacagatcactttgctggtataataaataaatatacccacaccaaaatcaacattttattctttcttcaatctgaaaattagcacataacctatattttgtaatctgtatagctaaaaatagcttgttttgaatgcctcatttgtacaataaaaatcttgatgtctctttaaattaatctgctttcatcatttcctttctataataaaatttcactgaaaaccttttttgctatttactatacaattttgatctccattttaagtggattcactttaagtggccttttctcgtgcccactcacctgacataagaggttctcagtgctaatggttctcatataagtccttctccggtttcagagggagcctgcatggtttgtggtttgacttctgaggcctcagtcagacacagcctagatggttggttctatacccagaatatttggggcctcggtcaattcaaaccaactcagagtaattgattcctcagtatggaagccacacaccttctccaggtacccactgcaacctacatgagctgtcagcaaaccctctggccagcctaaaagctgtggcctcagcccagggtgcttggcttggcccccagccaggctagctgagggcagggagggggcacttacttggccggcagggctctgggctgcctgtggctctccggggggctcctcgtcctcgggaatgtggggcatggcagcctcctgctgggagtggccacgtgtgcccggaacctccgctgcgtcagccccaaagatgctccaagaggcctgggctccacaggctggggagatgccaaaaggacaagtcaaatccattcccatccctgtcccaagctgggttccatttcccggagccacaagccacagtgagagccggcttgagtttgcatcaacaccggaggtcaaaccaggctaggagagggcatttggaatttcatttcctccggctctctggctttgtttacaaagtcagaggtgaccttagagattttgcatctaatttggtctttacagtaaacacagctatcccagaagggagaaatgtgcttcgaactcctcaaagctgtagctaatggaagatactccattgagatcacattggcagttgtttaccacttactgagcacctactgggtgccaggccctgtcctaggagcatcaccatcatctgattgaatcctcaagatgacctctgatgtaggcattaatattcccattttacagatgagagaaccgccccagagagtgaaagtcacttgccccaaatcatacagagaaccaataatttgaacccagatcttcctgattttgaggctggggctttttctgctatactacacagtgttcctcagccatgtggatggggagtaagaggtgctgtttcctgacttcctccctgacacctcccctcatgctcttctgaccctcagcacaggctctctcatttgagttcagcccttatggggactacaccagccctactaaaacctgggggctcaggcagggtgaattccatgtgccctgtgcccacccctggcaaccttagattgactcccagaagccaggctatcccttccccatggtgcagcagcctgggggcactggggtcccagtgctgattgggactgcaatcagcataatctcatccacctcccacagtgactggctcagggatagacaatggacccagcctacatcgatgagcttaaagtggtgttctaggaccagatgctttctcctgctctgagtggtggagtgtgaagatatgagacctggtgctacggacactattttgcttccatgaggaaagccagacagaatctaaatgatacacacagaggagggcagagcgaagggacctgcagagaaacagaactggagccctgattaaagtgtgcctgaagcctgaacactttctggactagctggttacatgaacaattaagcctcttggtgttgaaatcactttgtgttgggtttttgttccttgtaactgaaaacatgctccactactctttcgtgcttcttgtctgtcaagatgcctaggagtatgatcctgccaacagacctgagccaatgggtctagctcctctgcttcctcttagaagaggagactagcaatgccaggtttccatagggaaaggcaggatagcaatgtagaaagaacacaggctttggaaccagatatctcggtgtgagtcctcactttgccactcactggctatgtggccttggaaagtaggcttcatctctgagtcccagttttcttgtcaaaacagataagaatgcctcccaagcaggatgctccaaggatgaaacacactcagttcacagtagttcccacagaggccacctgcacgggggtctgcagcccaggaagcttggccgaagctccaagggctctgcctggcctctccccatccttaaactccctccttcttttattagtggggtgggcaataccttcaggaatctatagaactaacaactggcctggttctgcaacttttagagattccctgaaggagctgctccactgcacagtagattaagaccaccatgcagataacatagtgaggtgacctttggctgatgggacatggtgggtgggggtggagatgaaggacactgtcatttactgagcaccaactgtgttccaggtcctctggaaggtactgctgactgctggaggctgtaggaggaagaaccggaaagccctgccacctcccataatacttggtgttcttcctgtccttcagaaagggctcggaaagcccctagagtcagggcactggagaaaaggcctgagctgccatcagcccagctctgacagaccccccagccaacacacatacctctagactcctggactgagctccttgagctaggcaaggtgtcagattcatcctaggtacccaaaagattcagcaaagaatgattgttgatttatgtttaaagaactagggacttttagccccaggattggtcaaggtgaccaccatcttgattgctgtctttctctgcaatgaacaagttagcccacacagctctggaacagttagggtgacccctactggtcacctcaagaaatctcaagtagaccatccatagagtcattcattctttcactgccaaaattttacacctactctaccaggcctgtgcaaggggctggtgacataaagataatcttggccttcaaggaacatagagcccagtggtaggagacgctggagaacagtataatggggtaaatattttgaaagtgagaagttgcaggaccccagaaaagggttacctgtgggaactgggatggtgggacatgattttagcaaatatttcacattacaaatgtttgagctgagccgtgaacacaaatgctgagtggaatttcttggaacagattagctgggtgtctagtggggaagataagacaggatggggagaagccacattggacagacttcacctggctcttgggaatgagaactacggggccagggcatgctgtctgtgtcttccatgccaaattcttactgtatgaataaactgagcatcaggttcacccaaaggtgagctctgtgattaatttctatcatctttacttggatttcagcagcagtggcatcagtggtgctgggtaaagtatttggtaacaggggttgagggtagcaaaagactagccacaaaccctgattctactaaaggaagttggctacatctcataggaaaccttttaaaattatgtgtgacgtatgtacaggtccaggctgtcttaacaggggcatggtttctaaaacatgggaggtgactattccacttttcttttgtcttaatctacacaaagtatattgtgctctgcctgttaagaaggatttagacaaattgggacatgttttgaacctgggaagcaggaagcaaggagaacaaaaatttgtgtttaaagaactagagaactttagcccggagaagaggaagtgcagggagaaataaaaatctcttctcagatgtttggaaagcattcatgtggttttactgttcccaaagaatagatgtcataactaatgactgaaaggtcagatgaaggcaagggacgaccttctagtggttggaaccacctgaagatgaaacaggctgttctttaaggtagtgagtccccattccttggagcgttctcgtaaagcctgggacaagggtcacaggattcctaaccacttcaggggccttttctaaccctgggagtccctgaaatcctggactctttttagctacaacaaactgaaagacctgacgattccatcccaggactctgggattatggtctgaagtctcatgagaaatacctcattttttaaccctctactttcttcctccacctccctctcttccaaaaagagcttaagtcagtccctgtgacagaaagcagaatagaacaaatgagttaagtcagatgtcagctgccacaacataaaagtagagtggatgcttgctgaggccccactcttgacaagatggaaccccaggctcctcaggggagccccagcagccctgcctgcaggggccattcccacgctgctcctgccctgtttgctgtctctcccatccattattataaactcgctgcttaaaatagcaaggtaaaaggagagtccctgccccagggtgacatctgggttctgctggagcttgtgggcacacggacctcacatccatcactgcaaagtttagaatataatctccaggaagtgctgatctagagcaccaacccataaaaggaaaaaatatttagtaatgtttggtctccaagctgttccttctttaacccattttcagggcccttcttgctgcctctccagtctggttcggaaagggttaggtaggccagtgccaagagctaatcagcttttatgactctactcattctgcctccagctagtgcctaactagaacctggcccattttacaggccgggaaactgaggtgcagaaacggaaacaacttgactggttcagctacccttgtatctggtgcaaatcttccaagagactctgctgggataactatccagtaatttgtgcaactgaagaggctagaagttcctaaaccatatttaaatattttatctgcccctgctcatgaaagaaaacaaactaatatgcttttgttcatgctttcattcttcagctacttctaagtcgcctactgagcatcggacactatgctaaatgtatttcaagtgctattttctttaacccccatgagataggttttattatttccatttaatatattaaggatctagggctcagagaggttccgcaacctgctcaagatcacacagctagtaagtagctggtgaagggctataatccaggctagtctgactcctaggcccgccatctttcctctcttccactctggcttcttcaccaggagttctgcttgagtgtggcagaaaagactagcacgggggccctgcctcccaggggagggctggagtgagtactcccagtgaggctaaggatggtgggaggcagaggggaggaaacaggacctacacttcggttgtcgggccggggtcttatgagggctaaagagtggcctacagttgagcctgcatgtcctctggtaggtggtagcagcaggtggaggacgcggaggccggccctgccttgtaggcttcaaaggccttactgtatcccagaaagtatagagccatcatcgggacgcacggttcaggaacagaatttacagagactatctctttcagtgctgtcagcagccctgtgagatggggagagtaagtactattattattaacattaaagttagacccatgttacagatgaggaaacagaggcccagagacttgcccaatgtcatcgctcatgaatggcagtgctgggaattcaccgaatctgggtctgatgctccccttccttgcagggccaagcctgttctcggcaggcagcagcagcctctcatcatggcgccaaagatgcctctcccagagccttgcaacctgcctaggagagaccaaactcctctctgaaaccacagtatcccaggagcacagcccgtaagctaagcggctctcagattctctctgtgaatctttgagcattgagggaagagccaagaagccctttcgggaaaccatgggttaacctagcctccactgacctttctggagtgactcagtattctcagaagggagtttttttgttcttccagctttgaatttttgctttcattttagcagcacaaagaatgtgaaagagattaggttgctattaataccacgggtctatctctagatggacaactgatggggggaattgttgggggtgactgcacgtggagctctcttagcccttctgcaaatccagagggtgatggagggacactgagaactcaccagtcttacccctgcacccatttttaccaatggggaaccgaggcccagaggggcaggcatgtgaccaaggccacatctatgagtgaggggcagagtcagaaaagtccccagagcacccatgccccgagcccggctgcatgtggcagctttctgacttttcattttgacggttttgctcatagtaaagggtaagccattgtgtctgtgctgtgaaagcaggcgtccttcggcagtgactcgtcattgttcttgctctcatgctctcatggtcactctcgcaggagagaggatgctccccacaggagatctgctgaaagtgctgggaggtgcctctgggggtcccctgggcctggccaactgcagagctgggttccgcgactccacaagtgagccggatgggaagcctgccttgggaaagccccatcctgcttcctaaccttggcctgctcacggggctttgttgcttggcagattccgttctaatccttcctctgcctctcccttgctggataaatctcccctggcctcagttccctcatttgaaaatggaggtaatagcacccaccttttagcgttgttgtaacgattaaatcaggaaatacatgcaaggtgctggtacatagagtccactcagtgccctcgccattctccaaacagggcagctgagttctctaagcatgcacagcatcaacaaaaccaagccaaggctcagagagactctggtgttcatcctagtggctcagagctcccagatttgtctcctgcaagtaaaagagactcagtcctggtctttgctgtggacagtcccaggtctgtgctgggcttgccccatgtctgtgctgtgctcagtcccaggtccgtgctgtggtcagtcccaggtctgtgctgtggtcagtcccaggtcagtgctgtggtcagtcccaggtccgtgctgtggtcagtcccaggtccgtgctgtgcttgccccgtgtctgtgctgtgctcagtcctaggtctgtgctgtggttaccccatgtctgtgctgtgctcaccccatgtctgtgccgtgctcagtcctaggtctgtgctgtggttaccccatgtctgtgctgtgctcaccccatgtctgtgctgtgctcagtcccaggtctgtgctatggctgcccaaggtctgtgctgtggctgcccaacgtctgtgctgtgctcagtcccaggtctgtgctgtgcttgccccagatctgtgctgtgcttagtcccaggtctgggctgtgctcagtcccaggttggtctggtttcaaagccccagttctttccactatccctgtactcatgatgactcccccaaaacagaggtttttgttccacaggtgagacatgaggcctagtgtggaatccctcctggaagagagccagccacagtgtctggccaagtaggtatttgtgctgtgctgaacaagtgggtaagtgagtgactgaagggggtacagccaccccccagtgtgtggtggaagccccaggattctctcctgaaagtggatctagattgaagggaattgtgcaggagcaggaatggtgaagggcggagatgcagggagaaagcctcggtggcaacagaaaagggaggatgaggaagtggaagtcacttcccccaagactgtgtcccctaaacaaagtcacgtttcgggaggctggccctgagaaccccgacaatcctggggtttgcacctctgtgggaaaccttcttagggcccgattttctccagccctgctctccgctcctgtggagctcgtataggctttgttggctgggggtgccctgggaaggagccagcacctgctcagaccaatgacaggaaataagcctaaacatctccccaggtttcctttccagcttgttcacttcaggaattctttttttaaaaataggtccacttgaaaaaattttttcttcttcaaaatatgtacaattgctcaatcggaggcagttcaaaggcaccgagaatagcagcaaagtatctgagcctcccatttagcgcctagcagatataaatcttgcccagttctgtttgttccaggctgctcagcagcctcttccctgagtcactcactcaagagtgacatgagtcatcatcctggggtcaaggaccacacggcattctgggtctgtgagatcccataaagggcagggcaccgaggggtctccaggaagacatggaggatcaggaactgtctcctaggccctaggcttggctctgcctccccacatgggtgactttagagagtcactaagcctgagaagtaggtggatttctgggcccttctaacttgtactttggaggaatctctttagtggtgcacaggagcctgcttgttccagctcataagagtctaatgtaattttcaagaattctgtgaactggtggttaaacacagacattattaaaaaataaattacatgaactcacattaaacaaaaaggagataaatactcaaaataactgctttttaattattttactacattttactattatctatgctcttctgaagatttatttctattgtctctgcatagcggaaactatataatgatttgctactgcccatctcttctcagttccatgatcagtgagggtgagttagtagcttgccattggtcatagtgggagtatctataccatggaaattggcaaacactatgtacatatcagggccttttccccccagagagctggccgtggaacattgccagcacaccactgagctactcagccccaggctccctgattcttgctcctaccagggtgcagaaggaacacagatgactttagtatcaccccaagatagcacagttatggagacttcattgccaattgtctttggacaacttttcccaagtggactatgaatcccttatcctcaacacatccctgacagagctcattgtttctttccctccccagcccactcctcctgtgccccagagaatggcactcaagctacaaacctagaagtcaccgtgactccttcatttctgtcaccctccacattcaattagatgactctgagtcccatcaatcctagttcagaaatgcccttcctcccatccctggcacccctgcccatggctctgtgtgacctgagtcactgcaacagcctcatttgtctccttacctctggcctggtcccttccaatgaccctccataatgataccagagcagtctgtctgaaacacaaattggatcatccttccccttcataaactccttgaggattgattcccttttaccatgggggggccagttctgagtcaagctcctagcccctctctcgaggctgatcccctctttcaacctttgtacaccttatgccccaaccacagtggaccaaaagccaacctccaaacatgccctgcttttttacaccctttgcatacatcctcctccttatacttgggctgccttctgtcctccttctatactttatgggttcctacttgtcctccaagacccagttcacatatctcctccttcataaacccattcctcctcttcacctcaggaaaagttactcccttcctgtagtagtttcctactgcgtctgtaccaaatttccacatatttggtggcttaaaactgcacaaattcattatcttacaattcttgaggtcagaagttcaaaatccatctcagcaggctaaagtctaagcatcagcagggctgtgcttcttcaggaggctctaggggagaatccatttcctgccatttccagctttagaggctgcctacattcgttggctggtgacccttttttctccatcctcaaagccagcagagtcgctggcatcttttctcccctctgatctctgcttcccccttcacatttccttctcctctgactttcaccgtcctgcctccttataagaactcatgattacattgaacccgctcagttaatccagggtaatctccatctaagtattcccaatttaatcatatctgcaaaggcccttttgccatttaaggtaacatcttcataggttcctgggttaggatgtagacatcttggggaggggggagtattcagcctactgccctatcctcccagggtactttgcccagaactcaacccaactagaatttgaacatctcaagagcagagactctgccttattcatagctttatgaatattcttataatattcatatttttatgacctgcctccagtacagggtcaaacacagaataggcattcactaaatgtttattgagttaataaatgaatgacaccgtatttctaaaaagcagagaagaaggttttacataggctgggtgcagttgcccatgcctgtaatcccagggctttgggagatcaaggcgggtggatcacttgaagtcaggagttcaagaccagcctggccaacatggtgaaaccccatctctactaaaaatacaaaacttagccatcatctgggttgctatataagcaagtgggtggccttgcctgccctcattctcattgagcttccccaggttaatggccaagtttttctctctctcgatgatgtacccgggtttcatgtcttctctgccacacagatgtgcaaatttctcccatagtattctacaactaaaacctcacaaaaggccagggcctccttctctgacaccttcatgcttctgttctgccatccaggagtaatttgcaaagtgaattttcagattaacttatcaatggctcttctagctttaacctaagcctaacagaagaccacagagcagccccaccagcccctctggctccgcttggaatgctgaccaaagcatttcctcaaacagttggttatgtgtgttcaaatgcggcagcaccctcgtgtctgctgctgtggtactctggaaccacctccttcctgacagagcagagccgggaggctttgcaaggtggtcattgcctttaaacccagacctggactcatggcttgattcctgctccagcaaaggcacagactctggtattaggggtcctggcaatccagcacctgggattgcccattcccatgaagcaggcctctgggaaatgtaccttatttcaggtagaaggcaggaggcactgtacccacttgatgggatcgcactaggccttgatggccttggttctttcagaagccaacatgtgggctgaatctgagccaacggcctcttccttggatctcccggcctctgaacctgaagatgcccttttcttaggatgggagcaaggatggataaaggcaagctggtgttttgtccaggcccagagatctgtcaagggccatctagaccaccaggaaccagaagaggcaccctattgccttggattctttagaaactttgttccaaataaaaataaagcttccttgacttggcaacaccacagcccaataaataaataaataagcaaaaaaagaaaagaaaattaacacccagttcccagtgtgcctctctcattcagttcctcctacttctccatcatctccccttcccttcctagttttcttctaggaagaggtcatcagggtctattaggaacctgtaggaatacatataggaatataggaatatatgtaggaactggtttgggaaagtcagaaggaaaagatggcctccatggtgcctgcctaaatcattcacccattctagaaaagcttgttgagtgcttcctatgtgttaggtactgtgctgggcactggggctctggggtgtgtcctccaaggccacctcctccaggaaggcttccctgacctctcctggaagctatattctcctctggtctatgacagcactgtgtggctatcccaatctgccaagcagtggtttctgtttctcatttgcaaagcctgagggcagatagctttcttttgtaacacaggtacagagaaagttctcaatacctggtggatctcttcttttgaaagcaaggactctaggaatcaagcctcacttttcacatggcctactacacacccagcacaatgtagatacgctagctcttgaaccatctcaggtctgtgagaaaggaattacttgtccattttacagatgaggaaatggagccttagacaagcaaagtgactcgctctaggtcacacagtcagaaggcagagtcaggattaaacactgggtctcctctgcccaaaatgggatgtttggctcttccttagagagagcttattcctatgcttctctaatcttagcaaagacagaacaagggtattaggagatgttttttgatagggcagtgctcttgatcattctagatcccagctcttcctcagggccagcacagccaacaagaacaacagcagccgagacgcagcccctctccgaggaactggaagtccttctcacggcatcccctggggtagacaggaagcagctgcgactgtgatcatctaagaccagcaggagagagtgttcttccctgctgggatggagcaccccagctcaggtccccgcctcctgttcatctccactctgggaatcccagttctccaaagccatggaaataggcccaataaccttgggctgggctgctgggcaaagtctggtgtaaagcatgctacagaaagctacagcaggattgagataggggttcagggacagggccttgtggggagtgaagagcagactgccatgctaactgcctgtgtaggaatgagttccttcaccattcaggcctcagtctctccatctcaatagtaaaggctgggctaacttgccagcctgagccctgctttctgccccatgagttcaagttcacgttgcctattgaaagcagtcacacagtaggaagttaggggccttcctggcatcccagggctggaagcagccatcacatccccctgatcacagtgattggctggagggtgagcatgtgagctgacaagaaccaatgagatgcaagaagacattactgggcatcctgggaaagccatccttaactgcagccttgagttccagagggtgaaagcagaatccctcttaagatgatgaagaagaacttgtctaaggatggaatcaatgtgagacagagcacagctaagagccagaaagaaactaggtcctgaggctatcttctcagatcctgatcaagccatgcctgatatccccagccttttctgttttgagaaccaatgaataccccttttttcttaagctggcttgtacgagcttttttggcacttgcaataaagagttccaactggtgcaaacagcctatcctttataatgctgcctgtggggactttcttggcaccaagtcttctctcacctctctactgtgctgcttacctaaccctaaccctaaccctaaccctgagagtttaagctgggaactcagatctagagttgatgagcttaccctaagttattccctaacttagaatatcaccatgcccttttcctcagaacctgttcctctttctgcattccctgctaccattggtgggcccagcatctggccagaaaccccagcccaaacacagaaccttctcccacctctccaggatgcctgtccccacttctttttactaatacacacatctaaactgttagggctccagaggagtgactcggtttgaccaacctccatgttcctgcctagacgatagactggtacacaccaagatatgtttgttgagtcaaatttcaaccttcaaatgattttcaaacatcattacttcctgggggcgaccactccacctacctatccctcagctcagagctggataggctctcactctcaaccctccccagaagagcagaccccaagaccgggacaatgattggctgtgtgaacaggctcgcagccctgtgcttggaaccccagcaccagagtttagggtggagactcccatgtgcaggacaggaaggaagctcacaccttgccgactgaggccagcagcagggtgggagcagctgtggatcttggccagggtctttttttcaccaatagactctgagctgaactgcaggatggtgggtgtgtacacaagaagacacgtgataaagtaaaagtgagcagtcccttggttatccagatgtatgcaaacagctgcattagctgagtctttagacccaagttgagaacaggttatggtgaacagtgatatgcaatggcaggggtgggtggaagccgggagggtagagcctgggaatggctctcccaacagcaagctttggtgattagaggcccatgtatttcaaggtcctactgcttaaatgggcatgtgcaactgtgactgcctaatgatatgagattggaagtaaccatagagaatttctccgcaggggagtcatttttccaccatggagaggtggggatggtctgggagtaattctgaggcattagcaggagagaaactgacatttattgtaccaggtgctctacctgactctttacatcctttatcttatccagtccttacaacagccctgcatggtacgattattcccatcttacaggtgagaaaattgaagctcagaaaggtgaagtaatttgtttcagacatcacaattactaagtaatgttaacagggtttgagctcaggggagcctgactccaagcccagggttctgctcagtataccataatgaaggcttctaggtcaatacagagccaggcgacagcagcagcaacaacttcaaccaaaaatgaaatgctaacacaggaccagaagaggtttttctggctaaggcttcaccagtttgtcatcgtggagaaggtatcatccctaacaatcagatttacctatgttctttgttaacctgcagtttgttatacatgcaatagctctgcttaagttaactggtaaatagcatagagtttatccaacgggttaagctgagtcattctcgtgaagtattttcttgtttttagaaaagactgagtaaagagagctctgagggcaggttaaggccagggactgcctggagatgcctcagcagttttgctggagctgttctgggctgtgagtgggcaggcaggtgagcagacccccttcctggcccaggttccacaaggagcataggcactgggaaatcactgggttttggcagggttttcttggatcacactagcaacattaccaaggcctgagtggagctcctgcaccctggggaacattttcccagggtagcccccaggctccttaggtcggctcagacacccctctttcctgtgcccacagttggtatttcctagttataaaatgattttttcattaatgctatgatagaatgtagaggaatgtagatatttttaatatgacaacatatgtttatagaacagaagttttttttttcgtttttttgtttttgtttttaaagcacctaatttggagtcaccctggatcccagaagccccaaagtcctgggacattgttctcgtggcctttcatctcttttcctctgatcttctggatcccctacacagggcccttcctctagggttggcagagtttgggaaaagcaaaggccttctagggccctgggctggaatgctggctggggtatggctggcaggctttgtggttgggactggttgggagcagcagctctgctctgctcagcctgcaggtcagcactggaaggcccaagttgggcaggggccccaggacaggagggagggagccgctactcaatgctttcctgatatcctcttactgcctcagttacctcccaattccctactcataaaaatctagccatcctgcagccctattcattctacatgtccagatgagaaaagctgataaccagaaaatcgactcctggggtaggtggagggtggttctcctatgaagtaatccatcttccacacagctggaattctaaaacataggtgtggtcgcaggcctccctcaagtcaaacatttcaatggctttctgtgtgctgactcccaagtctggctgcttactaaaagcacctgaggtgcttgataaaatgaagattcctacacccttctcagatagactgactcagaatatctgggaatagggcctgggaatctgtatggctaaaagcccctaaaggggaatctgatccaaagaccagagctggagaagccctcgtccacagatgaagtccagtttcctgggcactcatgcaaaactttctgctctgagactgccaaacctctctgttttttctccagccactaacaccaaggtatcctgcaccccagcctcacctaatgctcactttccagaatattccacgtgctatcaaacctcagtgtcactccctctgcctagaaggccatccccccatctgtctccatgaaagaccctactcatccttcaggagccaccacatgattctcaccagattaaaccctctgccccatttccttttagcattttaaattgtttagttggaaacatagactttaaccttctatttgccactttctagctctatgactttggctgttgactttcaatgtcctcacaaattattatgaaaaatattcaaatttgaaaagtatgtaaatgtatgtaaattagatatacagtgtctagcacaaaataactaacagaatggtaacttttattattattattcctatattatgatggcattcctctaacacagagttcaacaaactatggcctttgggccaaatctgaccaactaatggtttttgtaaataaatttttatcaaaatacagcacaaccattcatttgtatattgtctatggctgttttcatgctatgagggcaattgagtagttgaggcagacactctgacttataaagccgaaatatgtactagctgccttttttcagaaaagttagccaaccctgctctaacataattgcaattatttttttatagtttcgtctcccctatttggctgagagacactcaaggatcttcatggcagactcctgttcatccttttaaactaagtctttctcatctttgtatctctaacatttggtatataattagggcttggtatatgttaaattgaagtgaataattctttaacccagtttaaatgcacacatctcctgaaagccctgatgggaagatggggtaagtgccagcagacctggctctgaggctgcctccctcctggcttcagcatcccacagtctcactgcctcccaccacccaaaacccagcactctgtgctttgcagctgtaatatttcccctgatagagaggggaggaagaagtccttcaaaggttagtatattcccattatccaagagtgtacaaatggatggtctaatggtccccatggtccttacagggggcaatttggtggacccatttttaataaataaactaatggattggtattttttctctggagatctatattttgtttagtttcaactacccatgaatttgcattcctgacaaaagctccttttgagaagagaactaggatttccaagcagtgagaccatttctttgtgagctgtttatgaaactactctgtgaccttgggccagtcacccgcctctctgggcctagctttcagtttctgtataacaacttccagacttgactccctggagttctagccagagggatgaaccaactcatggtgagtgaaaacagtggcctggcaacaggcagcttgacagagtgtcttccctcttccatgctgcagtagcacattccctgtcctccccagcaaatacagcgactcatttctactgccttttcttgaggcttaaggaagatactttagccctaaagtagatcttcagaagataagaaaatgccatggtgtggaaaactctgtgctggatgaagtggaaacactcagctctcccccgaggccagatgaaaagcacatggatgaaagccaaagtccatcccttccttgagcctttgggagcagcagtccaccctctctttcagaaagtagttcccccccttacccttcaccctccttgcagacacccccatgggataaaatactgagcctgcaggatcctggttatctgggggcaaatcggtgtaactgtggattgaactgacttttattgatttcccagcaggtgatttataactgcctgcttcctaaaagggcttgtggccagatggcaataaaaacactcagaggccaagagagttaaaaataaatgctgaaaaagagagcagaggaaagagggagatagacagctgcactaaccgaggtgggatgactgctcagtctggatcacagggatgggaatcttgcttttcagttcctactgacataaccaattgagatcagcagcaccttgtttttggcttttgcaagaattgcagagcaaggagtagctacatcttgagcttccaaaactaacccttagtccaacagagaacaaaattgagtgagattttgcattttagaactttataaagctcacttcacagagggactcctcatacaactatgtcaccgtactgtttacacaacaggatctggaagtactttaaagccggcagtgtaaatcaaattctaggtgttatgtacatgtctgagtctaatggctggtcatccaccctccttgacttggctttagagtagtccttaactaaaacgagttctagggtcatgcaaaaccatgcacaaggatcctttagcttagtgaaaataggcagtgctttctaattctggccataggtcactgtcatttggtggtcacggtgaattggttatttaacaaattctgttttcactagttgcaactaaccagaaatcagatctctcaaaggaaaaccaagaaggctattgctatgggcttaattgtgccccccaatactcctcctagttcttatgtcaaaatcctaacccccagtacataataatgtgactgtatttggagacagggcctttaaagaggtgattaagtttaaatgaggccattagaatagaccctaatccaatctgactggtgtccttataagaagaggaaatttggatgtagaggcaccaaggatgtgcctatacagaagaaagaccatatgaggacacagagagaaggtggccatctataagcaaggagagaggccgcagaagaaaccagacctgctgataccttgatctgggacttccttagaactgttagaaaataaatttccattgtttaagccacctggcttgtgatattttaatacagtagctctgacaatctaatatagctattgatagaatctctcagccatatcagatttaaattcaagtctgtttcaaacatttaatctttgaaatagggatcaatacattttggagaataattgctttagtatttttccaggctaaccacaaaactcctttcagaacctttctaatgaaataaaaattctctagactaggtcccaagaattctacctttgaagaagtaaaattatctctatttgcaggtgatatgatcttatatatgcaaaatcctgaggaatccactaaaaaactattaggactaataaatgagctcagcaaggctgcaggatatatgattgatatagtacaatcaattatatttctatacattagcaatgaacaatcaaaaaatgaaattaataaagcaattctattcacaatagcatcaaaagcataaatacttaggaatacacccaacggctggccgggtgtggtagctcacacctgtaataccacaactttgggaggctgaggtgggtggatcacctgaggccaggagtttgagaccagcttggccatgatggcaaaacctcatctaaactaaaaatacaaaaattagcagggcatggtggcgcgcacctgtagtcccagctactcaggaggctgaggcatgagaatcgcttgaacccaggaggtggaggtttcagtgagccaagatcacaccactgcactccagcctgggtgacagggtgagactctgtcttaaaaacaacaacaacaaacacaacaacaacaacaacaacaaaaaccagaaatatacttaacaaaataaatgtaaaacttttactctgagagatatgaaatatatttgaaagaaattaaagccctaaattgttggaatgccatctcattccaatttcatatggaaacacaaggaagcaacaataatcaaaacaaactaaaaagaagaaaaaaattatctacacatcccaattgcaaaacttactataaaactatcgtaatatagtatgatactatacactatacaagaagagacatacacatcaatgcaacagacttgagagttcatacataagcccttacatttatagttaattgatttcaacaaggatgccaagacaattcgatggggaaagaagtcttttcaacaaatggttctggaacaacgggataaccacatgtaaaagaataaagttggacctcttcctataccatacacaaaaattaactcaaaacatctaaatgggagagctataactatagaattcttaggtgaaagcatgtgagtaaatcttggtgtccttggtttagacaatgccttcttagatacaacaccataaatgcaggcaacaaaagaaaaagtaaataaattggacttcatcgcgatacaaaaaattctgtattgaaagtgatgctatcaaggaagtaaaatgacaacccacagaatagaaaaaaatttgcaaatagcatatctaataaaggacttgaataaagaactcttataatgataaaaagacaagtaatacaatttttaaatgggcaaaatatttgaatacacatgtctccaaagaatatatgccaatgaccaataagcacatgaacagatgttcaacgtcatcaactatcagggaaatacaaattaaaacagcaataaggtaccactttacacccatgagggtggttaaaataaaaaagacaacagcaagtgtcgactaggatgtgaagaaactagaacccttatatattgctggtagaaatgtaaaatggcgtaaccgctttggaaaacagcttagcagttcctcaaaaggttgaacataggattactgcatgatctaccaattcttctagatatgtacccaagagaaatgaaaatgtatatccacataaaaacatgtacacaatgttcatagcagcactatttataatagccaaaacatggaaataaactaaatgtccataaggtaattaatggatgaataaaatgtggtatattcatacaatagaatctattcggtcataaaaaggaatgaagagccaggcgcggtggctcacacttgtaatcccagcactttgggaggctgagacgggcgaatcacttgaggtcaggagtttgagacaagcctggccaacatggtaaaatcccgtctctactaaaaatacaaaaattagctgggcttggtgccgtgcgcctgtaattccagctactcaggaggctgaggcatgagaattgctttaacccaggaggcgaaggttgcagtgagctgagatcatgccacttgcactccagcctgggtgacggagtgaaactttgtctcaaaaaaaaggaatgaagtaatgatataagttttaagtttcatgctaaagtatgaaacttaaaatgaatgaaaggatgaacttgaaaatattatggtaagtgaaagaagccagtcacaaaaaaccatacgtattattttatttatataaaatgcccataatagagaaagctatagagatggaaggtaaattaatggttgcttagggctgagaggatggggaaatgggacgtggctgttaataagtgtggggtttctttttggatgataaaaatattctggaattagttagccatgatggctgcacaactctctgaatatactaaaatccactgaattgtacactttaagtaggtgagtcatatggcgtgtggattatattttaacaaagctgtttaaaattttttctaacttccattaaaaaaaaaagagaaggaagctagctttggtccttagtgccttgtgacctctctgggcatagcttcctcaaacataaacattagaaattaagctcgatgatttataacgtgccttccatctctgaaattgctgaggatacataatgtaagaaaacaggttgagggaaagagatagattatgtgtctaggatgggctcgtgtgaggagaaatgaaggaggaggcaacaataagaagactaagagaaatagagatgaagggacagggacacgggctcagagagacagacagagacatggagacaagactacaccccaaaagaaagacagactcactgggatgaatgtgcagattactcatctgttcttccatttaacaaatatttacagagcgcctaccaagtgccaagctctgtgcagtagtaaaccaggtagaccagggcactgagctcagaggtaagagacatagcagtaagcaggcaatttgcaagcaagcacagagagcgagagctgggatgcagtaattcaagatgctccagaagtgcacagatgcaacatacaccccacaccacactccacatgcacaaatgtcccaaaggtagactcatttttgtagggagcgccattcctcatctgaggcatttagagttctgctagcaaagacattcaaataaacgggtttttacaagtatgggcacaaatgggggtgacacctttcagttctcaccctgaagtctctataaaatgaggctgaaggacaggattcatccctcactccagagcttcccagtactctttccccctcatcgggagggactggctttggaaacagagaggaatgtgacctattacagccacaccagcaccactcctctgggctttcagctggaaacttcccagaacacattttgttccaccctccttccatcccatccagacctggcgacctggcccaatgaaggcatcacatgttgccccttcccctgtcttgtggcttctctgctgctgacaggcacatgaaagggaattgaagctcaacagaaaagtgactgcttcctgcacggtgtcggctccctgcctgactcagattcagccaactctgaggagggaaggcaagggacgtttctggatatctcttgcccgggtccctcttctcctaactccagatttagcgagagtccaagctacacaatattcctgaaatagccccaagtcacatcctaagatgggggttcatcccctcatatgaaggattctctttggagaagatgttgggggctttggacgccgtgcactggcacacgaataggaaacgcagagtgacccggagcaggaaggaatgggcaccgccctgcagattctgggcaggctgcaccagtgctgggctgggaaacagcccctgggctccctgaagatctccctggctgtgcaccatttggagcagcagtgaattaatgtgattcaggctccaaaaatagtagccagagcatctaaaattgctttccaccctggactgggccagtcccctgggaatgtcagcatttctaaaatgtccccattcacccagagtgcctttgtcagaccccaagtagaatctgggccaccgttaagctctcctggttccgttggctcctgcccggttcccctctcctgtgtgtcacgtgcactgcctcccaaacaggaaatgctaattcatgcctgccacttgctgttaccaggtccaagaactttaaccctgcaaatggcttggaagggcagaaatggtcccttgcagaagtggcctgggtggctctctatcactgagttgggatttaattcctaacaatgacgactggggaagcaggtcacctgaggaaccctgagcctctggtctgctgctgatgccaaagggagtcatttccacagtggcttgtctttctctgacaaaattatttggggatctcagggaatttcatcatcatgaagacttgtcactctaggcctacctcagtgcttttgcacatcctgtactctacgcaggaaacaccatttacgccctcttccctgactgacaaatgccccttcatcctcttattcagcgccttcctaagagtgctgcggtctttactaagtttgtctgcaatgaatgctctggaatggccacctttgcccaggttacactcccatgcctagagattcacaccctgcattctcctacccactgatcgaccacgactctcagctgccttattcatggacaggagtgaggcaaggaacaagcctctcccctgcctcatggaggctggcctcccatctaacaattaaatggccagagtctgtaaccactgcatggggttcctgatttaaatgcagtttgggaatctctctgcctagagaatcgtgatttgatctttgtgatcatgtcctttagttctcaggttcttagctgtgatgctcgtactgcctcttagtggcttcgctttgcctccctaagagattccagaagcgcaggacacagaaagtgatggaggagtgaggagggagaatgagttagtctacaccttggtttctccctgtgcggtgggagctaacggtttctccgtcagaatggttgagaggatggcatgagatgcgtacatgactcagcacagtcagtgctttggggggcagctgcattttcgcccatgcggtccccagtcccccttcttctggcgacagcagcacatccatcatacttgtgcttgggatgggggtggttgaccccactgtgggattggagctatgacactggactggccccacagaatatcccatgctcccagctctgggttgtaattgaggaatgagcacgtgactcagaccaggccaatacattcagttcggtgacttctgttggaactgttgggggagttcctgctgcaagcgttgctgaaaggagaggctgggaactgcaggtgccacagtgccaccacacaggagaggtcacctgagaatacatctaatgccaaggacagctgagagacaaggggatgagaccgtggatccagccatgtccgagattgccctagaactctcaatgatatgatccagaacattctgctaatttgctaatctaatttgaatccgtttctattctaggcaaaccagaatcctggcaaatgccaagctcaatatgtttggaggttcacccttcccacggccattgctctggggcgagcggtgttccttggcctctgcagagacgatgccacagctcatctccctgtcctcagtctctcgttcttcagtcttttactgcactgactgttctcaaacacaggcttagaagatgccttgactccccactgcctggagatcatgtcccaacttcctcagatccacctgcaaagctctacatctgactctaatttcctttgtgcgtctctcccatgaccttcccctctgggtccatgcatactctgtgccccacccatattaacctcttccccactctgaaacgctccctccactctcccaaccctgtacttttcctgggaagttcctcacttctttcttacctacctgccagatccacaactaccttctcttctgagaagtcttcatggatggccccagactgagtcaatgtctccttctcctgaatcaatgtctcccttgtacatactgtagtacctcttggtgtttatgacttgagagtaatttatacattttttttgagagcagggagcatgtcttactcctttcaggatcccctgggatccttacacaagatttgctcactctagaccctccctgaatttgctgacacaagaccttggcttccagctgacaaactctgactaccccgtcccctcccctcaaccatactctaggagaggggtgcctaaactttgggtcacatttcctcttcaccagtaaacttcttttttaaaaaattatgataaaatatgtgtgacatatgatgtatcattttaaccattttgaagtgtacaattcagtggcattaagcacattcacaatgctgtgcacctatcacccctacctagttccagaactttttcatcatcccaaatggaaactctgtacccagtaagcagtcactccctgttcctcctttctggcaggccctgccaaccacgaatctgctttctgtccctgtggctttaaccggttctggatagttatatgaatgcaaccatacaatatgtgacattttcggtctagcttctttcacttagataatgtttttgaggtttatccacatggtagcatgtatccatacttcattcctttttatggctgaataatattccatcattatctatctctctatctgtctatctatctatctatctatcatctatctgtctatccatcccacattttgtttattcattcatcaggtgatagacattcgtgttgtttcctccttttggctattgtgaatagtgctgttacactgtgatacaacttctgtttgaacacctgttttcaattcttttgcatatagacctaggactggaattaatgggtcatatggaaattttacatttactgggaagctgcttatccttgctttctccaagcctcaacaacatgctgggtctatttaactgctttcacgctgagagagcccaaggttcttagaagggagcgatttcatcttgtcgtctcctgatggcaatccctaaaggatgttcctagtttttaatactgccctcttgctgtttagagctttcctttgtctaagctatttcagacatattatttaatttattcctcacagaaatactgtaaggaggaaacgattacgtctgctttttgatgtggaggctgacagattcagaggatgaagtgatgcggcaaggtcacacagccattaggagcccagctgagactgaccccagcccagtgccctttccacgccaccacagcggccctctctcaatttgcctctcttttcaaagtctttgtaaaatagccaccatctgaaatgtattctcagacccaccattgtttagaaatgccctcttggtaggcaactggttgatgctggcatggacctctgcaaacactctaccagttggcacctcatttgtaatcgaagctttttcctggggcagattctgcctgtaccaaacagaccaatgtttaccttttctgggtcttctgtcaccttctgcaatcctgggttaatgttcccttttgatgctgctatgagtctaaatctgagtgtgtcccacaagctcaacctcagctctctaaatttcctccctgttcttttgttcaacccaaggtcaacccaagagcttccccttccctttctcaggaagaaactatcccttggaccaaggggtcccctgacctctttggagtagaaaagaggcacaatgcccttcagcctgacatggtgaagttgtgtctatactgctccttggaagcttccaatcttagtgtcctagttctacatgagaccaggagactgtagaaataagcaaaacaggcaatgataacaataacaacattctctatccatcagaagcatagagctttttaaaagcatacgattcagtggcattaggtacattcgcaatgttgtgcacctaccacccttatctagttccagaacactttcatcatcccaaatggaaactctgtaccaatgaagcagtcactccctgttccccttccccccaggccctggcaaccacagatctggtgcctggtgctttaggcatatttactcactcaatcccccaactgccctatgaggtggatgccactttgcagataaggaaactgaagttcaatgtgatgctgtgacctccagagtcacagagctaatgggtggccaaacagggattgaagccgtcagagcccatggcttccccattccagcccactgtctgcctctcaggcagaaggtttgtgagctgaccttgctcactgagagctttccttagcagttctgcaagcagcaaggactctctagatgccacgtgatccatcctgtgtccacccaagtaggaataccactaaccacttatcccaaagttgtatagagttctgtacaactccagatctgggtgatgttgtcaggagctctgaaaagaaagcttatgtgtttcactctatttgggaatatcagcgggagataggtttctgtcttgcaggacatctcagagcctttaaaagtaaatgtgcagtataaatctgcaagaaggggtgaaaggatataatgtttcccaaatttatttgaccatgaaacgtttttccaaggagtatctcaaagtgtcctctttaaaactccactctgggccaggcacagtggctcgcacctctaatcccaacactttgggaggctcaggcaggtagatcacctgaggtcaggggtttgagactggcctggccaacatggtgaaacctgtctctactaaaaatacaaaaattggccaggcatggtggcgcatgcctgtaatcccagctacttgggaggctgaagtaggagaatcgcttgaacccaggaggtggaggttgcagtgagcagagattacaccactacactccagtctgggcaacaagaatgaaactgaggaaagaaagaaagaaaaagagagagagagagagagggagggagggagggaggggggaaggaaggaaggaaggaaggaaagaaagaaagaaagaaagaaagaaggaaggaaggaaggaaggaaggaaggaaggaaggaaagaaagggaaagaaagaaagagagggaaggaaggaaagaaagggaaagagaaagaaggaaggaaggaaggagaggaagggagggagaaagagagagaaagggaaaaagaaaggaagaaaggaaggaaggaaggggaaggggaaggggaaggggaaggggaagggaaatctccattcagaaatgccctaaaccctcttaggttagagggtgtccagaggtgagagaggacagtaattatgtccattggccctggagctgggctgcccgggttcatatcccagccctgccatgtgaccttgggcaagctgtttcatctttctatgcctcagtttcctcacttgtaaaacatggataataacaatcttgtgaattatgtaatataaacttcttagaacaatgccttttgtgacatagggctcacaaacattctaataaggtccttggggccgggcgggttagagggggcagtgagagggattatgttacctataatgcataaaactgtaaaactccagataattcatgaaagattacacagatagcatggtttcattgtcctcagggagggtcagtgagttccagtgggaggagaaagtgctatgcagatggtagttagctgcttgatccatcttcctgggtcttttcaagttcaccaggtctcctctacttagggagtgcccgacacctcctggaggcccctcaaattctggtgcctatgagtttcaccacttccaaggaacagaaatcttgtccttttgtcaccacccactactcctgtagggcatactcatctgcccccagagctggagtgctgggagaagctggccctgtagtgtgagggcagagtggccaggctctagcggctgcctggaccatcatttccaatctgagcagtaaatgtctaacgcatgagtcaagtgccttgttaataaaaaagagaataaataggcattccctttagcagtaaatgttttttttaaaaatacaaccttccattaactttggacctgatgcccattctaactgtcaccaaaggacttgaatgggattgtagaaaataaacaataacagctgactcttcaaacacacctgcagtcctcctccttgtcactgacagtgcccagctgtcaattattgctctgagatgggctctatcatgcaactattgggatgaatcactgggccctgtagggtgaatggttcacagatgaggaaaatgaggacttggaaagaagatttgatttgctcaagagcacaacatgagttgaaggcagaaccaggcctacaactcaggaccactgcttatacggtctcttcatttcagcttaggaagtggcaccagggacggatgctggaagaccttgactgcccttaaacctgagaggtttcattcatgcatgcatttgttcattcatttaatgtatctaccaaatacctgctacaaactgccatggtgctagcttcccttaatacctttctataaaaccataatgatctaaccctttttgaaatcttattgtcccagctctactctctcccggcctgaaaaactccaagtatgagtttctatctgttgatgggctgcatgcactttgcaccaagggcaatatggccttggctctgccactttctagctgtgtaatcctgagtgaactactcagcctcacaaagtctccattttctcatcagtaacatagagataatattataacctgtatcacaggatgctgcaaaaatatgagataatgtatgtaaagaacttaacatagtatttagctggtgctcaataaatgacagtaatttacagacagaaatgacagaaagttacagtaataagcacattattattactcttgtcatgtgaaacaagtctctggagattcagcaaatggaatcttcccctctgggactctaaaaagtcaggctctctttgttcatgtgcctaagcaacttttgtgctttataaactataggaatcgtgatatagggacaacttgccaaatgttttcaggtctaatgcaacagatccttgatgtctataaccaaccgtatctttttttcctttctgggaccagctggcctgagaaatagtcttcctctaagtctgataaggtctgtgaaccccagacctgttaggaatgttggctatacatggagataactgcaaggaaatggggctgccctccaatgtattaacaaggtttaaaaaaacccataaacaatggacatggttagttatctatggaagtaacccaagaaattctctgtatatggggttgcagagttgagaggcttaacagacatctctagaaggcaggacagaaagacaactataaataagtgggtgatgacattctttgaagacacttttactttaagcaattttcccttctttagtaagaacccctatatatgagggatggcttccccatgaccacatttataccccacaatcctgtcccctggccatgactgattgaccctgatccaagctggacttatcagattatttctttcaagaacttagagaccaggagcttctggaacctagtcatactgggcctgtggcctgggcagtgatcttcagagtagagtatgtcatccagggaatgcaggatgacttggtggagtataggaaggaaatttaaaataaaaaccttcaatttttaattaaaaatagtaacaaagtacacttccttaatatttaataaacagattggcagtggtgctggttcatgtattgaaaggccagttatatccagtttgtgagctgttgtatggggaattctacagtgttacggaactgatgtagcaccctcatgtatccatttgtttttcctgaagggtgacacagtttgtgtgtgcccaagtaagtaggttaataaaacatatttatctagttttaaccaaacctactatcataaaatgtgtatgcggcttaaaaggtttgtgccaaaaaaaaaaaaaaagtacaatgaaaatacttctactaataaagctaacagtaattctcaaaaaaaaattttacaaagtagtggataaaactgaaaatttaatataataattcaggaagtaaggatgtccctcttccacatgaggtatctgagctggttttcctctgccctccttccctttctccctgccctgccccctggttctctgctgtgtgcttcaggatgacacctatggaatgtataacttgggctcctttgcttgcaggctgagtttggccaagggaccagtaggggatgggaggagagagaggcctgggcctttcctcccttgctccagcaccacatctctggcagtgactgtgactctccttagctacagctcattctggatggaacctcttccctggctccagagctcactagcttctggtaatacgattttcttctctttccccttgaagaagcacatagaatcatgaccaaagaatacttatttagggaaagcaggaaaattgttgacactttaaaaaaaaaaaaaaaagcatgattttcaaaatattatttcatctttcttgttctttaaaaatttctatttttatgttttataaagtaacgcattagtacaatagctcatgaatatgatttataataaagaaatatacataaattggaggtgcatgctaaaaaaattttctctaaactaataagatgcaacatccaaaaaacttgaagacctctcctgtagagaaaaggctggcaaactataaatcatgctgctataaagacacatgcatacgtatgtttattgcggcactattcacaatagcaaagacttggaatcaacccaaatgtccaacaatgatagactggattaagaaaatgtggcacatatacaccatggaatactatgcagccttaaaaaatgatgagttcatgtcctttgtagggacatggatgaaactggaaatcatcattctcagtaaactattgcaaggacaaaaaaccaaacactgcatcttctcactcatagatgggaattgaacaatgagaacacatggacacaggaaggggaacatcacactctggggactgttgtggggtggggagagcggggagggagagcattaggagatatacctaatgctaaatgacgagttaatgggtgcagcacaccagcatggcacatgtatacatatgtaactaacctgcatattgtacacatgtaccctaaaacttaaagtataataataataataataataataataataataataataataataaagagaaaaggctggcaagttcctgctgctgggatctgaaagctgccctgggtcctgccttcctgaggcattgctggctacctaccttttcctttgattttctcaaataccttataataaatcctactttctcttaagttagccaacatagccttctgagatctggcaatcaaagaactttaaccaatatataggtgggatctgcaatttcttgtgtgctgggacagactatgtgaatatcacataataactaccattttatagagcatttttctacagcaaagagaaaggcttgtccaaacttcccagaggaaagaggcccttcctgagctctggaagagtctctctgctgtaggcagaggtggctcatcaggccacatcatagcttaggtgacccacccctcagaactttctgccttcttacctaaatctctatctatcaagcattttggtcattggaaagggtttgtctcctatcatatactggcacatagacattcagaattgcatacttggctgggtgcagtggcttacacctgtaatcccagcactttgaaaggaggctgaggcaggtggatcacttgaggttaggagttcgagaccagaatggccaacatggtgaaaccctgtctctactaaaaatgcaaaaaattatctgggcatggtggcgcatgcctgtaatcccagctacttgggaggcagaggttgcagtgagccgagatcgcaccactgtacttcagcgtgggtgatgcagcaagattccgttcccaaaaaaaaaaaaaaagaattaaaagaattgtatactttagtaatctcagtgctttagcaggctgaggcaagagtatcacttgagtccaggagtttgagaccagcatgggcaacatagcaagaccctgtctctaaaacaaaaaaacgtttaaaacattagccaggtgaggtagtatatgcctgtagtcctagctacttgggaggctgaggtgggaggatcacttgagccagggaggtcaagcctgcaagtcagctgtgactataccactgcactccagcccaggggtcagagtgagaccctgcctctcttgaaaaaaaaaaaaaaaaattgtatacttcagtctcttgtgagtttgattattgtgagtcagtctctacataagcaatcaactaatcaattccaggtcactaaccaggcttagggataggtccaggactctagaacatccccaaggtgatgctccttggggaagtctcttagaagccaactagccaggtttatcttgacaacacctagccttatcatcattgccttccaaactacaacggggaccagttagatctcaggtgggaaacaagaaagatgtcttaggtaagaagcccaggaagacattacattctttctaccatacccatacaagtcaaaaatatgacaagagagtccttggggaaacctgaccatttgggggcatccaaaatagaggactcccatgtgctcaatattaatctgggcttcaataataataattacttattgggtacttattcaggtataagtactttagatctagcaatccatttcataggtaaggggactcagaggttagatcattcgcccacgtcaaacagtaagttgtggggctgggatttgaacagactgggtgacctcggcaacatttacagacttttagggcacaaactttggagagccatagaaagtgactcaagacacacaatgtaggacatggcatttcttgccagtaaaaagcttgtgattctaaatttgtatttttccttctaaatagaggaaggaacttgttcataaacaagactaggagacctgataaagatcattacatactgaaagaaaccaagagaagtgcaaagtagagcaagcctagtggggaagctgctccagtgccctgccccgagagctcaggacctcagctctgagcagcagcactgggacctccagggctttgttcttataggggcaggaacaaagggtcaggcattatcactctgtcctgcagccaggtctataggccacagagagatggaaagagatggggcttggtggtctgatggttttggtttgactctcattcttctcatactagttactatcctccttgaatcagtttgttcacaaatacctcccttgcatggctaaagtacagatttgatgagatattgtataaaatgtgcctggcacatacaaacttgctcaaacaatggtagttcctttcccatatattttctcatctatctgtaagaagtaacccagaagaaaggagttaagagatcacttgctccctgtctggagttgcctaaatgaaacttctgtgaaaaaaggaaaattcatcgccgcagaaacttctagtcagatgcttgccttgtctaaggaaggactctgcattaaacaagttccccaccaggcatctctggagaaaagatgaggattgattaactggaaaagggaggagagggggtgcccatgggaccatgtggcaacccctgcagcctcggccctgcctgtctctcactagggcaggacacaagtcttgccaggtgcccatgggagaccagccttgcaagtgggctttagccaggccctcatagtggtaccccagagtgccacgctcttccacaccaagagaatggctatctgatggtgagttctgagaagtacctgcatgaatagctcagccctccctcttctgtttctctagggaattagctgctttcaggggacacacattctgctctgtttctccaagctttaatatttaaagagccctactttccccagtgggcaccccctagggctgggggataaatctgctcaatgcaatattagaaaacctacttgcctgttgatccaaacactttccaacaccagcttcatcagtcatacgggtgatattagtctctgaattcccaacaagccttaaagcttcagtgaaggaaagaggtgttatttattgggcctccttaaagacttcaccagacacagatgcccaatcctcttgagaggaagtccaccactctccttgcggtgtttttggagttgagaataggacccaggactgtggatggtcagagcctcaaacccagtgcagaagtcttcttgatggaatctctggaggggaacagacaggggctagaaataataagacctaatgtataccgagtgctaagaatagacagtgggctaagggatttagctttgcttttttttgggggggggtggtatttaactttgtaaaatggacactatcattacaggtcgagcattccaaatctgaaaaatctgaaatctaaaatgctccaaaatgcaagaatttctggccactggcaagacactcaaaggaaatgctcactggagcatttcagattttggatttttggatttgggatgctgaactgggtaaatatgatgcaaatattccaaaggccaaaaaaaaaaaaagtgaaatctgaaacacctgtggtcccaagcattttggtaagggatactgaacccatattacaggagaagaaactgaagcgccaacagattaggtgcagctcaagggatacagctggtcagtggtggagccacacggtcactccagggtccacactttccatagggacactgtgctgcctccattacaagatgtcatctccccactgtgataataagggaagagctggccaacactgagcccacctcctgactcagagcccggggttattttcaccacacctgtatgagcaaagtcaagaatgtcttcaggctttcttctcctcctgatgagccaggaagcttgggctctctggaaacaccctcttgatttgcttatcagccacagaactctctgtggcctctctgtgtcccttccctggtggccactctgggaaccacatcccacccctagagccaggctgtgtgcagtgtatagtctcatccctctcagcctctctcattgagcccattggttcctaaattcctgttggttttgctgggatgactcaacttccccaacaccctgcactcaccaatacctggattccaccaagttcatacaacccgatttccaccaagccgtggtggaatgacctgactcatttatacactatgctcacaatttttcccatgcctgtgttttacctatgcctttatttacttaatattctttcatttgagtagcaatgggccagaaaatcaagactgaaaccccggttggccatttactaactttgtgttgttaggcaagtttcttgccctctctgtgccccagtttcctgatctgtataaggaggacaatgacagtaactacttcagagggttgctgtgaggactgaatgagcgactgcaggtaaagcattaggacagtgcctagcacacggtacacactcaccaagtgttagctaccattgtcattacttttatttaaaagggaaactttatattcctaccttaaatggaaaaagcaataccacttaccacaaatagagttataaaaataaataaaatgaaaacggttattaaaccttagctaaggcctgctctcatttttttaagaagggaaacaaacagaaagatggtgaaggcatatgaggcttaaatgagggtgaccaaccttttgaatttgtccaggacctgtcccaattttagcactggaagtcctgcagcaattctcattcccggctgaccctggacagtcggtcaacctacctcaaatagaggctttctctccttcattcaaaggaataaaaagaacttaagaaggaataatgttcttacaatgtgatgttgtgtgtttaaggctgggtcagtatcccacatacgatcatcttgcagaacaagctcacaccttgggccacaccacacaaacccacctctgagagctgagtctccaaatgctataaacctatggaagagccatcatgtcacatgtgccactgagaaagtccccaaagaaaaatcacatttgtaaatgccaagaagaggaacagtgattaaattgttgcacggctaaaatgactctatgttataaaaccattgaaaaatcatgttttggagaatctttaatgatatggaaaaaggattatattagaatgctcagttttaaaaagcagactaaaaaatagcatatacactaagatcctagttttacaaaatatagagaaatgtaaaggaagaaacacaccataatataaacaatacttatcactgaggaatggtattctagagggttttttatttctttatatttatttctgaatttcttatttatatccacttctatattttccaagaaagtctagcaaagaacatgcattacttttttttctagaaaaaactgaatagaaattacaaattacaaataaaaaagtaataggaagaaagtaaccagagctgattaagcccagccttagcagactttttttacatgtcttctccgctaggaaaagttttcagtctggccgggtgcgatggctcacgcctataatcccagactttgggaggctgaggtgggctgatcacttgaggtcaggagttcgagaccagcctgggcaacatgacaaaactccatctttactaaaaatgtaaaaattagccaggcatggtggtactcacctgtaatcccagctacttgggaggctgaggcatgagaattgcttgaacccgggaggtggggttgcaccactgcactccagcctgggtgacagtgcgagaccctgtctaaaaaaaaaaaaaatgtttcctgtccgaccaactgtcctctgctttccacctcccttggagaaagcccttgcagagaaggcagggcttgtccagggtcatgggcgtgagttacctctgctaagactctgaatttgaaggcccatttgtgaggctgccctggactgtcgcctgaactcagagtctagcctccaaggtccacaggac

SEQ ID NO: 62 - DNA, 1706225 bp, Homo sapiens
gatgatttgttagattgagacagcatcatttatggtggcaagggtgctttgtgaaatgggccctgcttctcttgtccttttgtactaggagaaatgttaaatagttagaaaccgacctggattactccgatctgaactgagatcacatgggactttaatagttgaaaaaacgaacccttaatagcggctacactattaggatgtcctgatccagcattgaagctgtaaaccctgttgttgatatggaccctagaataggattgtgccgttatccctaggataacttattccgttgatcaaattattgggtcagtgtgtgttaacttgcttagactagtgcggtcttagtttaggtagtttggaggttgaattatgctctgaaataaaagaaaatttttattttttttgttttttatttatttattttttaagacagagtctggctctgttgccaggctggagtgcagtggcacgatcttggctcactgctatctccacctcccgggttaaagccattctcctgcctcagtctcctgagtagctgggattacaggcacataccaccacacccagctaatttttgtatttttagtagagacgggatttcaccatattggccgggatggtctcgatctcctgacctcgtgatctgcctgtctcagcctcccaaagtgctgggattataggcgtgagccaccacgccgggcaccccaaccaaaatttttaatgcaaagatagtaggctagggcctgtaggctttttttgagtttctatttgcattaatgaattaaagctctatagagtcttctcatcttatttgtttatactgcctcttcatggataggtcaatttcactgactgaaagtaagagacagctgaacccttgtgtggccattcatacaagtccctatttagggaacaagtgattatgctacctttacaatgtcaggataccgcagctgttgaacatatgtcactgggcaggcggtgcctctaatactggtgaagccagaggtgatgtttttggtaaacaggtggggtaagatttcccgagttccttatactttttgtaatctttccttagagcatacctgtgttggattaatggtataaataatagggtatttattctttattaatattaggctgttaactatcagtggattctggtttgatataagcttatgcaatggagaatgtcttcgtgttactaatattaacattattgcttctattaagtaatagattagtctaatgtaatgttaggagttcaatagagtgattaggatttaaaataattggatgttgagcttgaaagctttctttttttcttttttcttttttttttgagacggagtttcgcttttgttgtccaggctggagtgcagtgacgcaatcttggctcactgcaacctccgagtcccgggttcaagcgattctcctgcctcagtctcccgagtagctgggatcacaggcatgcaccaccatgcctggctaattttgtatttttagtagagatggagtttctccatgttggtcaggctggtctcaatctgctgacctcagatgatctgcccacctcggtctcccaaagtgctgggattacaggtgtgagccaccgcacctggccttgaatgctttcttaatcggtagctgcttttgggccaactacggtggtaatattttttactctctggaggaaggttatttcctagggtctaaacagctgtcccaaagagggacaatattaaggatgggagatttgtctcctgtaaaatgcatcctttctcctctgcaggttatgttcacctggtcctactctgaatgagaatctgctggtttttgaaaggcctgctctgtgatggagggattgcaatgcccagcaaggtgtgggcactttagttaagtcctcagtgtctgagtcacacctctcccccagacagatcaatacagctggctttctgctcgagagacggccagaggccaggcgcagtggctcacgcctgtaatcccagcactttgggaggcccaggcaggtggatcacgaggtcaggagtttgagaccagcctgaccaacatggtgaaaccccgtctctactgaaaatacaaaaattagccgggtgtgggtggcgcgtgcctgtaatcctagctactcaggagactgaggcaggagaatcgcttgaatccgggaggcggaggttgcagtgagccgagatcgcaccgctatactccagcctgggtgacagagtgagactccatctcaaaaaaaaaaaaaaaaaaaagagagagagggagggggccaaagtgggaccagcttggggctgggtactgtgctgcacggtgtgacagctgtggatctggggtgggagcagccacagaccttcctgcactgccctaagccaacaggaccctgatgtgctctgtgtccctggcagctgtggtgctgagaccttgactgtcgagggggtttggtttacagattattttgtcaccgaggtaatgagcatagtatccaataggtagttttccagtcctcaccctcctcccactctctaccctctagtaggccccagtgtctgctgttcccctctttgtatccatgtgtacttctaagctcccggttacaagtgagaacacgtgttatttgggtttctcttccattgttaattcgcttaaaataatggcctccagctccatccatgttggtgcaaaggacatgatttaattcttttttatggtggtgtagtatcccatggtgtatatgtatgacattttgtttatctacttcaccattgatgggcatctagattgattccatgtctttgctattgtgaatagcgctacaatgaacatatgtgtgcgtgtgtctttttggtagaacgattattcctttggctgtatgcccagtaatgggattgctgggttgaatggtagctctaagttctttgagaaatctccaaactgatttccacagtggctgaactaatgtacattcccaccagcagtgtataagcattcccttttctctgcatcctcaccagcatctgtcattttttgacattttagtaatagccattctgactgctttgagatggtatctcatggggattttgatttgcatttctcttatgattagtgatgagtattttttcacgtgcttcttggccacatgaatatctgactgctcttctaattctgttctgctcagctgcacttgccccgctccacgttcaagtgtttagctctggctttcaggaatctctgttaccatacctctgctctctgagcccatacagggatttctgaagggatgaggtagggtgtcagtgatagggtttttttttctctgggattatggggggagttgccaagctcctattagagccaatgaagcccccttcctcagggactttcccaagagaagagccagagctcatactcaggaccattcagaccataaggccttatagaggaacccagtgactccaagaaatggtgagacacaaaagagtctcaggctggaaggggaagaatccagggatgagagctcatcagtgcctgtgacatcatagacatgaccgtacagttctgtcatgaccagaattgggggaaagaagcaggtgaaatggtggtgcagctgccagactgagacagctcagttccttatctaagctttgtcatgtcctccagtcctcccttcagaaaggcccatattccatgatagcccctagaagggtcatgtcttggtgttttacacagaactctttgggtttctccattaacttagctactgtgcccagcagccaccagaggccccagaagaagaaaccagcaggggatctggctgcctgggttcctcgggggtggtctcaccatcaggggtgggtgagaccaccacagccacactgtgaaagtttcagagttttcactacttacagatcctcaagataggcagggtgaccagagagaggcagacagcagtcctcagttccaggtcttatgtagtgacagcagctgcacacttgtgggagaggacttctgttaaaggcttatttgggggtaggatgtcctaatttcatggaattactttccactgagtccttcaaccacttctagcaccaaaggtagttgagcagtttggcatgaggctggagttaaaacagggctctgcagagcaacttcttgtctatcttggtcagcccttgccaggcaacaatcaactgtggtttcttcattactcctcagacacttgggacattcatggtgacctattggcacccaaggaagagaacctgattttaatttggactgataagcaagttttctgaacaggtttatagggattagtttagtctggacagagtgagccggaatcaaaagatactgttaataccagaggactagaagatcccatgtggagatgtcaggtggcttagccattgagaaagaatgacagtagatctgaaatggtccagagcccagatattcaacaaaggctaagagccaaggtgagagggtaaagggaaggtgtgaacgaacgggtgaagccccactgtgtgcttggccagccccacagagctctctgctggtgcttgggggtatgaattctacttctgacatgtcaatttatgtcaccatctcctgtgcctgggtctaaagtcttgacttgtaaaagaaaaaaaaaccaactggggattccaacagacactaccttgatggtaggtaagcggggctgggtaacaagtgagatctctgattccttccttccttccttctctctccccttttcttttcttttcttttttccttccttccctctctccctttcctttccttccttcctccccctccctccttccctttcctccttccttccttctttctttccttccttcccctccctcctttccttcctcccttcctcccttcctttctccctcccttccttcctcccttcctttcctttctttcctttctttctgacagactcttactctgtccccaggctggagtgcagtggcgtgatctcagctcactgcaacctccgcctcccagattcaagcgattctccggcctcagcctcctgagtagctggaattacaggcgcacgccaacaggcccagctaatttttgtatttttagtagagatgggttttcaccatgttgaccaggctggtctcaaactcctgaccccaggtgatctgcctgccttggcctcccaaagtggtgggattacaggcttgagccatcacgcctagctctttctttctttttaaatgggtctctttttgccttttctacctttagactgtaaaaactgagtgaaagtgaaatggaagtaatgaaaggttttggaattgatttgacctatgttcaaaatctagctcctctcccttggggcagtgaccaggtcttccatatctctctttgcctggcacattataaacatacctgggcaaaataaatatcagttttatcatactgtatttaatgaacaaatgaactcactgaccgactgaagaatatggtgttgggagagttgtagatgtagccatcagtaatgcctgttggaggttgtttggcgcttgtttatcctgcctggtaaaactcaagacatatccagtaatagctggcatatgtgaagcttttacagtgtggttggttacatgtaaatggcttccacacatgaaagcacttaaccctttaaacccctctgagaggtagacattgtcatcactgactgtaagatgaagaggctgggctcagaaaggttaagtacttgtgtacttacttacctacttacgtaagtgtccaaagacacacagcaataggttataacaaaattagaagttaaacccggtttgtctcactccaaagccctcactacagcaccatactaacactttttgttggaatctgcagagctggaggttcattcgttgtctgatactgaccttaggccccagtgtcctctctctctaagaaaggggttcatgtctctcaaacaggcataagcacacaaaagcacttggaaaactgccccagactgacaaatcagaatctctggtggtggcatctaggaatcctcatttaagagaaattacagatgaggggaaaatgtccagctctttcatttagtcactgtgcaagtcacctaacctaggagggcaggtatgaattggggctaccaggaaaccaagactttacttacaaatctccataaatcttaaatctatgaaaaactccagacttgctcctggaatggccaactgtaagggtagtggctgagctgctgcaggagtacagcttcctccagatgccacacaggtcaacaccaagttcacagctttcaggctgactacgatggggaatggtggggccgcttgctagagtcccatattctctgtaagtgaagaacactcagtccttctcttggtctctacccagaaaccaagttacggttgagtctatttccaggactgtgaggagccaaggattctgcctgtgatgaagtcagctatgaaatgggtgcgtttttgtgccaggatcccagaagttctgggctgtttccagactgaactcacaagagaagcagcagagaggtagccagaggaaaggtgaatgaggcgcccagctcttgtttggctctgaccgtctgacagccactgtcagctgagaggagccatggtagaactatggaccagtgacggccagtaggctctgcccaacttctctgggttgtagcgagacgattgatccagtctacagggactggttaggaatctttggaaaaaaggaatagtgtcaattgaaaaaaaattatatcaactagttaaaatgtttcagtgagggaaggaggtatggaaacagtgtagagagcccactgtgtaacttaccagggaatgacctggttttttaatgggcctctgaagggctgcaccaatcctggagggtagtattagacataagaggaaatctgtagacttggggtcttgccttttgtacaacatacttccaatacattctcaagtggttagtgttgtattgggcttgttaagcaatggaaagtcaaatagtgagggcctgtggtcaattgactgagagaaacagccctgaactgtcattctgagtgtaccctcctggtggaaggtatgcactagggtgctgaagaaacaaagaccttcctcaccatccttgataaacagcagtttagtgaaaatacctaacctggtactgataatgcaaggtgcccaaaacaatagctgtgcagcctgaggagctgggttatttgcacatccagagctgtgtcacagcaagttgaagtgtctccagatgaacgtcacaaggagagcagcagccatgtgccaaagccctgtcccctccatgaagaaatggaccagaggacattgaggagccaacctggctggactcctagcccccaagacccagcccaaaagctaagtggtagtaaacattccctcctagaagagttacataaaagacttagtaagaagagagccctctgcaccctgggaaacctggattataattctgtctttactgtggattgagccaaagactgttgtgtgcccatccttcctccctctaagaagtatttccatttctagaagagagatgataatctactctccctctcaaagataccacttagagggcctgctttccatgtggggttgtatctctcctttctttctgtgagttacttttccctctctgacctccacttatttgagtttcacccattgacccagataataataggaaatccctagtaatagacatagatgagaactctctccttcacctccataactaatctatcaccgctacattatgttgactatgcgcccaaaatgtacaaaacccatccacttttttctgtatccactgccatcactagactagacaactgagtttctagacctcacagctaagaaagtcttacctggtctctttgctagcactttttttttttttttttttgagatggagtctcactcttttgcccaggctggagtatagtgacctgatctcggctcaccgcaagctctgcctcccgggttcacgccattctcctgcctcagcctcccgagtagctgggactacaggcacccaccaccatgcccagctaactttttgtatttttagtagagacaggtttcaccctgttagccagggtggtatcgatctcctgacctcatgatccgcccgcctcagcctccccaagtgctgggattacaggcgtgagccaccgcgccctgccccttgctaccacttttagctcttctgacctattctccacacagcagccagaataagagaattgtgtctttccctgcctaattattcagtggcttcccattatacttatcataaaatccaaactcttagcatcacatgtgataataaagtccagtcaggaaaacagaaaccattcttgatgtttcaaagaggggacttaatgtaaagaatttgtaaagtgggtgtggtagaattgaaaaaaaaagtgtaaagggaaaactgcagtgacagagatagtaactgtaggaaacagctaccacacatggggtctggatagagaaagggttgggtttaccagaccttggaagcttggaagagaggccccgcagagctgggacttggatttggcgagggtgctgggggttgggagctgggagctgggcagtgttgcctgactggtgctgatacctctgaagagtccaatgaggctgcttctggaagaagctttgttcactgctttttttttccgcttaacatggggaatcttgcacgctggagtgcagtggtgtgatcttggcttactgtaacctctgcctcctgggctcaagccatcctcccacctcagcctttcgaatagctgcaagcacgtaccaccactccaggctaattttttatatttttttgtagagatggggctttgccatgttgcccaggctggtctcaaacttctgagctcaagcgatcggcccacctcagcctcccaaagtgctgggatgacaggtgtgagccaccacccctggccctgttcactgctttatatttggctccagtacctcatatattataggcaatcacatgtttccggaataaatgaatggattctcccaacccttacctgtctacttcaggtcatctagagtggctgacaggcatggattggagactctaacggtacttgttttcatttttctgcccagcagactagaggacaaagcagcctggagggcagaggcaacctaaacatgcaaggagttcaacagttgtacccccatttacctggccacggtaggcccaggaatgggaggagcctactagtgaggccccgaagtgtctcactttccttatctcttccgttgacttgcactggctctcctcatttatccagccaccttctctgagctgataatccaaagcccatcagtaactagtccactcctgtctcctcttctccaccatgaatcaccaatgaagtcatggtgtcccaaataggtcacattccagcccacctctttgtcgaggccctttgaagatgtttttttctgagttgagcagaggctgtgaaatatgtgactttcggagctgtcctgcagagcttctccttaggggcatggtcgaggacagcaaatgcagagagaagcagtggcccaggcagagctcaataaagaaacaaaagtatattctcctcttctgcctttgcttctccttcgtccccttaaattctttttcttctggatttgaggtagaaagcacattctcctttgctcatatttaacttttctcacttagaaaaaaagtgaagctcgctgccagcactcatttaatttcatataaacatgctctctgagggtgaagcaaatgtgactgattttcaatgtgaaaataaaatataaaaactgttcttggagttatttctaaacagaaataacattagaattgcctgaatcatcagaattgtctttcagaaaaatcagattcatcaaatagatctttggcttacaactgttagagaatgatgttatcatatgtaagaatgctatgttttctaggatttgacattttcagcgattgagaattactgtattttgtaaaaggaaataccactactaaatgctgtaaatagaatgatgtcttttgtttccaaagttgatatactagagcaatgcgaaaataataaaagagagatggccaggagcagtggctcacacctgtaatcccaacactttgggatgctgaggcaggaggatcacttgaggccagttcaagaccagcctggtcaacatggcaaaaccctgttagttgggcatggtggtgcaggcctgtagtcacagctacttgggaggctgaggcacgagaattgctttaacctggaatgcagaggttgcagtgacctgagatcgcaccactgcactccagtctgggcgacagagagagaccctgtctcaaaaaataataaaagcaagctattttgtagcaaagttatctcagggtaaacactgcagctgccagtgctgctggcaagtattcttggggcaaatgcttaacttttcaaaaagctcaagagaccatgatgcttgttttgcaccataccttagaaaacgtcctactaccttgtgtgcaccagccaacaaccatagacaaatgtacctatcttctaccactttttatccatggcaatttcataaaagtttaactatctgtgactcatcacagatgaattttaagtttagttcctagtgtttctcatatccatccttcctttcacctaccattctcatctactaaactcttcaggagtcagaatctcttgatgaaccttgtttttcccttgtttctgtgatcttccctctcatgatggcacaaacccttcccaatccaattaattccctcttccccatttcctacccctattccttctctgcatgtcctactgccctgaagcaggctctacacttacatacatcattttcaggaccctgcaggcttctgcacgagtatagtttctgatggagaaaattacaaccaaaggccaaggaagtggagggagaaacaactttattttcatcagaaattagtaatgtttataaatttgtttatagtagtttgtaaattattatcagaaatagtaatgtctataaaccacttactttaagagacaatcaggaactatgatgagggcaataataaaaggagaaatcttacaaaaaattaacctggatgttgtgcttgctctaaggttaagtcacttagggaaacagattcagtattatccaatggcttaaccatccttccttctttctgtttgctttttggtggtggctgggttacaaagagcagtgtcttctgccctgaaggtagcagtattacggtgggtgcctagaggtcaattattggtttagaagagattcaggcccttaacttttacatgtgctttccaggaaaggagacactttctttctcagccctgtgtgaggactatgttagcccagaaagtgttcttggaccactgggtgcccattctcagtgctaggaacaggaagaccctggtttcctggtagaatttatggatcctacagctttctctccatcaaactttaagtcacagtaagataggactctggagtcacaggcacagccaggagaggtcagcgtccttatgctgactcctggtcctagacatgggtcttaagatccagtagtcagtaggtctgttgcaaagtcagggactggctagatctctccacagcagaagaaagctcatacatgctgacctgaggaacttaatctgacagtttaccgacacactcataacgcatctcttccttcctgtgatgagagtactgctttcatgtgtactgtctgatgacgggtgagggcagagttcttagtgaagcctctctcacagtgagaacacctgtaaggcttttcaccagtgtgggtttttcggtgggcactgaagtgggagctattgttgaagattttcccacacactgcacacttgtatgggctctccccagtgtggatgcgccggtgagcactgaactgggaactgttgttgaatctctttccacagacaatgcactggtaaggcttttccccggtatgggtcctctggtggacaatgaggctggaactctggttgaagcttttcccacattgcccacactgatagggcctctcccctgtgtgagttcgtaggtgggcagtgaggttggagcgctcactaaagcccttcccgcactcactgcacttgtgaggcttctcgcctgtgtggattctttgatgccgaacaagataagaacttcggctaaaggttttcccacattcaggacattgagatactttttccagtttgagcgctggcttgtggggagagtgcacactctgagagcagtttttcccacagaggatatgtgtacaggctttgtccctggcacaaaaactctggtgactcatcttctcctgggatggggttttctcctcactctcccctggagaatttctacattgccttcttgatgttggctcactctccaagcctttttgtagctcagagtgccaataaactcctctggactttctctgtaaagccttgtttatttctacttcctctgaatcatcccattttagattttcttttttaatctcgttcttgaactcaaaacctgaaaaaaaaaaaccccacagaaatacaatggactatagagaaggaaaacaatggaatgcaaagttataactatactacgtagaagaaatatctaattgaaattcttcatgtgattaagtctcctgctaattaatagctttttattttctcattgtaatatttttgagctccaaattattacaggaaaattatgccctaaactccaacttttctcctatcttttttcggatgttctgacacaatgacaaactgaggcaagacattaagcactatatcatctgccagtctgtttataggtgtaccctcaattcttgaatgttctaacttctagcagcagaataacaaaaggcaaccctgggcttggccagctcaaacaggaagaaagcaaggtgctaagtacccagccagcataggctcaggctgtgaaaggcaaggccatgctagagaaaaagggagaagatggacctggtctggaggcctaaccagcagtctgacaatgcatagtgaaactccatgggaaaagatgacatgaacttagttgaaagaggttggcaaatgcaaaatcagggctgtaaaatgcaaggggaataacctttaactccatgaaaaccaaaacttggatagggtcacacatcaagatgatgatgatgccaggatcagtgacagctcctactcaactgctaggctaatggcctctaaagtggactttgccatcctttgaccatcagagccaagggagtcttaccaagtctgtttgggaacagcactggcaggtctagtttcctgacttcctggccaggattcctgaagtccttttcatccctgtctgcaccatccacagtgccatcttctacctccgtgggttccccattctggtgattcagctctccagcctcaatatcacttccttcttggccaggaacagcatcgcttgccataggaggtgcagaggcccaggagcctgaaagagcattcatttcctcataaaagatacaaggctcaggcacacggcctctcctcactttgcggtaactcaactgtaggcttttgaacttggtgcgacactgttctggggtccgcagaaaaccctgctcccagagtccttccgccatggccctgtagatctggctgttctgctgacaggtctggagttttccataaaattgagaactactaagaatagccaggagcgtcttggtctcttcatagccccagggcacacctgttgctgggggacaaagaataggtcaattagatctgtcagttagatcatggaggactgtacatactgcagtgtgcagttttggcagcttaaaaagttacatcctaggctggatgcggtggctcacacctgtaatcccagcactttgggaggccaaggcgggcagatcatgaggtcaagagatcgagaccatcctggccaacatggtgaaaccccgtctctactaaaaatacaacaaaaaatagctgggtgtggtgccgtgtgcctgtagtcccagctactcaggaggctgaggaagaagaatcacttgaacccaggaggcagaggttgcagtgagctgagattgtgccactgcactccagcctgatgacagagagagaatgccatgctcatgggtaggaaaaatcaatatcgtgaaaatggccatactgctcaaggtaatttatagattcaatgccatccccatcaagctaccaatgactttcttcacagaattggaaaaaactactttaaagtttatatggaaccaaaaaagagcccgcattgccaagtcaatcctaagccaaaagaacaaagctggaggcatcacgctacctgacttcaaactatactacaaggctacagtaaccaaaacagcatggtactggtacaaaaacagagaaatagaccaatggaacagcacagagccctcagaaataatgccgcatatctacaaccatctgatctttgacaaacctgacaaaaacaagcaatggggaaaggattccctatttaataaatggtgctgggaaacctggctagccatatgtagaaagctgaaactggatcccttccttacaccttatacaaaaattaattcaagaaggattaaagacttaaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctaattaaaccaaagagcttctgcacagcaaaagaaactaccatcagagtgaacaggcaacctacagaatgggagaaaatttttgcaatctactcatctgacaaagggctaatatccagaatctacaatgaactctaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaactacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtcgcgattcctcagggatctagaaccagaaataccatttgacccagcaatcccattactaggtgtatacccaaaggattataaatcatgctgctataaagacacatgcacacgtatgtttattgcggcactattcacaacagcaaagacttggaaccaagccaaatgtccaacaatgatagactggattaagaaaatgtggcatgtatacaccatggaatactatgcaaccataaaaaatgatgagttcatgtcctttgtagggacatggatgaagctggaaaccatcattctcagcaaactattgcgaggacaaaaaaccaaataccacatgttgtcactcataggttgtaactgaacagtgagaacacatggacacaggtaggggaacatcacacacggaggcctgttgtggggtggggagagaggggagggatagcatttggagatatacctaatgttaaatgacgagttcatgggtgcagcacaccaacatggcacatgtatacatatgtaactaacctgcactttgtgcacatgtaccttaaagcttaaagtataaaaaaaaaaaaaaaaaaagttacatcctggtttctcaaaccgtgccacaactggctattgttatttctaggaagaaatctcactgtggctttttgtctaaaacatgaaaacttttagtataatacaaaagacattccctccactgataatgacttatagggttatttactaaagctgcctatttaatttctcgttaattatcctcaatcctactcattcctcctggagaggtggctggcaataagggtagtggcttgcctgccttgacagttgtgggacttcctgagggtggccacataagaggacacagtgaacaggtgatactcaaggaaagcaaagattcaggggacagaggagctggttgtaacgatatatctgcctgttccctccctgatacaggaatacctcctcagccagcccatctctatctgtttatatctcctgtcatccttgtagatacaggaaactaaatgacagcagttaacacaccaaggtaagaataagtagtaaacatctgagaagagcagttcaggatggctggctactaaataaccctcaccacacacacctgctgcccatctgggccagttcatgaggaccgatttgactagagctgtcccagcaagtgcattccaacatctggtcatgatgctctgaagcgcaccagcctcttcttgtcaccccctcttctccacactgagccaccatcacctcatgcctggatcactgccatagcctatctggtcttcttgcttccactctggaccttctacggtctactttcaacccaacagccagagggagtcccctcctttgttattcaatttaactaacactgagtgcctacaatgccagtttctgagaaatataaatattacatgaaccctgccttcaaggaggtcacagtcctatagaagtctctccagcaaaaagagacacaaataaatgtttacgtagagttaagtgccaaataaagtgacatactcaaagtggtccttttaaaactattactcctctgcccagaaccgcacaaggctcccccatttcactcagaagaaaaaagtccttcatgtagggcctcatgatcccatattagtacttctcaaattatctatgaaggacaggagtcttgtgcttatttcttttgtaaaatacaataaaaatgcaaccgaatagtgcagcagtgtcaaattgttataaaagtttctaattgctccctctcagtctcagctagcagcactcatttgatctggctttctgagctcgttttctcattactcatgggtgtactctgtgccagtgaactggcatgcccacctcgctccagcccaagtcattgcgtctgtcttacactcttcctccatgtaggatatggctgcatagctcatccctcctccttcagcaagtcttttcaaatgtcattttctcagtgagggcgaccctgaggacccaaactgaaaactgcaaaccaacctctgccctagcactcccatcacgctgctctgctgctgcttctctcccattgcgcttatcgccctctaacatcttctgccgcttactgattatgctatggtctgtctcttcccacagggcaggaatctttatctgtttgttcactgttgtatccctaacgacctagaactaggtctgagatactgtaggcactaaattaatatttgtggaaagaatgacttgtcctctcacattctgtctcaactcttacctctaattttaaaggatcctcaatggttgacaagaaaccaaaagtgtgtggggaatacaagccctcattcaataagcctaatgttgtagcagttaaaattacaggtaccattacatgaaatattcagaatagctcaatccacagagacagaatgaagactggtgtctgcaaagggcttgcaggggaaggacggggagaaactgctggatggttgtgggaccttactttggagagatggaaaggttctggaactggacgtggtggtaattatacaacactctgaaagtgctagaggccaaagaattgttcactttacagtggttaattttatgtcatgtgaatttcacctaataagttaaaaatcacaagtacaaaaatatttatatctcaccttattgtattatccatatatacttagtaatacaaatctcaatacagagctcaaaaagacactatactctcctgcaactggacagagatgaggtgcagaagcctgaagcagcagcaagaaatggcacatgatgaagccaggaaactgggagttcctggcaaaggaggggagggatggcaggggcagagcagggaaaaaccacacaccactggggagggcaacattgtagagtgaggcggggcactgtcacagggcctgtgttcacagccttgtgtagtccctcccaccctgggcttagccaggagtaccctgcatgtgaagcagcagaggagaaatctaggcccagtgagctgcagtgtctgtctctgaatctgcatggtcagggaggctgctctgaggaggaggcatttggcccagatgggacagaactgatttgagaaaggcaagagagcggtctgcttggcagaaccttccccaagtgtcctgagatgctgggaaagggcctggttcctcccggaaggcctgggcatagtagactgtcctggttgggtggttttatttgttaatctcctctgccactggggaaactcgggagcgactactgctacctgtgtgcatgagcgcacattcagcatgaacacatctgtgctcctggtggccacctgtctggctccggctctggactacttgttctgactctgtctcactaacattttgcttctccaccgcctcacccttcacctcccatgttcttgactgccggtcacacatgctgcccctttcttttgatctctgcctgtgtctctctggcctgctctggttccccatttacttcctcctttccctccacccaacagtctccccactccctctgtctccctccctctcaagtcctttcagcctctctgaacaactgaacacatccaccttgacctggagggaagatggatccttacccagcgagacgtgactgtccttcctctgggtggcacccctgtagagggccctttgtgcagggcctgggcacatccattcttgctgacagagggatacagctctgttgtcacgcatggctggtccctgtaacaacactggagctgctgctaccgataaaatagcaccactctagcctggggtgggggcagagacaggatcacagttgtcagatcaggggcaaggcaaaggcaggggaggtcagctcccagtgggacaggttctgagccatgtgatgatgtcagagtggacagaatcaaaataacccgagaagccccatggaccacacagaatctttctcatgtctctggaaaggaggagggttttggggtgagagtgggtactcaagagacagaaggcatcaaccacagctcacctgggacccagctgtccagaccacagcacctgtctcctggtcgtggagacctgtgttttgaggcaggttcctgggagcctgaggagcaagccaggctgggggaaaaaacagccgctattagagggcggcttccacacaacagcacagagcagaagctctcaaagtgggctcctgggccagccgcatcagcagcccctggcaacccatcagaaatacaaattctggggccccacctcagatcttctgaatcggaaattctggaggtggggcctaggactctgttttatcactctcccacctccgaatgagtctgaggcaaactcaagtttgagaaccactgccagcgctcacggcctctgtgagttgagaagttcctttcatgagattcctcttggcataagagctttaatttttttttcattttaaagaaaaatatacatgtcagggaaaaaaagagaatcgtagtgggcaaacaaaaatctctccatagccctgccacccaaagataaccagagtactctttaaaataccacagtaacagaaacccttcatatttttcacaccaagataatacattttttctcaagtctccaacttcaagaattgtacaaatatgactgtgacatcgcttaaaaatacaggaaaattaaaaaaattgtacaaataaaatgaatcatgtctatgacttattaatggaacttcagtggcaactcagaggtatgtgacccttcgggaggtgacaacactccagatctgtgagtggcccatgggcctgggaagagcgggagcctagcctggaaggcagcaagtcctgcttctctttacttacagccccctgctgtcccaaagccttggaaatcacacacagagaacacaggtgttcccaaggattaaaaggaaataaatgctaagtggcaaagtttataaagatgttgacaagagtattaactttgcttaaaaaaaaactaaaatcagccgggcgcggtggctcacgcctgtaatcccagcactttgggaggccgaggcaggcagatcacctgaggtcaggagttcgagaccagcctgcccaacatggcgaaaccctgtctctactaaaaatacaaaaaattagccgggcgtggtggcaggcgcctgtaatcccagctactcaggacgctgaggcaagagaatcacttgaacccaggaggcagaggttgcagtgagccaacatcatgccgctacactccagcctgggcgacaagagtgaaactccatctcaaaaaaaaaaaaaaaaaacaaaatactaaaatctcttagacaattttccagtttatcaacacaggtttgccaacttaaacatcatcaagacacactgtttttcaggctggatgtggtggcacatgcctgtattcccagcactttgggaggctgaggcaggaggactgcttgaacctagcagtttgaggcagcagtgaactatgatgccaccactgcactccagcctgggcaacagagcaagaccctgtctcttaaaaaaacttacctagcaacctgtaatggcagcttccaattaaacagaaaaggcagcaagtatctagccaaattactttatggaaaaagacttataaaaatatagacccttggaatatccatgcaatggaatattcagccatcaaaaggaacaaagtactgatacatgctcaaaacatgaaaagtgaaagaaggcagacacaaaacgtcacataatacatgtgattcaacttatatgaaatgtccacaacaggtaaatccatggaaacagaatggggagcaactgtttaatgggtacagggtttccttttcgggaggataaaaatgttttgaaactagacagaggtgatggctgcataacactgtgaatgtactaagcataactgaattgttcattgaaatggttaattttatgttatgtgaccttcacctcaattaaaacaattttttttttttttttttggtagagacaggatcttgttatgttgcccaggttggtctcgactcctaggctcaagctatcctcccgcttcagcctcccaaagtgctgaggttacaggcataagccattgtacccagccaagataatttttttagtttaaaaagttttctaaggccaggcgtggtggctcatgcctgtaatcccagcactttgggaggccgaggcaggtggatcacgaggtcaggagatcgagaccatcctggctaacacgatgaaacgccgtctctactaaaaattcaaaaaattagccgggcatggtggcgggtgctttagtcccagctacttgggaggctgaggcaggagaatggcgtgaacctgggaggcagagcttgcagtaagccaagatcgcattactgcactccagcctgggcgacagagcaagactccgtctcaaaaaacaaagaaacaaaaaaagttttctaaaaaaattaagacaagtaaaaacaaaaaatagagctctggaagaaaagcaaaaataataaaaatgtattctggaaaagattaagttggatggggaaggggatttaatgtcttcaagtatatgaaaaactgctgtgcagaaggtgaaggtaaccatgttcacctttaatgacacctgattctttagtaacagaattgtaataaaaaagaattatgctaacacataaagaatctctgttcctactttaagtgctattaccctcaactgaaatttgtaatcttgcttttggatatggagagagatatatatatatttctatatatatatttctatatttatatatatatttatatttatatatatatatatatataaatttatatattttatatatatatatattttttgttttctttgagacagcccaggctggaatacagtggtgcgatcttggctgactgcaaccttcacctcctgggttcaagcagttctcctgactcagcctcctgagtagctgggattaccatgcccagctaattttttgtatttttagtagaaacggggtttcacgatgttagcaagactggtctcgaactcctgacctcaggtgatccgcctgtctggtcttccaaggtgctgggattacaggcgtgagccaacacgccctgccggtttttggatgtatttcaaaggcatttagtctggaacccttgggtggactcagttcagacctttgtttccagtaaatgattgttcctcacctgcctcaggtgaggacagaggcttctgcttaccttctgactgttcccctggtctttggtgtgagctctgtgatcccttaaaagtcggttcctctggctgaacctcctgtttccattgggatctcagtgattctctggttgctcccaaaggggccatctccttcatgagtactttcaagtccttctcagaatctagaacctgagaacagaccccattatctatcactacaaattcctgcctaagctggactttacaactcctaagagtggcattaaaaaatgtgtaacataaggaagcagaagagaaaaatctaggagccactgtattgctgctgtaataaaataaaaattaatagaattaggtatttgaggggcagtagcttacgcctgtaatcccagcactttgggaggccgaggcaggtggatcacgtgaggtcaggagttcaaggccagcctggcaacaaggtgaaagaaaccccgtctctactaaaaatacaaacattagctgggtgtagtggtgtgaatctgtaaccccagctatttgggaggctgaggcaggagaatcacttgaacccaggaggcggaggttgcagtgatccaagatcacgccactgcactccagcgtggacaacacagcaagactctgtctcaaaaacaaaaaaaaactctttgaagtggttaagattatttatatgacagcacctagcatagagcctgacacaccagaactgttaaaaactgaaatatatttgtcagaagagagaatgtcagctttcactttagcaaacccccatgacttcagcactaggccatttcctctgccccccaaatccagtatcagttctgtcttcaaaagagacctcgcattggtcctctctcttcacctcatggctccatcagggtccaggacactatctgctgtctgcatcctctctactgctggaccctccaatccattctctctacatggaacccagtgtgatctttttaaaatctagagtcctgtccctccgtagtaacagcactcttcagtggcttcccactgcacacagaataaaatccagactcctctttgcagcctaaaaggcccagcatcattctgcccggcctcctccctttctctcacagcactcttccccagtctctgagctccagccacaagccctcccttcttcctctcaaacccgcccagtcttttcccaccttaggctcttggtatgtgctgtgccctctgtctggagtactctcctcccagctcttgggacaactggttccttctcctccttcagtgtcacctcagagaagtcctgcctcacagcctatctcccaacactccagttatcacatcactctgctcatttccttccaagcactcatctgaaacgatctttatggtttacttttgatttatgattgtctgtttcccccatggaccgcgggctccagcaggccaggggccgtgcctgtcctgttcactgtaaaatcctcaatatcaacggtcactgaaaatcaacttttgtctttcagagccatcttcattctttaagtcccatgcttataacaaacacccttaaagggaatgaagagaggtactgagaggcaagtggggtcctgagaaattatatcaacctctattactactacccacctccacttcttgctctctccttcactttcatgataggtaataaggtttggctgtgtccccacccaaatctcatcttcagttgtagttcccataatccccacgtgtcatgggaaggacccggtggacgtaattgaatcatgggggcagtttcctccatgctactctagtgatagtaagttctcatggcttcccccttcactcagttctcattcttctctttcctgctgccatgtgaaggaggacatgtttgcttccccttccgccatgactgtaagtttcctgaggcctccacagccatgcagaactgtgagtcaattaaacctcttctctttataaattatccagtctcgggtatgtccttatagcagtgtgagaacggactaataaattaggtttcaaataggtgtttaacctatacactcctgcactgttttcttttatattaagagtgtgggccgggcacaatggttcacacctgtattcccaacactttgggaggctgaggtgggtggactgcctgagctcagaaggtcaagaccagcctaagcaacatggcaaaacctcacctgtaataaaaaacaaaaattagttgggcatggtggtgtgcacctgtagtcccagctacttggggggctgaggcaagaggatcgcttgaacccaggaggctgagactgcagtgagccgcattcatgccactgcactccaacctaagtgacagaccaagaccctttcaaaaaataaataaataaaataaacataagtgtgattccgacatggttaaggataagaagaggagagaccatcaaacagagtgatggaaggggaactgggctaggatgactcttggcatactgggattcccactctatttataatagttcagttctccaagttctaccttcatacaagtgctactgcacctctccattcaatcttacttatgaataagagtcccaatcccacagatttcagactaatttcctgaacttcttccctgatgcatcaccatcaagctgctcttcccctctctaaattaagtcaaaagtactaactcttcaatcctaccaaatttcatctatatcccccttcacccattcctcttcccacagcccgtgcacatccctacctcctcactgggaaacacaagtatatctgctgcctagggccttcccattccagccatgcagactctggcacccagcaagctgcttcctgctctgatcacagacccactcaggctgaccaacgttcctctgacctgtgccctccattactctaggcctctcccagacttacccaatttcagttgccttcctcctaccaactcttccacaaccgaagctggtatgttacttttcctcttcctgtgcctttcccacctccctgctccaagaaaatataagctggttacaccaatcagatctcagacctagtcctgaccgtaagaggatattttatgaatccatcagtgtcccaaactgaacacttaatcccggcatcaagaactagagcaaggcctggctctaatataattttgttgagtgtacaacacatgtcactctgccctcaaagaagctcctagcatgaaactagattttcattcactagcatctctagttttcctccatcccctgagtgaaggagagttgtcctttccctggccttgttttcgagaatttttctgagtgtttttaccaccttaattagggacttcaaatattattaaatatatgaatgtctagcagctgtatccacagatgagaaattcttcccgtattataagggcataggaccaatccaagacagccaagaccttctgtgggcagcagagggctactgtgtgtttctcaaccaagcacctctccagtaactggattccccgacaacttcataaccaaaaccacaaagttccgacttccttttctcacctgttgtccaggagctctctgtacatcctcaaccagagccacagcttcctcgccgttttctggatgctgctccctcacccaggtctggatctcctctggcaagatagtcagaaactgctccaaaaccagcagctccaggatttcctcttttgagtgggtcttcggcctcagccactgacaacagagttcccagagtttgctaaaagcttcatgtgggccagttacctcctggtagcaaaactgcctgaagcgctgacgggaggcctcggagtcagggctgttaccctggagggctgatttctggccctgtgtgggatccttgtttgaggatgggtgtgcctcggtactcttcactgcagccatcatttgcttcaacgaactggcttactctggttgccacttctaccctggagatcagagtccatctttcccacatcactgggaagccatgttctcctgcaaggaatgtctttctgtaatccgtgggacatgagagtgtcagacatgtgtagagactcacagcggaaaaaaagggctcaactttgaaggatgtctgaagaggatggaaaaagacaatataaacctatcaaacattccttcactctggttcttgtgatttacttcctatccctttcctttactccctccacaaatctacaccaaggatccaaaacactagaaatagatctagaccatcctggctaactgcctttgcaaaaaccattaacagtgagaagattatgacactaaaagagataggatctaaccaactccatcttgcttttaacctccaaactgccgttggtcattcctgggtgtgggccaagctagctttgggagaaatttagtttatagtttgaatgataataacccttcccaaaactaaactgcctttgtaaaactaattaaagacaactaggttaggaggatgagaggggcctgaattctgctaagatgcaggcataatgaaatgattatccagaggtcacaagatttgcaacttccccaattaaataacatcacgattgtagaacctaagattggccttttgagatgccttttcaggcctctgctttctgacaaccagatggctccacctagaccagggactcctctgtggctcccacccaaaatcgcactcagcacacaaaaaccgttttccacagccctatgaatgcatccccaaccagtcagcattccctgttccctacccaactgcgtgccaaagccctagcctctgaatttccggggaggctgacttgagtaataaaactttagtctcccatttagccggttctgtgcgtattaaactctttctctattgcagttcccctgtcttgacaaactggctttatctaggcagtgggcaagatgaacccactgggcagttacagtaccaaaaaatatagtcttctcccagccaagattctgtgtctgctgacgaattactcaaactgttcctgacgatatagttcacctgttccttcccttcttccctcacacacctaggtctttttcctgtccttccctatcctcaagaagcctgaattcatgttcccaattgctaccctctcctcgggggagaactggtgtgtgtgtgcttcttgattaacttcttcattactattactccacacacacacaacgtggataagtgactgttcgggtttgctgtatgtttttattttccagcattcctttcccacttctagtagcagcatcttcttcctttgtgaaaaagtccccctcgaccaggcgtggtggctcacgcttgcaatcccagcactttgagaggccaaggcgggcggatcacgtggtcaggagatctagaccatcctggctaacaagatgaaactccgtctctactaaaaatacaaaaaaattagctgggcatggtggcacgcacctgtagtcgcagctactcgggaggctgaggcaggagaatcgcttgaacccgggaggcggaggttgcagtgagctgtgatcacgccattgcactccagcctgggcaacaagagcgagactgtctcaaaaaaagaaaaagtccctctcattggttctggtggggatattaattacaatacccacttccccagaagtgggcatatgacacacagctaggcctatcaaaattcttttctcagattttacatgagaggtagggaaagctcttcattttctaggaattggtaaattgggcaaatgtaagatcagagttgtctccaactatgtcccactctctactccactcttccatcacaggagtgagcctgtttacaagaggacaatatactcaagtcttgacaacatgtttggatctccaaggccagtttatgtaaggcaatatttttttaagagttaattttaaaaatagttttatataatttaaaattaataaataacttttaaaaataattttatttgtttttttatctttagagatggagtctcactctgttgcccaggctggtctcaaactcctgaactcaagcaatcctcccacctcaacctcccaaagtgttaggattacaagtataagccaccatgcccgaccttaaaaataattttaaatagaagctaacttttgtattttttgtagaggtggagtttcactatgttgcccaggctggtctcaaactcctgtgctcaagtgatcctcccaccttggcctcccaaagtgctgggattacaggtgtgagccactgcacccgcgaaggcagtcttttttaatgagtttgtgttggtttttatctacttaaaacacagattaaagcagatcgtaatttacattttctccaggggctgatacaccctcaccatgtggtattaaaatggatccagcatgcacaacaagatgaatatactcaggactactgagctgtacacttaaaaatggttatgatggtaaatgttttttaaaaattaaagaaatttttttatattttaaaaatggatttgggttcccttttctcaaggaacttgaactgccttcacttaaattctctttacatttcagtgcttctagagatagagaaatcaagggcattattattgttagcactgctttctagccaaaaagaaactgagagcgatgaagtatcttgcctaaagcatcacacagcacagctcctaggcagcaaggccaggactagaaccagcaccccttgccttcattatgttcatcctgtgccttacctggctgaagaagaatttaataaaagctcttctaacttcatgcagaaggcggaacctgcacccttcttgaccccttttgaccccttacctcccactcatcgttaaattttaaaatgctgttctctgaaaattttacttcactctagcgatggcccaaacactcggaaaaaaatgtagcatgaggatggggagccaggttgataggtttttcacttagttaactatttattgagtactcagaacgcactcggtgccagggctaggcactgtggatgagtagggagtgggcgagacagggacgagatgagcagggtcaaggccagggggtcccggggcgccggcgctcaggctcggggtgatccgcacggtgggagcggggcacggtgatcgcggcgcgtctggggacgcccggcctgagggaggctgcctgtcccaaggagacgcccatcggggccggacccgaacgcctcggagaagactcccagcggggaggggctcctcggccgtcgcagggcccagcggctaatcccgccggccgcaaggaagcggagaactcaccggacaccagcactcgcgactccacaaactccctcagcctccgggccggaagtcagcggcgcgattcgctccgcccattacgcacgcccctgcgcaggcccgcaagccgaattgccggactgcagctcccgggatgcactgcgacggtattgacaggcgcagcaaccaatagacggtagagaatgcccttggcaggaggcgggccctgtcagtagttgtcctcagcagctagtgggcgtctccgcagcgagtggcatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtaaggagggtcctctcccatcatcctggggatttctttttcttttctttttttttttttttctttttttgagacggaatcttgctctttcgcccaggcccgagtgcagtggcgctatctcggctcactgcaagctccgcctcccgggttcacgccattctcctgcctcagcctcccgagtagctgggactacaggcgcccgccaccgcgcccggctaattttttgtatttttagtagagacagggtttcaccgtgttagccaggatggtctcgatctcctgacctcgtgatccgcccgcctcggcctcccaaagtgctgggactacaggtgtgagccaccgtgcccggccgatttctttttcatctgggtaatgtttggtatctggatctctccctatttaagtctcagaagtggactggatggcttcagaagttgcttccagcctctatctgggaacctatcctgagttattaacaggtttttagaaaatccaactactgatacccagtgaggcaacagaggaccaaggttcttaccattcctttatgcaccttgtgtcaccagaagtaattgtaaggttcttaaatcccttctgtcagctcttcccccacccaacttagttttcctactagcagaattcttagcagatagggtcaccctgttgggtagcagttggactttggggaacttcatttcattggaagttctagcttattgtctttccagtgtttagcttatagtctttttttttttttttttttttttttttttttttttttgagatggagtcttgctgtgtttcccaagctggagtgcagtggtgccatttcagcccactgcaacctctgcaccccaggttcaagcgattctcaggtctcagcctcctgagtagctgggtttacaggtgcctgccaccacgcccagctaatttttgtactttttagtagagagggggtttcactatgttggccaggctagtctcgaactcctgacctcaagtgatcctcccgccttggcctctcaaagtgctgggattacaggcgtgagccaccacacctggcctagctttttgtctttgatttttttttttttttttgagactgggtctcactgtgttgctgaggctggagggcagtggcacgatctcagctcgctgcaacctccatgtccagctcaagtgttcctcacacctcagcctctcaagtagctgggactgcaggtacatgccaccatgcgtggctaatttttgtacttttgtagagacagggtttctccacattgcccaggctggtcttgaactcttcttgggcccaggcgatccgcccgtcttgacctcccaaagtgctgggattacaggagtgagccacacaatgcctgactagcttattgtctttggatcaggaagttacagttcaactggccagcgttgccattgcttgccactccccgccccgaagtcagaccccagtcaggacctaggcaagaagcaaacggcaggtacttcggaaaatagaacttgttagggaatgaaggtggggtggtcctcttagacccctactactactgggatctccttaccaggaaagcctttggcagaacaatgtattaggtaagaaggacttttaacagcccctcaccatactgcttcctgttcctacagggcctatttccagcagaagtaggtggggggtggtgtgtagagtaggcatctgatggcccagtgttgtgactgaccctgatatttgtgccagcaactaccctgatgactttgactctggcccttgagaaaggcccaagctttaggggaagccactcggctgatttgtagcatcctcattcctgtcattcttcacgttctcccctttacttcctttgagggtttcagtggtttctatgaaagttgacctctagatggttatcagcaattcccaaggtaaacgggtcattatacaacagtgagagatcaagcttccctcagtcctgatggatggaattaatggatggggcttgttcctaggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacaggtaaacactctgccttttctctccctctcatcagccctttatctccatcaatgtatctcatggttctgcaaaggcatagaccacatgtgtgtgtttttttaaatgttatatataatagtagatgattattcactaaacaaatttcactaattaggatggtggtgatactacaagtaagtatgtttttatcgttttctgttaatgaaaatttaagaatccagtgcatgacagggttgtacctacttttctgtccgtttcagaacttcttatagaaaagacagatccaaatatggccacagatgaacttccatgcaagctatggctgagtttcattgcttaaaatgctcctctgtttagaggggcctggtagaaataaaaacccaccctatatcttatatctttgtcctcctctgtgatgttgcttgtactttagatcctcaaatctatttccctttctctggtgtgatacttgtgtaactgctggccttgttctacacagtcctgtgatctctaagcctgaatgacagtgacattttggccaagcctggtgatgtgaatacaagatacagtgagcacgttagggaggagggttacaagacgacaaaaatcctcagtttcttaatatttgctacatccaatgaggtacttcgtgttttagtctgttcaggctgctaatataaaatgctagagactaggtagtttataaacaacaggagtttatttctcacagttctagaggctaggaagtctgagttcaaggtgccagcatggttgggttccagtgaggcccctcttccaggtcacagactgcctacttctcagtcctcatgtggcagaaggggaagacaggctcccgtggggctctttcatgaaggcactaatcccattccagtgagggcagcaccctcatgacctaatcacctcccaaaggccccatgtcctaacactattaccttgggagttagaatttcatatgaatttggaggaacataaacatttagcccctggcaaccacagtctactttttgtctctagaattgcttattctgaacattttatacaaatggaatcacacaggccgggcacagtggctcacgcctgtaatcccagcactttgggaggccaaggcaggcggatcacttaggctcaggagttcgagaccagcctgggcaacatggcgaaatcctgtctctacaaaaaatgcaaaaattagcggggcatggtgctgcacacctgtaatcccagctgcttgggggagctgaggcaggaggatcacttcaacctgggaggtcgaggctgcagtgaactgagatcgtgccactgcactctagcctatgtgacaaagtaagaccctgtctcaaaaataaataaataaataaattgaatcacacaatatgtggtcttttgtgtgtggcttctttcactgagcatgttttcaagttttatccatgctgtagcatcaatcagtgcttcattccttttctgtggctgaataataggcattgtacggatatattacatgttggttttctgttcatgttggttcatctgttcatagatttttgggttgtttctactttttggttattatgaagaatgctgctataaatgtgtgtttttgtgtagacatgttttcatttctcttgagtatatacctaggagtggaattaccatatgctaggtcatgtggtaattccatgtttaacttatgaggaactaccagactgttttccaaagcagctacaccattttacatccccaccaatactgtgtgaggattccgatttctccacattcttgctagcacttgttattgtcttatacccatcctattcggtgagaaattttgatttgaggttttgatttacatttccctagtgactaatggtgttgaacatcttttcatgtgcttattatccagttacatatcttgtgtggaaaaatatctgttcagatcctttggtcatttttaaattaggttatttgtctttattttttataagagtcctttatgtattctagatactagacccttatgtgtaatttgcaaatcttttctctcattttgtgggttgtctcactttcttgacagtgtcctttgacgcacacgtttttcattttgctgcagtctaatttatctatttttttctttctttatgctttggtgtcatatgtaaaatagcactgcctaatccaagggcacaaatatgtacagctatggtttcttcaaggagacatagatttagctcttactttcagctatttggtccattttaagtttattttttccccatacataaacaagtcaatttttatataggttttgaggtaggggtctgtcaatctgatcaggggtctgtcttaatctgatcaggctcttacaacaaattgccttagactaggtaatttataaacaacagaaatttgttgctcatagttcctggatactgggaagttcaagatcaaggtgccagcagatttggtgtctggcgagggcccattcctcataaatggtgcctgctatgagtccccacatggtagtctcttgggtttcttttataaggacactaatcccatttatgaggaccccaccctcataacctaatcacctcccagatgccccacctcccaagaccactgcactggggactgtcaatatatgtgtgtcaggggacaggggggataaacattcagaccatagcagggtccaacttcattctcttgtatgtggaaatccagtagtcctagaatcctttatgaaaaagactattcttttcccattgaattgtcttgtcaaaaagcaattgaccctgattgtataggctgattatttacatttgaatttaaatgaattaaaattaaaaaaaaatttaaaattaagttccttagtcacagtagtcacatttcaagtacccagtagccacatagtcacatgtggctagtggctgccatattgaacaacgtgcatgtgcctgtgcatgcacgtgtgcacacacacattttccacatcacaagggatccttctccagatcctgtgatttcccataggccgttccagctcatctccatccagactgtcaatccttctgtaattaggatacatggctaagccctgattccagtttctgaactcatatactgtcaaatttgtaatgaaagaaaacatcacagtctctgaacttaccatcttttgaagagaaggtggttgtcaattagtgtttactaagtgaggggtatttgttgaaatagctcaggcattggactacagcagtaaaatttgcaatgttgagatttcacctctcttccttcttcattagatacccaattctgatgggtttgcttttccctgttcttcatttcctaaacctttccctaaagggagaaaggaagaaggaggatggagaacttggttcctaaatttaatataaatcacagtcaccccaggagcctgctaactgtgcagattatcaggcccaaccccccgagattctgacccagcagctctgggggaagggtgaagagcctgcttgtttaacaagtgctccagatgagtctaatgcaagttgccagcggagggccaccctttgagaaacctctcagagtatttcataactcttgctgaagttatttcttccaagtgcagaaaatgaagcattttctttctaattatagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaatttcaaggcaaagttaattggaaaatagatccctcatattctttctgtaattactagctgtttatagcaaaggatgaattaaatgagaatatgcacgtttgtgcgagaagagtttccaagtagttagatggtgcttttacaaaaagaaaagaaaattacatttgagggatcttttttgtatcaaagcaccttttttttttcctttttattttttgagacagggtctcgctatgttgcccaggctggtctcgaactcctgggctcaagcaatgctcctgccttggcatcccaaagtgctgggattgcaagtgtgaaccaccgtgcctgttctcaaagcacctttgattgagaaaaaaaaaatctacacagttgctgcaaccccagcctaacacataaggaaaagctacagtgagaagcaagtagtggacaaagagtactaaggagatataaaagggaattcttcccactctcctttctcacttagcccattagctttaagaataacaaaatgcaatgggggtacagtggctcacacatgtaatcctagcactttgagaggctgaggcagggtgatcgagcccaggagtttgagaccagcctgggcaatgtagctaaatcctgtctctacaaaaaatacaaaaattagccaggcatgatggtgcatgcctataatcccagctagctactcttggaggctgaggcaaaagtattgtttgagcccaggagttagaggctgcagtgagctatgattgcaccactccactctagcctggatgacagagtgagactctgtctcaggaaaaaaaaaaaatagcaaaaggattggggtaatgaaaatattctaagactggattacagtgatggttgcacaactcagtaaatttactaaaaataattgaaatgggctaattttatgatatgtaaattgtacctcaacagcgtatttttaagtgacaaaatatatttatataaaatgagccctggaaataagcctgagcgatcatctaatgccacctcctcgttttctcaaagcggaaattaaaatgcaaatcagtatacaattcctagctcattgctcagtttagagaaaacttttggcagattagtgcattcctgatgcagaaaataagaagcaagtagcattttttttttttgagacagggtctcactctgttgcccaggctagagtgcactggcgtgatcatgcctcactatagcttcgatcttctgggctcaagcaatcctccctcctcagcctcccgagcagttgggactacaggaatgcaccaccatgcctggctaatttttctatttttttgtagagacagagtctcactgtgttgcccagtctatcctcgaactcctgggctcaagccatcctctcactttagactcccaaagtgctgggattacagatgtacgctcagcaaggtagcattcttcacaaaacatcagtatcatcaagtaactaccagtcacctcagggctgtgggctgagctcttctgtaccccccaaggaatctcttgtcccttctaactgccgagggacatatgcacacctatgagtcctctttggggcctttgcacacaattgtttcctttgcctttatttcctgatgctccccactccctcctgcctcctccctctcacaagagtttccttctctcaaagccttccctgaggagccctaggcagacttctgtgaaaattggggtccagcctctctgctagaccccatacaccaggggtgctcaaactgggagccccccaggggttgtcggacaaagtccaaagacacttttggttgttaggactggggaagggaggcttgttgctggcctctagtgggttctactgaaccgcctgcagtgccgggacagccagcccccacagcaatgacctggctcaaaaaatcagtatcaccaaggctgggaaactaccatgcactataacagctctttcaaaacaagaacattgtttttccataactttagcttctggactttgtcaataaccagccaagagaaacagatgttcagtatgtgaacagttgagaatccccactgtacccacagggcccatgtctgcctgagttcagagatcctggtgacaatctgttgaatgcacaggtgagcttctgtcttttgggcagaggcttattgaaggcccagtggccttccttacagcttttgtggtcctttaggtactttaggccctgatcccattcccatctgttatgttagatcatgaagaatttagcttctgtatccgagctgccccatacctggctccatcctgatacctctccctggtcaaggcctctttcttcctcattgtgtttccacctcaccctactgaaaccaggctgatttcactgttgtcccttaataacctccaagtcatagtcacatctgtattaggtactttgtggtgtggtaacagatgacccaccagcttaatggtttaaaacaacacaaactggggccgggcgtggtggctcacacctgtaatcccagcactttgggaggccaaggttgtgaaaagttcacctgaggtcagaagttcaagatcagcctggccaatatggtgaaagcctgtctctactaaaaatacaaaaattaaccggatgtggtggtgcacgcctataatcccagctactcgggaggctgaggcagaagaatcacttgaacatgggaggcagaggctgcagtgggccgagattgtgccactgcactccagcctgggcagcaagagtgaaacttggactcaaaaaacaaaaacaaacaaaaaaacacaaaaagcaaaaaaaccgccgggcacggtggctcacgcctgtaatcccagcactttgggaggccgaggtgggtggatcacgaggtcagaagatcgagaccatcctggctaacacagtgaaaccccgtctctactaaaaatacaaaaaaaattagctgggcgtggtggcaggcacctgtagtcccagctactcaggaggctgaggcaggagagtggcgtgaacccaggaggtggagcttgcagtgagccgagtttgcaccactgcactccagagcctgggctacagagcaagactccgtctcaaaaaaaaaaaaaaaaaaaaaaaaaaaaaacccacaaccttatcgttctagaggtcagaaatctgaaattgatttcactcagccaaaatcaagctgtcggcaaggctggttcctctgaaggctctgaggggtgaatctcttgccttgactttttcagcttctaacagccacccacatcctttggcctccaccctcaaagtgcatcactccaatctcattccaccgcattctcctctgactatgaccttcctgcttgccttgtataaggaccgttatgatgttgggcccaccggcataatccagaataatctccctatctcaagatccttaacttaataacatctgcaaagccccttttgccatataaggtaaacttaatgggttccaagtattaggatgtggacacatttggggtgccatgactcaacccaccgcacatatccatcttgaatcaagttagtcaaagagcatctctcctaaaagagaaggaccatagatttctacttaattataagggttggggtcaggcgcagtggctcacacctgcaatcccaggactttgggaggccgaggcaggcggatcatttgaggccaggagttcaaaaccagcctggccaacatggtgaaatcctgtctgtaccaaaaaaaaaaaaaaaaaaaagaattagccgcgtgtggtggtgtgcgcctgtagtcccagctactcacgaggctgaggcatgagaatctcttgaacccgggaggcgaggctgaaggaaggtagaggttgcagtgagctgagatcgcaccattgcactccagcctgggcaacagaccatccccaagcatagccttcctttggtataaggctcaactccaggccaagaggaccaggaagggtccaatggctacaagaacccaaggtcctgtactcagatgtaagtttcctctcagcccccgtacccatgcatggtctgccagaggacctcagctgctccaatagattgtgattctccgtatccaccagtctgtctctacaaattttggggtggctgtttgccctgtgacctcacttctcttacagaagaattgttgggtttttcgggttgttcagctttttatttgtcattagaatggagtgacaactttcaagctccttatatttgcaaccagagactggaagtcacaagagtgaaacaccgtctcaaaaaaaagaaaacagcagtgagacagtgactccctgacctcactggctagatgaattcctcttaaaccttctcaaagcaaaacatggctctacttggctgcagttgccctctcaatgcagatcgcaacgaaaccctctcaatgcagatctctgccttcccgcctcaacactgcacccgggagccctcctccaagggtcagtgcccgataggtttgagggcaagcccccgccagggtgaagccgcctcctcctctgggcctgggacgtgctgggagggagggaacgcggtcccccggggagtcacatgcccccattcccggggtcacccagggacaacgggcaggaatagacaggtaaggaccctgcagctgagcgagccctgtggccggatgttccaggtaggcttttccggaaatcgccaccggaggatagaacgctcctagggtgaggggcggggcctcgacaggaaatacctgaaagagtcccctctgagtgggctgcttggcgcccagcccgaggaattctcaccttccattgcctggcacagctgtcagggtgaagaggaggccgggcagccacggagccctctgggaattgtggttttcgtgggctccacgtactgctgagctgttgcttgcctgagactgttgaacctcaaagggtgtcctggggttcattcattaagcttgttcacgcaaatgacaaatatttattgactgtccacaacacgccaggcaccaataggggctggaggcaatatggtgaacccggacgatgctcatggtctcttagaaagcccagtctccaggccgggcgcggtggttcacgcctgtaatcccagtactttgggaggctgaggtgggcggatcacctgaggtcaagagttcgagaccagcctggcctacatggtgaaacctcgtctctaacaaaaatataaaaaaaaaaaaaaaaaaaaaaaaaaaaaaattagctgggcgtggtggcgtgcgcttatagtcccagctactcagggaggctgaggcaggagaattgcttgaacccaggaggcggaagttgcagtgagctaagatcacaccacggcactccagcctgggtgacagagggagactgtatctcgggggaaaaaaaaaagaaaaaagaaaaaagcctagtctccagcaaggaacacatctgaatcaaataattacacaaaggcaaaactgcaaccacacagctcctaaaagaaatgttaaaacagaaatggcacaataacaagtgactgaggaaggatctaatttataaagatagaaaggtttttgttttgtttcgttttgtttttttgttatgttttgtgttttgtttttgagatggagtttcgttattgttgcccaggctggagcgcaatggcgcgatctcagctcaccgcaactgccgcctcctgggttcaagcaattctcctgcctcagcctcccgagtagctgggattacacacaaccggccaattttgtatttttagtagagacagggtttctccatgttggttaggctggtctcaaatgggtgatctacccgccttggcctcccaaggtgcagggattacaggcgtgagccactacgcccagccaaaggtaggaaggtctttatgccacccccaaacattctcttgccagggcgatcacttgatgacgacagcgattcctcacagagatacaactgacagcacatctgctttgactagcatattcgagatagaccctatgattatcttcctggcatttgaggagactgagattcaataatgtttctggagtttgtacagctcataggaagttgagagatgtaacaacacacctccagtgcaccttccatcctgtctcctactgcctgcccaacataccctacaacctggtcctatattttctgatgtgtgaaatgtgatgataatggtgaaataatccaggaaaagtgcttagcataggagggctggcataggacccgcacttgaatggtgttagccacttttataactattctaattacctctctgattctctactctgatttaactattatttttaacccaagcacccatcctctcttctccttcttctcttttttgaggtagggtctcactctgttgcccaggctggagtacagtggtacaatcatggttcactgtagccctgaactcctggactcaagtgatccttccttcacacttaatccctgtgattttggtagaactgataccaactccaggacagcacatgagaatccaacctgaacagtctactccatcttcctggccacagcgtgtacaacacttaagatgtacaacatgatattctgatatacatatacatagtgaaatgattaatatagtcaagcaaattaacatatccatctcctcacacagttaccttaaatttttttcctctagtaagaatacctgaaatgtactcttatcaaatttccagtactatatcattaagtataatcatcatattgtacatcagctttctagacttagtcatcctatataactgcaactttataccctctcacctacatttccccatttcctcccccgcccccgcccccaccaccattctactctgttttttgttggtttttttggtgaggatgcagtctcgctctgttgcccaggctggagtgcagtggtgcgatctcagttcactgcaacctccacctcccaggttcaagcaaatctcctgcctcagcctcccaagtagctgggattacaggcatgctgccaccatgcccggctaatttttgtatttttagtagagatggagtttcaccatgttgcccaggctggtctcgaactcctgacctgaggtgatctgcctgcttcgacctcccaaagtgctggggttacaggcatgagctaccgcacccaccctactctgcttttatgtatttgacttttttagattttgtatataagtgggatcatgtagtattttttctttctatgtctagcttacttcagttagcacaaagtccaacaggttcattcatgttgttgaaaatggtagaatcttttttttttttttttttttttgagacagagtcttgctctgtcacccaggctggagtgtagtggtgcaatcatagctcactgcagtcacttgacctcccggaatcaagtcgtcctcccgcctcagcctcccaagtagctaggactacaggcgtgtgccatcacacgtggcttattttgtaaaacatttttttctgtagacacggggtctcactatgttacccaggctggtctcaaactcctgggctcaagcagtccacccaccttggcctcccaaagtgctgggattacaggggtaagccactgcacctggcagatagatctcctttttaaggctgaataatgttccgctctgtgtgtgtgtgtgtgtgtgtgtgtgtgtgtgtatccatttatctaccagtggacacttaggttgttttcaagtcttggctactgtgaataacgtaccttagttgtatacagtatcctcacagatattgcagttttgattccagacccctacaataaagtgaatgtcccaataaaatgagccacacaaatgttttgatttcctggtgaatataaaacctatgtttacactatactgtagtctattaagtgtggaaaagcattacatcagataaacaaaatgctgataagtgtggtggctgcagagggttggggtggcagggacaatttcttaaaataacaatgaagtttttcaaatcagttgactcttcctttcacaaaagatttctccatagcatgtgatacagggtgatagcattttgtccacagtagaactttcaaaatcttctcaaatcctgctgctccttcattaactaagtttatgtaatattctaaatcctattgtcatttcaacaacattcacagcatctttaccaagagtagattccatctcaaaaaaacacttttgggctgtgcaagtggctcatgtctgtaatcccagcaatctgggagaccaaggtgggaggactgctctctgagcccaggagttaacacagggaagaccccaactctacaaaacaattaaaaaattagctgggcatggtggtgcatgcctgtagtcccagctacttgggagcctgaggtgggaggatcacttgagcctaggaggttgaggctgcagtgagttgtgattgtgccatttgtacttcagccagagtgacagagcaagaccctgtctcaaaaaacaaaatggttgggtgtcatggctcatacctgtaatcctagcaatttgggaggctgaggcacccagatcacttgaggtcaggagttccagacaagcctggccaacatggcaaaacccatctccacaaaaatagaaaaattagctgggtgtggtggcgtgctcctgtactcccagctactcaggaggctgaggcaggagaatcgcttgaatccaggagttggaggttgcagtgagctgagatcacgccactgcactccagcctgggaaacacagtgagactgtctcaaaaaaaacaaaaacaaaagcaaaaacaaaacaaaaccaaacacttatggttgggagcagtgtctcatgcctgtaatcccagcactttgggaggctgaggtgggaggatcacttgagcccaggagttcaagaccagcctgggcaacatatcaagtccccatcgctacagagaaaaacatttttttttgagacagagtcttgctgtgtcaccaggctggagttcagtggtgcaaccttggctcacggcaacctccacctcccaggctcaagcaattctcctgcctcggcctcctgagtagctgggactacaggcacatgccaccacgcccggcaaattttttgtatttttagtaaagacagggttttaccgtgttagccaggatggtcttgatctccttaccttgtgatctgcctgccttggcctcccaaagtgttggtattacaggcgtgagccaccacacccagcctacagaaaaatttaaaaaattggacaagtgtggtggcacatgctgtagtctcagctgcttgggaggccaaggcaggaggattacttgagcccaggagctaggctgcaatgaattatgattgtaccactgcagtctagtctgggggagtgagagcccatctcaaaaaaataaaatgaaataaagagaagaatgaaattactctttgatccatgggctgcagaataaatgttgtgttagcaggcatgaaaacattaacttccttgtatatctccatcagagctcttggttgtccaggtgcattgtaataaactgtaatatttggaaaggaatatttttttttctgagcagtaggtctcaacaatgggcttaaaatattcagcaaaccatgctgtaaacacataggttgtcatccagtctttgttgttcaactgatagagcacaggcagaataaacataattcttaagggcttcaggatttttcagaatggtaaatgagaactggcttcaccaacggcattcaccccaacaaaagagtcagcctgccctttaaggctttgaagccaggcattgacttctcctctctagctacaaaagtcttagatggcatctttccccaatagcaggctgttttgtctacattgaaaatctgttcttattgtagccactttcatcaatgatcttagctagatcttctggataacatgctgcagtttctccatcagcacttgaagcttcaccttgcacttttatattatggagatggcttttctccttaaacctcatgaaccaacttttgttacttcccaacatttcttctgcaccttcttcacctctctcagccttcacagaactgaagagagtttgggccttgctctggattaggctttagtttaagggaatgttgtggctggtttgatcttctatccacaccactcaaacttgccccatatcagcaaaaagactgtttcacttttttatcattcatgtgttcactggagtagcactttaaatttccttcaagaacttttcctttgaattcacaatttggttaaacatttggcacaagaaacctagcttttggcctgtctcaggttttgacatgcctttctcactaagcttaatcatttctaccttttgatttaaagtgagagatgggccaaggggtggttcatgcctgtaatctcagcactttgggaggctggggtgggtggatcacaaggtcaagagttggagaccaacctggccaacatggtgaaaccccatctctactaataatacaaaaattagccaggagtggtggtgcacacctgtagtcctagctactcaggaggctgaggcaggagaatcgcttgaacctggaaggcagaggatgtagtgagccaagatcacgacactgcactccagcctgggcgacagagcgagactccatctccaaaaataaataaataaagtgagagatgtgtgactcttcctttcacttgaacacttagaggtcatcgtagagttattaagtggtctaatgtcaatatttttgtgtctcagggaaaagggaggtccaaggagaggaagagcgatgggagtatggctggtcagtggaacagtattgaaagttccatgcaggctgggtgcggtggctcatgcctgtaatcccagcactttgggaggccaaggtgggcagatcatgaggtcaggagttcgagaccagcctggacaatatgacaaaaccccgtctctactaaaaatacaaaaattagccgggcatgctggcatgcacctgtagtcccagctactcgggaggctgaggcaggagaatcgcttgaaccggggaggcagaggttgcagtgaactgaggtcctaccactgcactgcagcaggggttgacagagtgagactccatcaaaaaaaagaaagaaagaaacacagaaagagagagagacgaaagaaagagagagagagagagagagagaaagaaagaaagaaagaaagaaagaaagaaagaaagaaagaaagaaagaaagaaagaaagaaagttccgtgcagtattttctgttcctgccagtagtttctggcctccaactccatcgatattcctgcaaaagacatgatctcattcttttttatggctgcacggtatttcatggtgtatatgtacgttttctttatccagtcgtcactgatgggcctttgattccacgtctttgttattgtgaatggtgctgctgtgaacattcatgtgcatgtgtctttacaagagaatgatttatatttctctgggtacatacccagtaatgggattgtggggtcaaactgtagttctctttttagcactttgaggaatcgccatactgctctccacaatggttgggcgaaatttatactcccactaacagtgtataagtgttcccttttctctgcaatcttgccagcatattttttgactttttaataacagccattatcactggtgtgagatggtatctcattatggttttgatttgcatttctttaatgattagtgatattgagctttttttcttatgattgttggttgcatgtatgtcttcttttgaaaattgtctgttcatgtcctttgcctactttttaatggggttgtttttctcttgcaaatttgtttacattccttatagatgctggatattagacctttgtcagacgcatatttgcaaatattttcttccattctggaggttgtctgtttactctgttgatagtttcttttgctgtgcagaggaagctctttagttcaattaggtcccatgtctcaatttttgcttttgttgcaattgcttttggagtctttgtcatgaaatattttcgatcctatgtccaagacggtattgcctcggttgtcttctagggtttttatagctttggattttacatttaagtctttaatccatcttgagttgatttttgtatatggtgtaaagaaggggtccagtttcaatcttctgcatatggctagccaattatcccagcaccatttattgaacagggattccctccacccacacaccattgcttgtttttgtcagctttattgaagatcagatgatcttaggagtgtggccttatttctggtctctctattctgttccattggcctatgtgcctgtttttgtaccagtaccatgctgttttggttactgtagccctgtaggacagtttgaagtcaggtaatgtgatgcctccaactttgttctttttgcttaggattgccttggctattcaggctctttttggttccatgtgaattttttttttttttttttgagacagagtcttgctctgttgcccaggctggagtgcagtggcgcaatcttggctcactgcaagctccgcctctcgggttcatgccattcttctgcctcagcctcatgtgtagctgggactacaggcacctgccaccatgcccagctaatttttttttttttggtatttttagtaaagatggggtttcgccgtgttagccaggatggtctcaatctcctgatctcgtaatctgcccatctcggcctcccaaagtgctgggattacaggtgtgagtcaccgcagccagctggttccatgtgaattttaaaatagttttttataattctatgaagaatgtcattggtagtttgataggaatagcattgaatctacaaattgctttgggcaatatgtccattttaatgatatttattcttccaatccatgagcatgggatgtttttccatttgtgtcatctctgatttatttcagctgtgtgctgtaattctcattgtagggatctttcacctccctagttagctgtattcctaggtattttatatacttatttatttttttgagatggaatcttgctgggattacaggtgtgagcctccatgcacggcttggtattttattctttttgtggcaattgtgaatgggattgccttcctgatttgactctcggcttggctgttgtatgtgcataggaatgccggtaatttttgtacattgactttgtatcctgaaactttgctgaagttgtttatcagctgaaggaacttttgggctgagacaatggggtttcctagatagaaacatgtcatctgcaaacagggagagtctgacttcttttcttcctatttggatgccttttctttctttctcttgcctcattattctggccaggacttccaatactacgttgaataaaagtggtgagagagggcattattgacttgtgccagttttcaaagggaatccatcctgcttttcctcattcaatgtgttggttattttatgttttctttagaaaaatgtccattcaaattcattgcccattttttaattgggctatttggttaatttgtttttgagttgtgtgagttcctcatatatttgatgactttatcagatatattatttgcaggtattttcttttaatccatagtctaccttttcattttgttgactgcctcctttgctttgcagcagttttatagcttgatgtaatcctacttgtttcttgtgtcttgctttgtttttttttttgcctcagcttttggtgtgatattcaaaaaatcattgctggctgagtgcagtgggttacatttgcaatcccagcactttgggaggctgaggcaggcggatcacctgaggtcaggagttcgagaccagcctggccaacatggcaaaaccccgtctctactaaaagtacaaaaattagctgggtatggtggtacacactgtaatcccagctacttgggaggctgaggcaggagaattgcttgagcccgagaggtggaggttgcagtgagtcaagatagcaccactgcactccagctgggtgagacagagcaagactctgtctcaaaaacaaaaaacaaaaacaacaacaaacaaaacataaaataaaaaataaggaaagatttactattgatattttgttacttatttctgttagtcttatagtccttctgtccctttctcttgctgttttcttttgtatttcactgttttttttttttttttttttttgagatggagtcttgctctgtcacccaggctggagggcaatggcacaatctcggctcactgcaaccttcgccttctggttcaagcaattctcctgcctcagccttccaagtagctgggattacaagtgtgcagcaccacacctggctaatttttctatttttagtagagatggggttttgccatgttggacaggctagtctcgaactcctggcctatgttttcattattttctccttttctttaattctataggcattttctttgtagttaccaagtgtttacataaaatctcttataatagtctactttaagctgataacaacttaacttcccttgcatgtcagaactttgcttttatctctcttcccctggcttatatgctattgatatcaccactaacacctatttatattgtaccaattaacataatatagttgttttactacttttgtcttttaacttttataagagaactaaaattgatttacccactactgttatagtaatacactattggttttgactatatatttacctttgccaatgagtttcatacttcgtgtgctcctgttactgttttccatacttttgttttaaccttaagaactctctttagcatttcttataaggcaggtctagtggtgataatctccctcagcttttgtttgagaaagtctttatttccctctcatttttgaagtatgggtttgttggatatagcattcttgactggaagtttttttctttcagcactttgtatctattgtcccactcctttctggcccacaaggtttatgctggaaactctgttaatagttttattaggggacccttgtacacagaagttgcttttcccttggctgctttcaaaattctgtctctaacttttgacaatttgattgtaatgtatgtcagtgtggatctctttggattcatcttattttttttttttttgagacagtctcgctctgtcgctcaggctggagtgctatggcatgatctaggctcactgcaacctccacctcccaggttcaagccattctcctgcctcagcctcctgagtagctggcattacaggcacatgccaccgcgcgcggctaatttttatatttttagcagagacggggtttcaccatgttggccaggctggtctcgaactcctgacctcaagtgatccacctgcctcggcctcccaaagggctgggattacaggcatgagccaccgcacctggcaggattcatcttatttcatgtcccttggacttcttgggtcttgatttctatttcattccccagttttggaagggtttcagccactgtttgtttgaatatgctttctgtccgttttgctctctctgccttctgaaaatccactaatgcatacattagtctactcgatggtgtcccttaagtaccttaatctatcctcactctttctttttttctcatttttgcccctctggttggataatttccaatggctggtcttcaaattcactgactcttttttctgcttgacctagtctgtgagtgaaaccctctagagaatttttcagatgagttattatgtacttcagatctataacttctgtttggtatgtttttaaattttctcctttttctgagacagggtctcactcagtcacccaggctggagtgcagtggtgtgataacagctcactgcagccttggcatcccaggctgaagtgatcctcccacctcagcccccagaggagctgggaccacaggcgtatgccaccatgccaggctaatttttaattttttgtagacatggggtcttactatgtaaaccaggctggtcttgaactcctaacctcaagcaatcctcccaccttggcctcccaaagtgctgggatgacagtgtgagccaccatgccaacccttgtttttgtattttctctttgttgaaagtctcggtttgttcatacattatactcctgacatcagtgagcatatttatgattatttttaattctctttttttttttttgagaggacgttttgctctgttgcctaggctggagtgcaatgacacgatcttggttcactgcaacctccacctcccaggttcaagcgattctcctgtctcagccttccgagtagctgggattacaggtgcccgccaccacgcctggctgatttctgtatttttagtagagatgaggtttcaccatgttggccaggctagtctcgaacatctgacctcaggtgatccacccgcctcggtctcccacagtgctaggattacaggcatgagccactgcacccagcctatttttaattctctaataggtaaaatcactgatctgtatttcattggaattggtttctggagatttcttcatcttttgtttggaacgtattttctatttcttgatttttttgttgactgtgttgattttcatgcattagataagacaactctctttccaagtcttaatatctgatttttcgtaggagatgaacctcaccaatcaacccaaccagattctaggcacctctcaaacttttgtgcttgtacaaactgctgtctttgttcttagtagccccaagagattggggtgcaccaaatgccatcagtgccccaagactggtgatattgaagccagttactgaaatttagctagaaaagttggggtgttatatgtgttccagttccttctatcctcaaggagaagctgggaactggtgttgatctcccacttgccctgtactaagctggggagataatcccaagcaaatgcctgcattctcattcagaccacatactctttcaacccattgcctaatgtgttgttacccccaggggcctagtcaattgcagctcccatctactgtccaggacagatggattgttcagaggcttggctccatctctagagtgagcctgcaaaaggaattgcgggaagcaactgcatgcccattcaggctcccagaggactacttattgcctgccctgtcagtgcccagatataggctagaggcctgactcatggacagcggctgggaaagttgggacgttaggtgtgcagtcaaaccccttcctgggggtaaactgggaactgggtgtttttgtctgctcgctttgtactgagttaggggaaacggatgctagaactgctcaaacactcttttaaaatcacttttcttctctgtagtctagggggacttgtgaatgcagtcttatcaattcccagagacagatgatttaggagcttagaagctggtcccttgggtggaagctgtaaaagttggggtacactgtccaggaagaagctagaagcctagtttttttttgttttgttgttttatttttgagacagagtctcactctgtcacccaggcagaagtagagtggcacaatctcagctcactgccacctctgcctcctgagttcaagccattctcctgcctcagcctccggagtagctgggattacaggtgcacctccctgacaacccccaaccatgcccaggtaactttttgtattttttaacagagagagggtttcaccatgttgaccaggctggtcttgaactcctgacctccactgatccacctgccttggccacccaaagtgctgggattacaggggtgagccaccgtgcctggcccctagttttatctctgaatggagtagtggcagaggggagaacgacagtgaagttcccacatgcctgttcatgctcctggaggtctattgtttaccagccctatcagctactcgatgtaggctacttagaagcccagcgttcaggcagcagttgggaaaaatgtgtagataaatcccttttagggagactgtggaactgcttttttaaattcttttgtttcttttctttttttttagagacagggtctcactctgccacctaggctgtaacgcagtggctccatcatagctcagtgcaaccctgaatcttgggctcaagcgatcatcctgcctcagcatcctgagtagctaggactataggcatatgtcaccacacctggctaattaaaaaaaatttttttttgttttggtagaggcagggtgtttgtatgttccccaggctgttttcaaactcctggcctcaagtgatcctctgcctcagcatctcaaagcactgggattacaggcatgagccatggtgcccagcagatggtgcatttctgcctgcttgctctgcactgaccctgggggacagccgctgaaagtgctcacatacctgtttaaaatgtcctcttatggctgggcatggtggctcacacctgtaatcccagcactttgggaggctgaggcgggtggatcacaagatcaggagatcgagaccatcctaacactgtgaaaccccatctctactaaaaatacaaaaaattagccaggcatggtggcaagtgcctgtagtcccagctactcgagaggctgaggcaggagaatcgcttgaacccaggaggcagaggttgcagtgagttgagattgcgccactgcactccaacctgggcaacagagagagactctgtctcaaaaaaaacaaacaaacaaaaaaaaaaaaccccacaaaattagctgggcatggtggtgtgcgcctgtaatcccgcctactctatagcctaaggcaggagaatcgcttgagcccaggaggcggaagttgcagtaagccaatattgtgccattgcactacaacctgggtgaaaaaagcaaaactctgtctctaaataaataaataaataaataaataaataaaatgtccttttttctcaggggactcacaaatactaaaccctgccattcccgggataagaagatttaggagccaaactctcacgtggaaactgtttaagtttgggagcgatatgtctggcctcaacccttcattcttcaaaaatctggtatttcgggattccttcccaattgtaagatactgtgcccaggtttttggtttacattgtgtctcaatttgttggtatccattttgatgtggatatattatcagttgccagtgtgtgggagtctcaactagtttctatatttctctcagagagaactgatccatgtgtagatacttattcagtgcatccatggaaggaaagaaagtcaggagtctcccattctgtatcttgttgatgcccaatcagtgaaatgaaactttttttttgggcagggagggagttctcattctgtcacccagggtgagtacggtggaacaatcacagctcactacagcctccacccaggctcaagtgatcctatcaccttagcctcctgagtagctgggactacaggcatgtgccactacgcccggctttttttttttttttttcagacagagtctccctttgtcccccaggctggagtgcagtggcgcgatcttggctcactgcaacctccacctcctgggttcaagcaattctcctgtgtcagcctcccaagtagctgggactacaggtgcgtgccaccatgaccagctatttttgttttgtatttttagtagagatggggtttcaccatgttggccaggatggtctcaatctcttgaccccgtgatctgcctgccttggtctcccaaagggctgggattacaggcgtgagccactgtgcccggcctaatttttaaatttttggtagagatgggtcttattatgttgcccaggctggtctggaacttctggcctcaagtaatcctcctgccttgacctcccaaagtgctgggattacaggtgtgagccactgcaccggccatctttgctaaattattaccttcaagcctataaggtatcattatatatttatcctggaagctttcttagtttttttctaaactccttacagcttctttgggtacactgttacacctcttgcctactagtaagtgacagcaccagtatctattctcctttctttttttttttttttttgacaaagtctcactctgttgcccaggctggagtgcagtggcacaatctcggctcactgcaacttccgcctcctgggttcaagcgattctcctgcctcagcctcccaactagctgcgactacagatgcgcaccaccatgcccggctaatttttgtattttttttagtagagatggggtttcaccatattggccaggctggtctcgaactcctgacctcgtaatctgcccacctcggcctcccaaagtgctgggatcacaggcatgagccactgcacccggccctctgtcagtctttaagctgaaaccaatggtataaaagtgacagagccgtagtagtttcaatcagtgcataattttaagcatctaccatgttcctggtctctcctcccatggagacaatgaaattttattagttacataattaatattcaattacaagcatattgctataaggagggtaaaacaaagaatgtaggaattgaaagggatgttccaagtaaaaggaaaagtatgtgcacaattctcaaagagcttggtatgtttgatgaattgagagaaagtgtagctggagaggggtaagagaaaaagaacagctggagttgacactggcagggaagtaatgactaggaaggtcatgttgaaaatttaaatgtccctaaggacaatgggaagccaatggaaggtgtcaaattggatgatgaaatcatcataatcatctggtacctggccctctagttctgtgcagcaaagactggaaagatgaacatctagtgttgtcttcccgcaataatgctggaattttctgctgagtttcagggagcaaacattttttaatacttcttttattaaatggcagtgtgttagctgtgttgacagagaacaagtgtgatatgaaagtcatcagcgggctctttcaggtaacccaggtgagtactgttggataggatggggacaggggagacagaaacattcaggttttggtgatacttttgaggtagaatccatgagacttgatgattgagtggatgtgatgtcttagtctgttctggcttctataaaaagttaccataagccaggtagtttataaacaacagaaatttttttctcatagttctagaggctaggaaacccagatcaaggtgctggcagattcattgtctggtgagggccatttccacaatggcaccttcttgctgggtcctcacaggctcgagtacagtgggccaatcatagttcactgtaacctcaacttcctgggctcaagcaatcctcctgcctcagcctcccaagtagctaggactacaagcaccagccaccacaccgggctaaataaattttttgaaaagatggcgtgtcgctatgtttcccaggccggtcttgaactcctggctttaagcaattctcacaccttggcctcccaaagcactgggattacagacgtaagccaccacacccggcctgcagtctcttttataaggacactaatcccaatcatgaggggtctgccaaagtccccacctcctaataacatcagtttaagtgttagaattccaacacatgaatttttagggtacacaaatattcaagccatagcaagaggaaagagggagtgtttgttgatagcatgagcaattgtatggatgtggccccacatactggaggcaaacagatcaggggctaaaagcatgagttaagggcatgtgttttgatgcctgagagacatctaaaagacgactcctgtaggcacctgaatgtaggaatctggagtacatagaaaagaaattggagctagacctaaaatgaggtctttgtagccatggaagtggctaagctcacctggggagataccatttaccaaaggtaagccgagggtacattccagctaagtagaagcatgttagaatttggctgcagagaatgccaaaagcctaagagattggtactggttctaaagaaaagacactctacccagcacaagtgagatgtacaaagtgcccatttcaacaagccagagacacacgtggtagtcaggcccacagctctgcattgcctaagtgagattagagctgggacggtggcccggagctgcttctccagtcctaacgcctagaatcatgggatggagattcgtgttagtgcccgacagtcacacccatgataccctcctgctgatgcggaggaagagacctgaggagttcctccgcaaacactcttacccgtactgctagatttacacggagatcacctagcgatatgcagtggatatggccaggcacatggccaaaccccaccactggatctccaccgttcaccacagtccacttgccccaggaatgcgcaggcgctaccggaagcgggcaccggaagtggctcggctcgtggcttccggttcctcaccagtgtgccgctgtagcgcaagtcatctcgttgacacttccgctgacccgtgcagttggtggccaagctggagacccaggatctccctgaggccgcgcgaggtcttctgggagtcctactcaccacatccgctactcggaatccaagctttaagtggcaacccgtgccaggcagtagctgctccgtgaagacagaggtccttgcccctgtacttctgtgtacagcaaagacgaaaggaaattgaggtctagcgctagcttcccagaatgacccagaattttctgctgagttccagggagcaagcgattttacttcccttattaagtagcacgaagtccttcactctctgtctctaaaccagaatcctaacagtcttcaaaattaacctgattgccacctaaaaccacgtattttttttaaaaagttcacttcattgccatcatcataaaatagcatttaatagaagccaaattgcacattagacgtaatcaataacttcagagcttgcaaactagagtgaagactgatgagaatacgtcaaaaagagtaagacccaaaacattgaataaacagtataagtgtatacaataaatagaattctgaggtatccaaaggaactggagattacagcacattcttacgtttacacagaagaatatttatattgtattccccccctacagacttaatgcaaagaggactgtcaattttaaaagacaaaacacctgtactacttagatgggccttggaaagatgggtaatggttatctttgaatcagatcaatagctcttctaaattacaaaactaaaccagatgaatacatacacttctaatgtaatgaacatcattttgttaaacagatggtcaaagcaaatacactttcctactaaaatcccacagggataacaagtttaatgaacattcaaaatagactattcatataaactataacctgctatgtctccctttgtacacataggcagtaaattgcagattactttgatcaaactctgcagtttcagattgtatgacatcttatgctgcagtcactagaacattgccacttaattatatggaaactcaggaggcaaagactcaaaatggcatttgctgtgaaatgtcatttgagttttaactccctgaattattgggttagtcattttctatgttaaatgaggaggtgtcaatagactaccacctgtagcaacaaagctctaaataaaactattctgagtcgacctcattcaaaacaactacattccacaatttcttaaattataaaatgtaaactgctgacatctgaattccattggaaaaatgctgttttcatcaatgacgactgtttaaaagactgtttaactattccagcaatcatgttaaggaactgttggatatacattttcatcactgcatcaacgacaaaaacggagaaatttgtctgagtcaatttattcagcacaaagttttcactctcatagtgtgttgatttccatgctgcaaaatgcagttaaccaatcattcatagcaataaactcttgcatttagtttttcattcccatattaacttttatccagtatttgtgaatagcacctaacatggaaggctagtatctgagttaatgacaattttatggaatttatctccatcagttgacactgtaaacagaagggtgaaatgccatcatcataaaaagcctgaagctcaccagcagatatatcttttccttcaattccctgggggtaaagcagcttgaattacatctagcaaatgtatttaagtacaactgcacaataagcacaactgaaaatatgcctctttcacagtaactgacacttccggggttttcatttttttctgcatactaatcattaacagtattataccaaaaagccattttagttctacccacacgtatgttaatgtttctgaaaagggctattttttctaatcttttaggaagtttgtcgtaatcttccaaaatctggagaaaactgcaaaaaaaaaaattagaggttaattgtgaaggaagactcgtgtggaaaggcaaacttccatattaaggtgcagaacaggatgtatggcacaaattctcactttctgctatattttctaggagccaaaacaaaaatgacagcatacatcttttatatcacccccattctgtccaagtgccttctaagatattcccctctacttctttctgcagcaactctgctaatccagacctttcccaatttcatcccccatcctgtgactcattagatctttgactgaactcttagggcccctgatatgtgctgatgaggctcctgccagtttctcccactgagggcagaagcaggagagcaaggaggtggtgttcttgttatttaacaaaggtcatggtatctcagagttgcctaataagtaatctaactggagactatctttctacacatttcaaagcacctcagagaaacctggaagctggtgtcctgtctcctaagagtggagacatcagaaacaaacagccaaagtctgaccttgacatacagagcagcacattgtctcaactgtggatctgcaaacaagaaacaagacaagaatgacaaagagagagaaactctctctgggttagggatgtttttgttagtttcagtttttctctcacctgaacagtatcttcctgcctctactcagtaataagagcttagctgagtagccagcattttttgtatatttagtcctcaatctgctgttctgtaggaccaccttctgctaccttccatataattagtcctcaagagtcctttatcttttctcccagcaaaaattcccagcaacaattcaattttagcaaatattgtacttttatactgtctatttaaatagaatgagagcattcttccatcctaatcaaaacccatgtaaatattgttttgctgataggcatacaatcgactttaatgagaaattgtatatgaatctatatttacaacattctgtggttctttaacattaataaccataccatttaataatattttgctccagtatttatctataatagcaatatctaaagatctatatattatcaagtattttggttaaaatctaacaattttctatatgcattttctttggagatggagaggaaatgttatgggtgttttttaaaaaaccaaaacccagttaagaccttcagtattgtactctgccaagtgtgaaatctctcatctgattagagggacaagaattcaaacctgaagtcctggagagtcttctgctgctttgtaactgtatatgttagtcaggctttgggtacagcacaaagggaatgaaggggttccaggatgcaagcacacagaatcgcctccatgaggaccaccctcacctatctcagctcccctttccctggctgcctgcagtgctactacgtggtgcaaatgccaacaaatgccgcagtcttgcagactgcatggcctttggagtcagagaaacccaagcttaatgtcagtttcaccacaatgtgatttgtgtgctgggcaaagaactgactttaccctctgaggacttcagtttcctcgtttatgaaacaaagattttttttctctgtcacagattctgaagattaaattacataatatatctaaagtagctagcatgctcactgagaaacaattacaattattcatagtaagacaggtaatgtgcttcagtagcaatttggaggcaaatcttagaaaagagcaagtacttctccccctccccaagtcaagtccagcctccagaaaagggctgcagttagacttccaaaactccttgcaaacaattgggtcctaaatgccagtatgtgcccctggcatcagaaccatgacagagaactccggatactaatggccatcaaaatataaactagtctacccatttgggaacttttacagggcagaaaaaaacttctgaacgcctgtgggaattcacatgtagaacagcaatcttatacaagtattacattcaaatagttatagcaaaaaaaagtataaaacatataaaagcatttactttcctagatatgtctgcagaactggcaaaatataaataaattctcctccttctaaaagtcagaaactacgtaaacaaaattaaaataactttagcaagagccttcattttaatgaaaattgaatttaaacaaaagttgtgtatcttcttctggctcacagttgtacagtaactgagttcaaatcctgggttcattcactagtttagtgacacggattttgcatccctacttataaaatggaaatgatactgcctaaatcacggttgtgctgagaattaagtattacatgggaatgtgtgtaaagtgcttagcacattgcctgggacatatacagtaactgcttcccaccatacagatactgaaaagcccaatcactaataacaatttgttatatttactttacgtggtgttttttatgtgagttcgcttatgagtaatgagatgcaaattcgacttgaaagttttcccacacacggtacatttaaaaggttccgctagcatgtggctcttctggtggcatgcaagttctgagtccaaagcaaaactttcctcgcatgttttgcacttatggggcctttcctctgtatgaatgttctgatgggaaataagctcagagaaacaaggaaaggtcatgtcacagtcaggacactgtaagggcttgaattttgagaatgagaagaaattgtccccatcatcgctgcagcgttcagagtcctcgtcgtggctcttctcggaaagggcaggatataaggactgcctgaagctcttcatgcacttagtgtgctggtactgggggcctgatacgaatgtttcctcaggcaaagcaagatttggtttctcattaaaatgtttatcacagttagtagattcgtaggtgttttcagcactgtggcttttctgatgctgtgccaatcctgggagccacataaaacctctaccacatatgctacatgtatagggcttctcctttacgtggctattcatgtgtcgggatagatgagagtgctggcgaaagctggcactgcacttggcacacttataaggtttctcaccagtatggattctcctgtgtgtcctcaggttggctctatgattgaagatctttccacagtcaccacatttatgttttttctctcctgaatgaattttctgatgcaaaactaggtatgaatgatcgctgaagttttggtcacactcaggacatttgtacacatttttggctccttcccagggagaatcaagaatttcagaaagtgtgttggttcctaaatattcagagagttctactaatggggtgtggttttcaatggtaactaaaaggctgatgacccttctcttgtaagtgggagttccacttaatattttcgcttcagggtttccaactccatcctcagaggatttttctgggtaagggacaaggggtgcagcaatggggtacttttctaaggcaagctcgtcaagttccatagactctaggcttaactgctgattaatctcaggcttgccttcctctcctgttgataaaaacaaaagaaagcaaaacatagacaatatcttcaagggatactggggaaaaagtaagctaaggtagttacaaacaggaccaggaaaccttagaagggttattctataacccagacactaaccacacaaaatcaggaccaagcagactctcctggcctcccagaagatccagttttgggtgaatatccaaaggtaaggagagaatagctataactaagtcagagtccagtgggataggtactaaggacaatctcagtagcagctatctagaggtgaacttttccatctaatctatttaggcctcaagagcctttcatttttgaagctatctcaagtgacagcagaacaattaacaattggaaaaaagattaggattcatatttatcaacaaagagaggggttgggcagtgtctcacgtctgtaatctcagcactttgggaagctgaggtgggagcatcacttgaggctaggagtttgagaccagtctgggcaacacagtgagaccccatctgtacaaaaaataatttttaaaaattagccaggcatggtggcacatgcctatagtcctagatactcaggaggctgagacaggaggatcacttgagctcaggagtttgagatgtgccattgcactccagcctaggtgacagagccagaacttgtttcttaaaaaaaaaaaaaaaagatgacagcaagaatgagtgggaaagaaaataatttttaaaaagaggctgggcacggtggctcacacctgtgatcccagcactttgggaggccgaggcgggtggatcacgagatcaggagatcaagaccatcctggctaacacggtgaaaccccatctctactaaaaaaaaatacagaaaattagctgggcgtggtggcctgcgcctgtcgtcccagctactcgggaggctgaggcaggagaatggcgtgaacccaggaggcggagcttgcagtgagccgagatcgcgccactgcactccagcctgggcgacagagcaagactctgtctcaaaaaaaaataataataataattaaaaaagaaaaaagaaaaaaaagcaatcaagtgagcatttttcttccataacaaagaaacacacgggttatcagaaatagttttattatcaccaggagaactctccaaaatctctttactcctcactgaggaaagatcaaggtagaaggctgtgtgtactgcatgaaaataacagccaatctacttacaagaatggctgacaaaactaacattcctgtgtaatattttccaagtattcttcagttataaagcaaatatatcaatacaaaaggaacttttctttccagagaaacaaagttctacagttttcccaactcactgactagaaagggctgcagtatagttcatgggaatccaaacagtaccaagtggttttgctgatttgaggggactgagttcagagatcagggatgccaaggcagctagaatttgaaagcaaaacagcaaagaggcagctgttcagaaagagagctcaggtcatctacatggggtccccttaagactttcctgaggctaggtacagtggctcaaacctgtaatcccagcacattgggaggctgaggtgggagaattgcttgagccacggagctcgagaccagcctgggcaacatggcaaagccccatccctacaaaaaaaaaacaacaaaaaaagacaagcatggtagtgcatgcctgtagtcccagctacttgggaggctgaggtgggaggactgcttgagcctgggaggtcagggctgcagtgagccgtgattgtgccactgcactccagcctgggtgacagatcaagatactgtatcaaaaaaaaaataaccccacaactttggctgagtagtaatctacaagtgcatgaagaaactacccaatgccgtggaaagaaccacctaaaaggaataacagagcaataaccagttcatgttgcctccagccaaagtggaaagacataagacattgagcagcaacgtccacagaaaaaaactgccttagcagtaactcaaataagtcctagcagaaaggttgatctgaacctatcctaacaaagcaaaaaaaaaaagcacaccttgaaacagtcaaactgactccaagtaacttaactgcctcccacaacaaagtccaaaatatttttaaaaatacaacgaaatcccgggtccaacaacataaaattcttaatctaacatccgaccaaaatttacccaggaagtaaagaaaatatagaaaatataacccataactagaagacaaatcaatcaatagaaacagacccagaaatgacatcaatgttaaaactagcaagaaaaaaaagtttaaataaccattataaatatactccatacatttacgcagacagaagacaacatgaacatgatgaagagagaagtggaagaaacaaaatatgagttattcagaataactagttactctagttatttttttctgactaggattgagtatctcaactattccaaactatttagaataactacttagaatagatagtttagatactcaatcctagtcagaaataaaatctagtcaggcacaggagtccatctgtgtatggttccccttaggtgagtaaggcatagcaccccttaagagtaaatcaatctccagtctttagcaaatgatagtgatcgatactaatgggatttcccaagtaaaattgtaaactgcaacaaatgtttgtgaaagattaccaaatactgccatctcttgtactaaaccacaggcactgtactagactgaatttttgtctttaagagatcatctcggccgggctcagtggctcatgcctgtaatcccagcactttgggaggccgaggcgggtgatcacaaggtcaggagattgagaccatcctggctaacacggtgaaaccctgtctctactaaaaatacaaaaaattagctgggcatggtggcaggcggctgtagtcccagctactcgggaggctgaggcaggagaatggcgtgaacctgggaggcgcggtttgcagtgagcagagatcgtgccactgcactccagcctgggcaacagagcgagagtctgtctcaaaaaaaaaaaatcatctcatattttaaaactttttctctcacacaattatcacctccacataaattactgagggacaggtcccactccaccataccaacatctggataaagcatgaagttctcctcctagaattgacaaaagttccagatgcaggaaaaacaattgccttacccatcaaagccgcatcctccaaagactcttttgtaccatctttgctgagggacctctgggcagggtgcagagtcacgcactcctcttgagaaaaatacacagccagatcctcaaagagtattggtccctgaaacacaagagcctgtgtcagcacaagagggtggagggtcagcccctcacttaacctaggaaggatgaaaagagctagaaacatcagatgcacgggataaaaggctcggtgtaaaaggttcttgagcgcagaagtagggcaaatgggttctaaggggtggggtgagggttgggaagaagagagtaaacatggacatacatttttaggcagtggtacaaggacggtggactgtgagaattattgtctatcttgaaagagaaaagatgagggaatggctcttagggaggcaaccattaagtgaggatgctctaagaaaaggagaggtttggggccgggtgtggtggctcatgcctgtaatcccaacactttgggagtctgagggggatgcagatgacttgaggtcaggtgttcgagaccagcctggccaatatggtgaaaccctgtctctactaaaattacaaaaattaaggctgggcacagtggctcacgcctgtaaccccagcactttggaaggtggaggcgagtggatcacctgaggtcaggagttcaagaccagcctgaccaacatggtgaaattctgtctgcactaaatacaaaaaattagccaggtgtggtggcgcatgcctataatcccagctacttgggaggctgaggcaggagaatcatttgaacctaggagaaagaggttgcagtaagccgagattgcaccattgcactccagcctgggcaacaagagtaaaactccgtctcaagcagagcttgcagtgagctgagatcgtgccactgcactccagcctgggcaacagagcgacactccatctcaaaaacaaaaacaaaaacaaaacaacaacaaaaaaaactctgtctcaaaaaataaattaaaataaaatgaaattagccagatgtggtggcatgcgcctgtagtcccagctacttgggaggctgggccaggagaatcgtttgaatccaggaggcagagattgcagtgagccgagatcgcgccattgcactccagcctaggcgtcgcagcgagactgtctcaaaaaaaaaaaaaaaaagaaaagaaaaggagaaagttgggcagcccaggaagaatcataaagagataaaggttacaggattctcccaacatccttccctttgctatttcctctcgtccccatgacactcattgctaagctcactccagcacttcatccaggcctaccccaccttctctaacggtgtgataaattaatcacttgggatttattattactcaacgagtgtggagtctagaaatgtgcttaatttaaaaattcattcaaattggagaagtaccaaatctgtaattttgggaaccattccagaaagtcacttttaatcctagcactttggggagccgaggtgggaggatagctgaaggccaggagttccttggcaaagcagcaagactccatctccataaagaagttttaggccgggcgcagtggctcacacctgtaattccagcactttgggagaccgaggcgggcggatcacaaggtcaggagattgagaccatcctggctaacacggtgaaaccccgtctctactaaaaatacaaaaaattagcagggcgtggcggcaggcgcctgtagtcccatctactcgggaggctgaggcaggagaatggcatgaacccgggaggcggagcttgcagtgagccgagatcgcgccactgcactccagcctgggcgacagagcgagactctgtatcaaaaaaaaaaaaaaaagaacttttaaaagtagccagacactgtggtatgcgcgcctctcagatactcgagaggctgaggcgtaaggattccctgagttccagacggagctatgatatcagcactgcactccagccagacaagcaacactccagcgacaaggccagaccctatctccaaacaaaacaaaacaaacagataagacattgagaaactctctcagagattcctccacaggtccctgctcccagttggtagttctgaaagaaggaagttggtaaaccattatgtgtgtggtcttggaacgaagaacacttggtcaaagggctatttggggctcaggagcactcctaccacaacaggcatgcccaactctcctccaaaggagggggtcaggcagagaccgaaagcagcaataaacttggacgaaaaaggtacctcgactcacctgggcctcgggcgtcgggggcatggacgccatttggcgggtggggaatgccttcttcaagacgccacagggacttcgtgacaaagctgcggggggagagaacagttcttaaagggaccaattccgctgccaagttcctccactacccctagcctccctcgattccctccgaacccccccttaaaaacctacgccgactgctcctcctcttggcccggcctcgaaaggggcccacttaccgctccgcggttaataacaggcctcgcgctccctgacaggagctgcagaaagcgacgcccgaccgagacgcgacgaagaacgccacggccactgcaaaactcccacgctctcatgctcctttacgcaggagctgcgggaaaagccgccggaagcgacccgccctcagccctctccgccatcctgccctttgattggtcgaagttctcccgaaggggaagtccttcttttgtgttgaccaattgaacaccttaaccgaggacctgtagccactgggcagctgcgagaggtagttttcctccttttctctaagcaaccatttccgcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcggtaacaaaatgtgggttcggccaacagtgccctgtaggcctgaaatttcggtctggccagagcaaggtgattgagagggcgggggttcgggcctagcctgggcttgagctgtcctttgtgtcttgagcggatggtggggccgtggaacatgaaggagtatctttgtgtacgttcacaacgttcacatcggtgtaggccaggttgctggactctgactcaaagtgttatagaggcattacgtattgtacccgcagctgcagcctaagcgagctgcttcagcttcctagtcacaggatcccacgcgagaatagagccataggttagcgtcgcaggacgttgttcgcccccggatacctcacatgcagcctaccctagagccagtcatttcctattgtgtgctgggggaggagggagtgccctggtgtaggcatttggaattggaaaattgagctcctccccaagctctgccactgattggttggtaatcttggccagtttacaactttgctttcctcagctgcaaacagctcagagtgcctctctgggctaactcagagggtaatttcaaagattataagataatgtaagtgaaagaaattgccagtttataaaggtgtttggggaaaaaaaaagacgaaaatgataggtaccttgatagaaaagcctgaaaagtctcaacatatttccttattccagtgccaggcacattcctgtatctaaaagcttaatgaatggctgcatggttattaaaacaatattaggagatttgacaacttaggtaatgtgattttgtggaatatctgataggatagtttcagctacaagtaacagaaaacccaccgaaaggatgttcaaagagcagttacaggttggttaattcggtggcccagtgacaacatcaaggtcccagtgcttctctgccaccctaagcatgttggtaacgttgacaatagaatccaggtaaaatatacagacatgtattgtgtcatgtacccatcctaaactagttattaccaagaataaataattgtttggggcccatcatgcttcagcccctgtcactaggggaaggacctagcctcccttgataatctacctgcacaaaattagggctttgttacaaatgaaaaaaagagatgtggaaaataagttagataagaaactagcagtatctgccacaaatgatatctcttgacagctaactaagagctagaccttgtggggatggatcacaaaagaggtagctgtgaagtcccagtaaaggtgcttccaggacaggtggaagaatggtaagaacaaacttgcctacaggctagaccagtccaaagcatatatgttgaagaagagctaatagcctgtatatgaaggtgtaagtaaaggagatgttcatggttgagtcactgtggtgttcacgtagtcatctttcccttcttggtttgtgcttatctcttttttttttttttttttgagacagtctcactctgtagccagactggggtgcagtggcacaatcctgactcactgcaacctctgcctccggggttcaaatgattctcctgcctaagcctcctgagtagctgggactacaggtgcccgccaccacgtccggctaattttttttttttgtatttttagtagagatggggtttcatcatgttggccaggatggtctcgatctcgtgacctcatgatccacctcggcttcccaaagtgctgggattacaagcgtgagccaccgcgccccgcctatttaatgctattcttacatcagcactgtctcattgtggtctgagattctccttatctggatttgtggctctttcaccaagaacaagagactcccgtggctctcttctttaaatcctgttgccataattacaaagaaataaacacagtttccaatgctttgaaatgaagcatgtggtattaactcagtggattaccagagagagagggatatacctgaaatgggagaggaaaaaatcttccctagactatctttcctaagagccatcaaaactataaacaagtggacaaagaaggaggaagcttgaaagctttatcttcctgaaaataaagagatgacatacaaagtccaagatagaccaagattgaaaaattagaccacattatatccctaactcaattttgtaaaaaatcacaaatgcttgactgtatacccactatatgttcaagtaacatgttttaatcatcaaaatttaaaaatccttccacgacaatcttttgcaagtttttccatttctgtctttaacatggtaccagtaataacaactacaacctgtttgtattgaaattatttctatagcccagcatctgctttctctgaaaattatctttttaaaaatagtaaaactaacatcattacaaaagtagtatatgtgcatttcagaaagttaggaaaggctgggtgcggtggctcacgcctgtaatcccagcattttgtgaggctgaggtgggcagatcacaaggtcaggagatcgagaccatcctggctaacacgatgaaaccccatctatactaaaaatacaaaaaattagccaggcgtggtagcgggcacctgtagtcccagctactcgggaggctgaggcaggagaatggcgtgaacctgggaggcggagcttgcagtgagccgagatcacaccactgcactccagcctgggtgacagagtgagactctgtctgaaaaaaaaaaaaaaaagaaaatacaggggaaaaaatggcaacacattcctgtcacccagagatcaccactatttactctttattatttgtttttttttttttgagacagtctcactgttgcccaggctggagagcagtggtgcgatctctgctcactgcaacttccgcctcctgggttcaagtgattcttgtgcctcagctaccagagtagatgagatgatgggcagatgccaccacaaccatttaatttttgtatttttagtagagatgcagttttgccatgttggccaggctggtctcaaactcctggcctcaagtgatccgcccatgtcagcctcccaaagtgctgggattacaggtatgagccaccgcacctggcctgctcactgcaacctccatctcccaggttcaagcaattcttctggctcagcctcccgagtagctgggactataggtgcgtaccaccacacctggcgaatttttgtatttttagtagaggacgggttttccccatattggccaggctggtctcgaactcctgaccttgtgatctgcccgccttggcctcccaaagtgctgggattacaggcgtgagcccctgcccccggcccctattcttaagtatatatcttttccctagtgatttttatgatgatgcagctgtatattgaaacggaaagatactcatttttgggagtaaaattggttatgaaacaaaaacaataacaaagttgcttttgaagactatgcgttaaaatggtagtggtagttatatttttaatttttatgggtacatagtaggtgtatatatttatgtggtacatgaaatattttgatgcaggcatgcaatgtgtaatcacttcaaggtaaatggggtatcttccctggcgatgtttaacatgatttccagaatgaattgctcactacgtttggtgtgttttccattcccagatggtactgccttttaaggtctattacttaaacataagtatggctctggttcttaccgcctttaccgtatccttcatgggaagttgatactgatcggaaactgacacagagccttctcacctacactaagggggcctaggtaagcaagattatctttctcccaacttcagcaagaggttttcttactggtgttcagaatgcttgattgagcagttagaaaactgttgctacctagtctccagtcttataaggggacaatggctgcaagtcatgcctgcaagaacaagaggctcacacagttttgaaattagcacaacttctagctggataggagtctttttagtttcatttagccttgagttgaaactaataggagtcttttaattagaaaaaagctcagggctctaaacgtaccttcaacatgttaattctgttaccaaaaactggcttggtctgtgttaactcccaacagaattctttttcagtcactgaggcagaggtgcttccagagaaagattcttgacctactcatactgaataattatcgttactagaagctgcaaccaaagactcctggagggtagtaagaggtacagagaatgcaggttagatacagtgaggacagagaagaaaggatgggttggaggctgggcgtggtcactcacacctataattccagctactttagaggctgaagcaagagaatcacttgagtccaggagttcgaggctgcagtgagctagcattgtgccactgcactccagcttggatgacagagcaagaccttgtctcaaaaaaaaaaaaaaaaaaaacatgggttgctttgtagtttagagaactacatgtttagatagttaatttttccccaaaagggcccatcagattgatactctgagatccagggtttgtctgacactcattagcctatgagttgtagagatgggatggccaggagtgaagtgatggccttgtgtctttctcccctgcagcatacagaaaggctgtacctggaggaaggaagtgcggagccagcctgagttgggagaagagctccagagagtgagtcaaagcgctctgtgtcctgctattaatgatgccctcatagtcagaggaagcctacttaagtgaaatccatttttgacctgtcaagtattaaatattctcttaatttttagtactgaatgatagaaggcgcctagtgaaacaaatgctttcacttttttgctaggagggtaaatgagtatattcttacgttaggtacacagggatacagtacaagtatgccagcctctttaaactataaagaagtaaacaagatttggtttaagcatcagtctcttgtgagtctgatgggtaagcccagtctcagggcacactgacaatgttagtggagaacgagactctcccagtgtgctgccctgaccctctgagattggtctgtgtagccacgtggtggtcatcctgtgccacctctggtttggttctaatcaaaggaagcagtatcatctgtggtgatccgtcttacacacttgcatcattttataccaaaggagaatttcttttgttaaaaatttatttttcattatctactcataaagaaggagccaaagggctgggcgcagtggctcacgcctgtaatcccagcactttaggaggtgaggcgggtagatctctggaggtcaggagttcgagaccagcctgcccaacatgttgaaaccccatctctactaaaaaatacaaaaatgtagccgggtgtgctgggcgtggtggctcacgtctgtaatcccagcactttgggaggccaaggcaggtggatcatgaggtcaggagatcgagaccatcctggctaacacggtgaaaccccatctttactaaaaatacaaaaaattagctgggcgtggtggtgggcacctgtagtcccagctacttgggaggctgaggcaggagaatggtgtgaacctgggaggtgacagttgcagtgagccgagatcacaccactgtactccagactgggcgacagagcaagactctgtctcagaaaaaaaaagaaaaatttagccaggcatggtggcgcccaactgtagtcccagctactcgggaggctaaggaagaagaattgcttgaactcaggaaatggaggttgcagtgagctgagatcgcaccactgcactccagcctgggtgacagagcgagaccccatctgatatggtttggctgtgtccccacccaaatctcatctgcaattcccatatattatgggagggacccagtaggaggtaattgaatcgtggggcaggtctttcccatgctgttctcatgatagtgaataagtctcacgagatctaatggtttttaaaaaggggagtttccctgcacaagccctcttttgtctgccaccatgtgagacatgccttttaccttccaccgtaattgtgaggcctccccagccacgtggaactgtaagtccattaaacctcttttttttgtaaattgcgcagtctcaggtatgtctttatcagcagtgtgaaaacagactaatacatcgtctcaaaaaaagagaaaagaagaagaaggaactaaagaagaatttctttggaagcaaaatatttggaagcaaaatatttggctcctgactgaaagggttttgatccatgcatacattaataaacccttcagaaccatgagttgggataattcactgtcccttgtgctagtctcatggagcttttctgctcttctgggagtgctcctggggtggtctggaggcctctcaggcagagcagaggctggtcagcaagccacagggcttgccatgaagtggtttgttcatgatttgtttctgggaccctgggaaaaatgttctcagggtctgcctaggaaggctggttttggaagcttgtggatttctttctgggtgagtcaggaaagttgtgctcctgctgggcgcagtggctcatgcctgtaatcccagcactttgggaggctgaggcaggcggatcacaaggtcaggagatcgagaccatcctggctaacatggtgaaaccccatctctactaaaaatacaaaaaattagccgagcgtggtggtgggcacctgtggtcccagctactcgggaggctgaggcaggagaatggtgtgaacccgggaggcggagtttgcagtgagccgagatcgtgccactgcactccagcctgggcgacagagtgagactccgtctcaaaaaaaaaaaaaaaaaaaaaaaaagaaagttgtgatccaagggaaagcatacaggttttaatgatgaactagtttgttcctttgtctcctggctttcattcttcatggcatgtgctcagggcagccagtggagagaggcatcattctgcatggtatagaagccttgggtgggtgtttcatcatctgtaaaatgaggacaacaatactgaactttcaaggccattgtaaattagaatgtacagtacaagcattgtaagttagaagtcaattagaacatgcaggagggattataactcagtgtttagcgtatagcagacacttagtaaataatgcatttactctgttccattctagaagctccattgttgtttgtacaacaaacacctctgttgcagtgcttatcagattgtcttgtaatcacgtaactcctcaaaggcaggatgtgtgtaataacacatttccttggtcaccatttgtacccagaatggggaaggaagaaatgaaaagaatccagtatctaagcccagcctccatttcacttgcacgccttttatttatgaaaatatagtacttgtccatgtaaataatatctctgaatggataccaggaaaatggtaagatgagttagctggagaacttgggtactgagttggagggagggtaacttatttttcaccaatgtatccttttgttttgctttaaaataatttaccacaggcatgcattacttctaaaaataaaaatgtttactgtcagaaaactcccccaagttaaaccaaaaccaaaatatgttagatacatctgtaacactcattataaaagatgacatataaatgcctcaaaaatagaaaaggtgatcaaacttactgagaaatgtgcattaaaacaatgagacctttttcagttagattgcagaaaggtaaagaataatacctggccaggtgtggtggctcacacctgtaatcctaacactttgggaggccaaggtgggtggatcacctaagctcaggagttggagaccagcctgggcaacatgacaaaacctcgtctctacaaaaaatgcaaaaactagtgaggcttggtggtaggcgcctgtactcccagctactcgggaggctaaggcagcggaatcacttgagcccaggaggcagaaattgcagtgagctgagaccacacgactgcattccagcctgggggacagagcaagaccctgtctcaaaaaaaaaaatgagcatggtggctcacaccagtaatcccagaatcccagcactttgggaggtaaggtggtcagatcacttgcaccaggagttcgagaccagcctgggcaatatagtgagactctgcctctacaaaaaataaaaaattagccaggtatggtggcgcatgcctgtactcccagctactggggagggtgaggtgggaggatcacttgagaccaggaggttgacgctgcagtaagccgtgatcacgccactttactccaacttggatgacagagtgagaccttgtctcaaaaaaattaaaaaagactaattccctatgttggtgaggctgcgggccatttgccctgctgtagtgggtgtagagtcttcacactcttggtatgagaataaattggtaaaactttctggcaggcaatctagggtttgtttccaaagttaaatgtggttaattaaaactaattttacttatgcctgtaatcctagcactttgggaggctgaggtgggcagattgcctgagctcaggcattcaagaccagcctgggcaacatggcgaaactctatctctactaaaaatacaaaaaattaaccgggcatggtggcaggtgcctgtagtcccagctactcaggaagctgaggcacgagaatcacttgagcccaggaggcagaagttgcagtgagccaaagattgtgtcacactccagccggaggggcagagcaagaccccgtctcaaaaaaaaaaaaagaatgcttggttgagcatggtggctcacaccagtaatcccagcactttgggaggtaaggtggtcagctcacttgcaccaggagttcgagaccagcctgggcaacatagtgagactctgtctctacaaaaaaatgaaaaattagccgggtgtggtggtacgtgcctgtagtcccagctactggggaggctgaggtgggaggatcacttgagaccaggaggtcgacactgcagtaagccgtgatcatgccactgcactccaacttgggtgacagagtgagaccttgtctcaaaaaaattaaaaaagactaatcccctatgttggtgaggctgcgggccgtttgccctgctatagtgggtgtagagtcttcacactcttggtatgagaataaattggtaaaactttctggcaggcaatctagggtttgtttccaaagttaaatgtggttaattaaaaataattttactcacgcctgtaatcctagcactttgggaggctgaggcaggcagattgcctgagctcaggagttcaggaccagcctgggcaacatggtgaaaccctgtctctactaaaaatacaaaaaattagctgggcatggtggcatgcacctgtagtcccatctactcaggaggctggggcaagagaatcgcttgaacctgggaggtgtaggctgcattgagccaagatccactgcactccagcctgggcaacagagtgagactctgtctccaataatgaaatcatgaaaaaaaatttttttttttgagacagagtttcgctctcgtccaggctggagtgcaatggcatgatctcagctcaccacaacctctgccttccaggttcaagcgattcttctgccttagcctctcaagtagctgggattacaggcacgcaccaccacgcctggctaattttgtatttttagtagagatggggtttctccatgttggtcaggctggtctcgaactcccaacctcaggtgatctgcctgcctcagcctccgaaagtgctgggattacaggtgtgagccactgcacccagctaataataataatttgaaccaacattctaggcattttccctaaggaaataatcagaacgtatgcagatttgtgtacaagattgtaagttgcaatattgtttttgacctgaatgtgtaggtttcagtggggaaacctgatccccagtccctgctctcctcccaccccaaccccatccatctactacctttcccaaatagagcttgcgtagggccattggtgtccaggatccagagcagggcatgggtttgtgggaggtggtggttggaatcacctggggttggatactggacttagttcctctatgggtaaatgagagcctggggattgtcggaaagaggcctagggtgaaaattaaaatgacttaatttcaggagcagtcttggccttggagattcatgggacttaagagaggaagggcagaggctgaccgtgtagatggtagcttgttgctctacctgggccagagaagcctgcttgcctccctatctccaaggctgaaagagggttgtgcagctgaagatacaggaatttaggatacaggcaagtgccatgacctggcagcttggtatgtcgctacactgcaggagcctgctggcttcccaccactgggagtgccgttaggtgtctgtgctagacccatggccagagggtgaaaggaggcatgagtaaataggcaagagaaaagcgataatatgctggaagaggccttagagccagagggagaaggagcagacagactctcataaataaggagttctggtgaaacagaatttctgcgagagattcaattatagcaaaactttatggaaccaaaaagcttaaaaaaaaatcagaagtttaatagataaactgaaggagagaatggtcagcacaaactgagtagcctgttagatcaagtggaagaaacactcaaacacagcaaaaaaagagagagagaaaggaaccatgaaagcaaagaggtggaggaccaatcagccctgaagtcgatggtgatcaacccattcctgaaccatccctgtgaccggcagatgtccctctgcttgacttgcttaggcaggggtcctctgaactcatcacagagccaagggagaatgggatgaccttaatgggttaaaccagttagggaacacactggaacaaggggtagagtctgtgccacaaacacaaagagaaagggtggaagtttttttagtgtacaaataaccttgaatatctcctgtagtgacacatggtgcctaaccgaatgaaccgttgtgaagataaatgagatcttgcataacatgtttaacacaatgcctcacacataagccgtggagaaatagttattttctcatttgtgttttaaaggagtatttttttcttttttgagactgtcactttgttgcccaggctggagtgcaatggtgcgatctcggctcgctgcaacctcggcctcccgggttcaagccattctcatgtctcagactcccgaatagctgggattacaggcatgtaccaccatgctcagcaaatttttttttgttgttgtatttttagtagagatggggtttcaccatgttggccaggctggtctgctggtctcgaacctcttgacctcaagtgatccacccgcgtcagcctcccaaagtgctgggattacaggcatgagccaccgggcatagccaaaaaagagtttttagttttttttttttttttttttttgagacggagtctcgctctgtctgtcacccaggctggagtgcagtggcgcgatctcagctcactgcaagctccacctcctgggttcacgccattctcctgcctcagcctcccaagtagctgggactacaggcacctgccaccacgcccggctaatttttctgtatttttagtagagacggggtttcaccgtgttagccaggatgctcttgatctcctgacctcgtgatccgcctgccttggcctcccaaagtgctgggattacaggcgtgagccactgcacccggcccaagttttgggtttttttgttttgttttgttttgagaaggagtcttgctctgtcccagactggagtacagtggcgcgatctcggctcactgcaacctccacgtcctgagttcaagcgattctcccacctcagccttttagtagctgggattacaggcacgcaccactatgcccagctaatttttgtatttttagtagcgacggggtttcaccatgttggccaggatggtctcgatatcttgacctcatggttcacccgacttgacctcccaaagtgctgggattacaggcatgagccaccgcgccctgcccaaaaaaagagtaaagtttgaagggatgtacatgctgttctgtttgccagttcatcttaacggtgctgtatttagaaccctggaaacagccgggcacggtctcaaaacaaacacacaccccgtggaaacaatagaatgttgttactctgttgttacttagggagtgttttttcaaactgtactgtgcttgttactcacatgggggtcttgttgaatgcagattctgaattaagtgcccattctgactcagtccaactgagtcctgaggttctgcatttttagcaagctcccaggtgatgccgctgctcctggaccgcagactgcactgagtagcaggcacctgagttttgcctgtttttatgattgattgggctccccacggcatccatcttctagccagtgggaaaggggagaggaagtacagagcgagcaatttcctttttttttttaaccccatcttttattttgaaaatttcaaacctcctcaatttttgaaagaataatgcgcttcaccagttgttaacaatttagcaatattcttttaagcacatgacacagaagttgccaacattgtgctctctcttgttcactggtgaaacttttggcacatagcctgatcctgctgcaggagaggctgagaaataaaagcctagcttgacagtgatctgcctgctgaagggggtgggattctgttactactagatgatgataaagcagttattttttaaaaggagaagatggcagagtaggacaatggatactaggggacagtttgacacgcagactcaaatctttttttttttagatggagttttgcttttgtcgcgcaggctggagtgcagtggcgcaatctcggctcactgcagcctccacctccagggttcaaacgattctcctgcctcagcctcccaggtaggtgggattatgggcacatgccaccacgcctggctaatttttttgtatttttagtagagacagggtttcatcatgttggccaggctggtctggaactcctgacctcaggtgatccacccacctcggcctccggaagtgctagaattataggcgtgagccaccacacccagccaagactcgaatcttataaccagttctcttcaaattggattctggaaagctcggagttgaaatatacagcccaggttggtcgtggtggctcacgtcagtaatcccagtattttaagaggcccaggcgggcagatcacttgaggccaggggttcaagaccagcctgggcaacataatgacattcccatccctacaaaaaaacaaaaaacccaaaaaacctgttttttaattagccaggcatggtggttcacacctgtagtctcggctacttgggagactgaggcggaggccaggagttggaggctgcagtgagccgagattgcgccccaggctgggagacagagaccctgtctcaacaacaaaaacttcgcgttagatcttgcattatagaacccctacaaccggagggcagcttaagttgcctgttttactcagggacagccctaaactgcctttcgccagaatcggacggctgagaatccagtgtcgtcgcggggtggtgctgccagctggctccgggtggtcggccaggagccagccttgtgcacctgctttcagttgttggccagccccggcgctgcaggccctcgcgagcttaggatgcgcctgccagggcctgtgcgggggggccactcggtagagccgcgggacctcggcccggaaaccgcgccaccggcgtccgcacacgctaggccggggagcccagaggtctggccggccatgtctcggcgacctcccggagcgagggacagggaaggagccggccctcaccagtgccccgcatacgggatcctgggcctggcttcgcacggagcctgcccgctcccaacctgcccgctcccaacatggcggcagcgccggcctcagggggcggggccacgtgggggcggcggccaatgggcttccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgaggtggcggggggcggccgccggggctcggacctgcggcggggcgccgagggggcggggtaggcggggaggccgcgccggggtcaggggggccagcgcccaccgggtacgagcgcgctggtgaggcaggcccggccgcgcccgcgcccccggcgcacggtcctcccgggagccggtttcggggacggcggcggggagtgggcgctggccagggacgagggttgaggaggtcgcggctctcatgctgggtgggagtcgggccttctgcctgggggttgcgtcagtgtccgaccccgcgatgagtggtcgggacaatttgcaactagagggtggtcctcatgggtaccctgtggggtgtcgcgcgaggtgaagggccaggccatttccgtcgggtcagcgatttccgccttcgccccgctctcgcctggcctggtcagggcctgttttggtacttgttgcgccgattggagtcatctgcgacttgtttgccctcctctgaactcctgaaagccaggggctccgtctaggtctcctcctagtcttattctcccagctttcgttgttaagacaaattccttacgttcctggccctttacagaccggccctacagaacccacacccccagctccgactttcttctccagattgggtacttcccagggagtaaagggaatctgtagcttttgtggtttgtcctgctgggaaaatttgggggtaagtggtgggccttctctggacgaccacccacaaatctgtgtgcccaaacggagacaggacccagggtctggacatcaggcaaggggtactctgcagtaaacgtggacattggccgtttcgtgggtttgttttcactctgccaagtccttgaggcgtacacttttgtgtcactcatttatcttgaaagaaaaggttaacagcccaacagagtagttcgctttggtatctggagtggtaatcagagtgccagaactggagagaacattgccgtgtacagatgtttgccttttaccagggcactgaaggcataaaacccttagttaatgcttaactgagtgaaccatgaaagtcatgtgactccaaaggtcgactctagaaatgcggcagtccatgtagcactgtgatgtagaaattctatgatatatgggtcagtgttcacaggcagggagagggggagtcttcaacatctttgaattaaaaagcatctggggcaaaaacaaataaatacacacatatcagtgaactgctttaagttcagttagagaaggtgagattaaagaccagaagaaactcgagggagactgctgtataagtcccagttatctttccaaacagacaggttcatcacagcagtgaaggctagtcttcatctcccttcttgtgggattttctacattaatgtgcagatctgcccttggagaatggggcgtgcatgattgggctgtggtttgctggagtttcatcttactgaagttgcagacactgtgggtttctgtgacaatggtttacactgaaagtagcaaagtcaaggcatggtctggtatcagcatgccagaataaaacacacagacagctttttaaaaggtctgtgtccgtcctatctttagcctctcctggttgtaacttgaagtgactttgttgccgtgtttgttttgaccaggccgggacagtatggagagtatctttagatgtgacttatctgggttgcttagcaacagcatgcttcagattagaatggaagaaagttcctggatgtgaggagatttgaatgataaaagatacttacacctaaaaggagaccaggagggattgtgccctgttcttgctaactgggtgctcgtaactggagacggggtgtacctgttagcggtggttagacgaggtggatacagaatccagaatggtcacattgcagccatagggaacagatagatgcagagaagaggcttcagccctctgagttagggcagtgcatggccttgctctgctgaaatagcccagaggtcccatttgcttggtgacatctctcacttgaatagaaagctggctgtttatcagacactgttttcttaaatggcagctcctccacatctgcgtcatctccattatctcccctatccatctctttttggaaggaatccacgaagccctcatgactgtttgtttgtttttgtttttttgttgtcgttgttgttttttggagataggttctcactctgtcgcccaggctagaatgcagtggcgtaatctcggctcaccgcaacctccacctcccaaactcaagtgattctcctgcttcagcctcctgagtagctgggattacagtcatgtgccaccatgcctagctaatttttttgtatttttggtggagacggggttttgccatgttggccaggctggtcttgaactcctgacctcaagtgatccgccgcctcagcctcccaaagttctgggattacaggcgtgagccattgcatccagcccgccctcatggcttttacacctcttttcctggtttgcagaaagcaaggctggggtgtggaccctgcatcgaagctggttctgcttatgtccatgtgaagtgctttcaagtaaaatgctgatctgcaaaaagatgctgaaagtcctttgtctctttctggctaagttcaaatgccgaatttgattcagcaaatagttgtgagtgccttgaagtgcaaagaatgatccaggatcaggactccttccctacatatcattattttgatatgtatgtatgtatatatgtttagtgacggagtcttgctgtatcacccgggctggtctcaaattcctggcctcaagccatcctccaacctcagcctcctcagtcgttggggttacaggagtgagtttgccaggctctatatcattctttttagcatgacctctgataggaggctggcaggacagttcaggacttatcagaagcccaaatatcttacactgctgattaaagagagacctgtgtttgaaaaccaaacgggcatataataggattaacattctgctatgaacactaaggcatttgcgtagtgcttgtgggagtgataggaagggggtctgaaccgggggagccagggctttctgcaggaagtggtttggggtccttgtcaacagtgaatgctgcttaatggagccagagtgcccccctgcggaggtgggcagagaggtgccagtcaccccaaggtgccacagctctaagctgagatggtcagatagagggaagcaaacaagggccactccctagtcccaccttgtcagcagctcagacgggattccccatctctatctcagccagggagaagccatcgcgagaactggctatgagtgcgacagcttagagatgttgcaatgtctcttcaagttaggagtgaaattattatccattttgccccaaaatggactcttaaacccccatacacttggaatagcatgtattttgtgctttgaagccagaaataaacattctaaacaaagatttaaagttgcaatgaagaggaggtggttgtggacagacatgcagaacaaatgtttgagaaatgttccctttgcttccacagaaaaacaaaagaaaggcattttctcgtgtttgacaaaccatgttaaaaaaatattcttggccaggcacaggggcccagcactttgggaggccaagtgggcagatcgcttgagctcacaagttcgagagcggcctgggcaacatagcaaaactccatctctaaaaaaatacagaaattagccaggcatggtggtgcgcatctgtcatcccagctacttgggaaactgaggtgggaggatggcttgagcccaggaggtggaggttgcagtaagttgagatggtgccactgcattccagccggagtgatagagccagaccttatatcaaaaaaaaaaaaaaaaaaacctttcagtgctattttttgtggtatagttactgttattaaaaagcaaatggcatttctctttttttgtttactgtattcctgaaatagggtcgatttggccagcaaagtattgacactggggcccatcttgaaaacaactaactattgaagaaaataatttcattttataaaatagtagttgggtaattctcccttaggtaccaaaaagggctcttttctggaaaatgttaatgcaacaatatttccctcattcctttggtgttcatgggtgttctattgaatgctgttccattcttatttctttctagaagatagctcattctgactcctgctgtaaactgttcagagattattctttccagagtctgttacattcagaatgtcttgctagtctgtcacttgctgcccttctctttctacttagtttcagattactttgcatctcctctggcctcccgtttttaaccttttcattgatgtatacacacagaaaagtgcactgcttgatgagttgacatggcatgaacataacctgtacatccccaacgccagaagacccatgggcccccttaccaggcaagccctcttctattaagaaaagcgtttttcttgttgtaagcacaagaaaccactaatagtaattatactagggatggggcgcatacaggattcggaatttttgctttgtgttgcacatgaattcttactttactatgaacatgggttgctttgacaaatttaaaacaaaggcctgaaaggactccccttactcaagaaaaggaaaatgccttttttaaatgtttttttgaaatggttgtcttaaaatttctaaatattttttaaaattagattttatatagccacgcaaattgttctttaatggttatgtaggaatacaggctgcttggcctcccttgtccacagcctcctctttgtttctttgcgactttgactctgtgtttagaacatttatttccgggatgagtgcacaaaacaccatgctactccaaggcacagagtttcagagtcagcgctgagtctattttagagcaaaatgggtaacactactcataatttgaaaacacactattaaatacccaagctgttgctaactaaaagcagcctgtgaggttattttaatataaaaatgcaagctgaggccgggcccggtggctcatgcctataatcctagcactttgggaggccgaggtaggtggatcacttgagctctggagttagagaccagcctggccaacatggtgaaaccccgtctctacaaaaaaaaaacaaaaattacctgagtgtagtaacttaatgtctgtactgtcagctacttgcggaggctgaggcaggaggattacttgagcccaggaggtggaggttgcagtgagccaagatcgtgccactgcactccagcctgagtgacagagtgagaccctgtgttaaaaaaaaaaaaaaaaaaaaaatgcaagctggcgcggatgcagtggctgagacctgtaatcccagctacttgggaggctgaggtatgaggatcctttgagtccaggagttggagaccagcctggacaacatagggagacccagtctctacttaaaaaaaaaaaaaaaattcaacctagacttggtggcttgtgcctgtaatcctagctatttgggaggctgaggttgagggatcccttgaaccctaaagttcgagaccagcttgggcaacatagtgagatcctgtctcttagagaaagaaatctatgtgtgtgttcgtcattttgacatacaacatcttcacttttttctgacaatgaaaacaacccaaggttattgcaaaaaaaagatccagtaatacagaaacaagtgatacagaatggaaccgtctgctgcaattgctggggcagattcaggcagaaatttggattacttttattttattttattttattttattttgagacagagtctcactctgttgcccaggctggagtgtagtgatgaagtctcggctcactgcaccctccgcctcctgggttcaaacgattctcctgcctcagcctcccaagtagctgggattacagccaccatgcctggctaatttttgcatttttagtagagatggggtttccccatgttggaactcctgacctcaagtgatctgcctgcctcggcctcccaaagtgctgggattacaggtgtgagccaccacgcccagctagatttatatttgatagttatttgattccagaggatcttaagtgcaaacccagagaagcagagagtaaaaagcaaaaaggcaacaaaacccagcagatggtgagggaaagggaagaagccagggaggggcaagtggggacaggaagtgctctgaaacccgaccctctcttgctgggctttctccttttaaactgaggagctgctgtgtccatctcgcccgctgcttcctaggcggtacagagggtttcctgtagccttaagttttctctccgagaacagacagattcttggttgagccttaaacagggtccagtcttgggtgttagtcaagaatgctgttcaagtaaatacgttttactatcatttgactcccatgtgcccccaaacctggtattatttacaggtagttttgttgttgttttgtttttaaaccaaacaggttgacccattcactcaatctgagttaggaaatatattccaggcacaacctatcaggcggttgcctgcaagatcccagctgaaagcatcgctgggacaaaggtgatgctttggcagccaccctgttggctccgtccagcccacacctcagttgtctcaagctgctctttcagtgggaatgtgagatctggtagcagaggctcatttcaccccaattttctatttcagaaaaaggggccgggtgcagtggctcaagcctgtaatctcagtactttgggagtctgaggcgggtggatcatgaggtcaggagattgagaccatcctggctaacagggtgaaaccccgtctctactaaaaatacaaaaagttagccgaatgtggtggcgggcgcctgtagccccagctactcgggaggctgagacaggagaatggcgtgaacccgggaggcggagcttgcagtgagccgaaattttgccactgcactccagcctgggcgacagagcgagactctgtctcaaaaaaaaaaaaaaaaagaaaagaaaaaaggaaactcatccgaagcaagagaggcagccacggggtcccatcttggcagcacatcttctggtccccggtttagcgttctgtccttctcttgggtcatgttcttgtctctgttcttcctcatcccttcttcgtccttgtcatcgccacttctgacactgactgagtggggccacaaaaggtgagtcgtccttccggctgcccccaccacaatccagccctggctcaagagcagggaaggtgctgtcccccaggctgcagacgggggttagtacagcaacctcagacagcttcctctctggggggaccctgcgtgtcttgggtgcagtttcgaggaggatgcagagggatggatccctgccttcttctgtgtgacccctgcggtgggggagcatccctgctcagcccaggggatggcacttttcatgtttgccgtgagattcctctagcaaaagcagtgggttttgtgagtacttaggtaatggtgccagaaagcaccatgacaccctggtatgtccgccccatataatcagagaatctgactctgctcactgctgagaccccgatacccagggtagggcctgaattttcaatgcaattgcgataaattaatgactaaatggattctcagtttgaaatgtaaggcgtgacagaacgttcaacccagggaagattgagtcaggacccgggaccttgccggaacacctgtggccgttgctgctgttaactgaggtgtaattaacatgcagccaagtgcacagcttcacccagcagatccgtacgttttgacaactgtgaaacaagacgtagcacatcgccatcgcgcttctcagctccgccttcaccactctgggtgccagcaccggcaatttgtttggccagttccagagtgtcataaaaacagaatcctccattgtcactcctctgtccttgaagagatatgcatcgagttgtatgcggccactctgcgggctcccctcggcacatgatggtcttcagagagaggctgtttggaaatagagtggtgggtgtttgcttcttgtcacccggcaaatgattcatttttctgctgctctgacactttggaagaagccagggatgctgaggagatggcttgctctcacgtgggcagctgctcctttgagaaacaagccatgcgcagtgttagctgctgacatcctccacttttagcccttgagcccatttcactgatgagcaagacagtggcctgtatctgtcactaacgtgcttttctttttctcccctgttccccaaagacaggagtgtggagttcatgagtgttggatttttcaagctagtaaaccttgcagctgcaagtggtgtttaattcttgtggtatggatgagcacatgctaatctcccttgagcttctcttgagcagaagcctggtgtgctaacgggcaggactggggtggtgctttgagaggaagagggggaaggtggcccgagagggagatctactgagatgtgagctgcctggagtttggggtggggattcctggaggggctctggattttgcagagggacagctgttggtgcaccttcaccagtgtgctgggacagaaagtggggtgagtgggtgagtgaggaataagtgtttgaagggcaggagtaaagcagaaaggtggcagcaggtgttgagctgcaagtggttccattgcctggaaaggaggtggcagggaggcctgcccaagatgggtgcctgcagggtgcggacagcctgtcagaggtgcggaaagcctgacattgaaaatgtcagacagtgggtgcttgggccagagagaaagagcctgaggagctggaccaggggttggggggcggcctttagaagcagcgtctcatgcagccttcccagcgatcctgaggtaggtgggagaatcttcaggccacggctgagaagctgaagcgtgtggcgggagatccgtctcagaacacctgagatccctgcagggtctgggagcatgttaggggctcagagtgcaggtagggactggcagggaggagctgtgggcgggaagagagagaagggagggcagggcagtgtggccatggccagctgaacactgggagtctgctcctgaggtcatggatggaggccaggacacctctcaagccattaagagggtggcctttccaagcgcagcatgacttgttggtcttgaagcagtgccttcgaaggaggaggagtcccccgtggacttggggcattaggacagggactgccaaggagagagggcactaggaaacagggttgtttttggcttttttacctggggtgcaagtggagcaccctgtgggcatcatgagggtgtcaggaaacccttctggtaactgaaacgcagtccattctgtgtcccccagattctgagttttcagcacctgacagtggcgggggatggcagacacacctgtgggtgctggagacatcttggcggcccttcctccagtttggcatcatagtcccctgtgggctgagcacatggggctcctggacagttgttaccgatggagggtatccaggttcttgacatcttgaacaaagaattggacaaaacggcacaaacaaagcaagaaaaagatgaagcaacaaaagcagatttattgaaaacgaaagtacactccatagggtgggagcaggccctggttacagaattttctggggtttaaataccctctagaggtttcccattggttatttggtgcatgccctatgtaaatgaaagtgacctgcgatcagtctgattggttgaggaaagcagccaaccagaggctgaagtgaagttacaaagttacatcctatgcaaatatctgattcattgtggaaagcaaccaatcagaggctgaagtgaaattacaaagttgcactcctatataaatgaagacttggccggagaccagcttgattggttgcaggaggggaccaatcagaggtactttcagttcttgatctgcttggtagaaaagcaggtcggtgtgaagggagtagcctctggttcttttgttacttggggatggaaagttggggttttcctttggatttagttctaagaagtcagcatgaattggccttaggttccctgcctccagaccctattctcctgcctcacagtgatgttgatcagggggctcagcttggctctgccagttcagacaccagccccttccagctactgccagtccttggaggaaagcagtcttggtaccgtgtccggagaggtcatttccatgtaaaagaaatatgaggtctacaggcagctcaggagcacggagttgggggaagcagagaaggtgtgagtgccgaggcgcaagcacggcttttgtttgggtcaagcaggatcagtgcctccctccttgcatcgctccacctccggaaggcggagaactgcgatgcagacccaggaggccagccaggagagatttctcaccccaggctcgagcctttgaagctccaggttctaacttaaaaattcaagggagtggccgggctcggtagctcatgcctgtaatcccagcactttgggaggccaaggcaggtggatcacgaggttagggatcgagaccatcctggccaacattggcctgacaaggccaacaaccttgtctctactacaaatacaaaaattacctggttgtggtggcacatgcctgtaatcccagctacttaggaggctgcggcgtgagaatcgcttgaactcgggaggcagaagttgcagtgagccaagatcttgccactgcactccagcctgggcaacagagccagacaacatctcaaaaaaaaaaaaaaaaattcaagagagtttcgcattctcccgtgcaatacttccctgcttgttgtagtagagatgcgtcctgtgcctttttaggaacatgttctgaaagatggcttgggcaactgtgactttagtgctctatccccccagcactgccctggtacccatcctgtttagagggctcagagcagagagcacctgcctggcagggcccgtctctgactttgccttgctgctcctcccagcactgccctggtacccgtcctgtttagagggctcagagcagagagcacctgcctggcagggcctgtctctgactttgccttgctgctccccccagcactgccctggtacccatcctgtttggagggctcagagcagagagcacctgcctggcggggcctgtctctgactttgccttgctgctccgcacagcactgccctggtacccatcctgtttggagggctcagagcagagagcacctgcctggtggggcctgtctctgactttgccttgctgctccgcactgcactgccctggtacccgtcctgtttggagggctcagagcagagagcacctgcctggcggggcctgtctctgactttgccttgctgctccctgttatcagcactcttgtccctgtgtcctccgggtggcctgcagggcaatggaagatgagtacttagtagaaggttctaggtgggcacatgagggttccttgccagcaccagggctttgttcacacaggtgttgcatgaagccatccagccaagagccagggctccatgcctctgagccctcaggcactgcatcatgctgggcctcagctccatacctgccgcgtgtctgtctcaccatcactgtgctcaaggaaggtcgccaccagatgctcctctgtgcgccgggcctgctggggctgccctggggcctggaaagtgctttaagcaggtcctttgtctcgtgtcaggggatgggctccaaagttagtggttggaactaactttgccatctgctggagggctttgcccctgccatgccttgagcccacacatactccaggggtgactgacacagttggttttgcatcagaattggccattgccacctctgaggggctgggaaatgggtgaccctgccccacagtgcctgcactgcccccagcagacaatgctgggggagcagcttcccaccaggcctggcttggggcttctccagggaagcccaggtacacctcccagcctgtaggtgaaggtgcctggaatggaactcgctattcccagaggcacagagctcccgtcacagcggctgggtgacagcagtaattctcgcagatgttcaggccctgggaccccagaagtgaaatgacccagggcgtcagcaggaaaggaggccccactttttcaggacctctccctccaaccagctccacgtccttcccaaagctgggcccagcgtggccctcatagccagctccgtctctctctccttgggcctgctgtgactgcaggcacggatacactggggagacgggatgtagaaagctgtgggaagagggagcaacggcagggcaggggccagtggggttggggggggccgctggccctgcctttggatcatctccgacttgatcagcatgaacccctgactctagagggaggctgatgggccagggcacatgtgggtccccctcactgcctccgcagcagtggacctacagccatgctctttgaccccatctcttcctttcatgggcacacaggtgacccgagtctctgtttcgtgcaccttcctgcctcttctctgcccctcagttgggctgagacacatgaggtgctgtgatgcatgctgcatttggccctgacttaggtgtgacgcgtttccatttttaaatcgagtgtaaagaactggcctccagaaacacggaagcacttttagtagggatttgaaaatccgcagatcgttgtgtatctcagagcccagtgtttttcttgaaattcacactggaaacaaatgaggatactgggggaaatgtgcagtcccaggacatgagagatgcgagcttattacgaatctgtctttggtaccaagccacaatatagagatttgtgaaaatctttaaaaatcaacttgactgggccgggcgcggtgctcacacctgtaatcccagcgctttgggagggcaaggcaggcggatcatgaggtcaggagatcgagaccatcctggctaacaaggtgaaaccccatctctactaaaaataccaaaaaaattagccaggtgtggtagcaggcccctgtggtctcagctactcgggaggctgaggcaggagaatggcgtgaacccgggaggcggagcttgcagtgaaccgagatcgcgccagtgcactccagccttggggggcagagcaagactccatctcaaaaaataataataataaaaagatctggaacgttttcgtcccctcaggaagtcatccctgccccaggcatccacggaggtcaaggccttgccaaccccacttcctgggtccagctctcaggtggttctccctgtggcctccagacccgggctgtaccggctggtttcgcaggttgcctgtgctcatcctgccctctccggtgagagctgagccggtggtgtttttttcagagccagctggccctgcaggagctcagaaacctgggcggctgggcctatgggctctggagttctgcccagggtggccaggtgggcagcctttcccccgtgctggttcctgtagcaaggaggaggccgtgtgctggggcccttgtgtcaggagctgtctctggaaaggctgaatcgaggaaccagcctctgccttgtccgtcgatgttgtggggttagtggctttgtcccagagtttcaaagtgtgggtaagtggtttctgggtttgccagttttcttagcccttaggggaaagggggtgggagcctgccctcagctggcttcgtaaaaacacagtatctgtgcttgagttacacgcccggcgtccttttgcgttttgagacctcagtggagtgtgcgggccctgagtagtatgcacccactgacagtgaaccagatgctgcccccctgcggttccagtgtatgtcagtgccagccacgtgcccaggacccaccgttcccagggatacaagatcccgtggcccatggtggcagctgcggcacacagcgctgctttccagagctctcagtgcggacaacagaggccttgcattcagtcacctggaaaacccaccatccacattggaaacccagtctctccggaatgagaaatttggttggttttctttagctttttgtttttttgtttgttttgtttattttttgagacagaatctcactctatcgcccacgctggagtgcagtggcacaatcttggctcactgcaaccttggctcactgcaacctctgccgcccaagttcaagcaattctgttgcctcagcctcctaagtaactgggattacaggtgcctgccactgcgcccagctaatttttttgtatttttagtagagacagggtttcaccatcttggccaggctggtcttgaactcctgacctcatgatcggcctgccttggcctcccaaagtgctgggattacaggcatgagccaccgctcctggccctggttggttttaattaagaacattttcaaacatccacgtggcatacccgttatccagatctaacgcccattaatattttgccacttttttgctccaactaaattaaactaaattctggaacattctgtcattttgcccctgcatattccactgtgcatctgttaatataaaatatggactttttgtacataaccacaagactcttctcacacctgacaagattaacaccttcatctgttcttttagaggttttgttcctttgtgtgttctttgtcatctgttttgttttgttttgttttgtttcgtttcatttcgtttttgagtcagaatctcaccacgtcacccaggctggaatgcaatgacaccatctcagctcactgcaacctctgccacccgggttcaagcgattcttgaacctcagcctcctgagtggctgggatgacaggcacaccaccacgcctggctaatgtttgtatttttagtagagatggggtgtgttagtccattttcatgctgctgataaagacacaccagagactgggtaatttataaaggaaccaggtttaatggactcacggttgtacatggctggggaggcctcacaatcatggcagaaggcaaaagtcacgtcttacatggtggcaggcaagagagaatgagagccaagcaaaaagggaaaccccttataaaaccatcaggtctcgtgggacttattcactaccacaagaacagtatgggcgaaactgctcccatgactcagttatctcccaccaggtccctcccagaacatgtgggaattttgggagctacaattcaagatgagatttggggagggacagagccaaaccatatcatagtgtttcaccatgttggtcaggctggtctcaaactcctgacctcaagcagtccacctgcctggacctcccaaagtgctaggattacaggtgcgagccaccatgcttggccccagctttttgttgttgttgttgttgttgttgttgttgttgttgttgttttttgagatggagtcttgcactgttgcccagcctggagtgcagtggtgcgatcttggctcactgcaacctctgcttcttgggttcaagtgattcttccacctcagcctcctgagtagccgggattataggcacctgccatcatgcctggctaatttttatatttttgtagagacagggttttatcatgttggccaggctggtcttgaactactgacctcaggtgatccaccagccttggccttccaaagtgctcatattacaggcatgagccaccattcccggcctatttttaaagggtctggagtcaacagtgcatggatccagaaccgtgggaacaaaggggtgggcacaagggcggggtggggggtgtgagtttagagaggcttctccctataaagctgagcatgaactacttggcacacctgacgttgaaccaggagctgagaaccacacaagttaggagtcagagcagagctgctcaggacgtcagtgctggccctgtcccaggtcaaggggataccccgggaagtggctggactgagccaagtatcagctagtagtgggtgctcaaggctggtgtagaggggcaccgcctccctgccagcactgtcctgacacttggaccccatcagctcgttccagcagagaaccaccctggggaggggcctagctatctccactccgcagagaaggctccaggaatctgattaactaaggctgagccagcagagagaccagattcagcgtctaaattcctccccttgtcaggaaagggaaggttgtgcagaaacctggacagtggacgccgcgggcacttcccacccatggcagcaggagggcgggagctcagagaggctgggctcgccctgccagtggagtggggactgccagataaaagacgaggtctttcctgggcagtgagtgagtcctgggggcccaggggcttgcctccacaccttgcacctgcccccagcagctttcagctgcggatttcacggcctttcctgattgttgtttgactccgtcatttctgttggtgattccaaaatggtgactttctaattcagtcattatttctacttttattagctggcattcttctgtaaagaactttcctcaacgctgagatgaactacgcagttcctcctaaaaaaggaggatgaatgcagcatcttttcccatttatttatgggtttgtttatttatttatttttagagacagggtcttgctatgttgcccaggctgatctcaaactcctgggttcaggcgatcctcccacctcagccttccaaagtgctgggattacaggcatgagccaccacacccagccttccatcctttccttttttttttttttgagatggagtctcactctgttgcccaggctggagtgcagtggcgcagtcttggctcactgcagcctccacctcccgggttcaagcgattctcctgcctcagcctccacagtaactgggattacagttgcccgccaccaagcctggttaatttttgtattttttgtagagacagggttttgccatgttggccaggctggtcctgaactcctgacctcaggcagtccacccaccttggcctcgcaaagtgctgggattacaggcgtgagccatcacaccaggccccatcctttccttttaacgactaatttccaacttaaagaaccaaggcttctgttttccccttctcggtgcccagcacttggccggccagccttcctccctccattcctctcttcctttctatacaaacttccttgttaaataaaacaggggggctgctcctcccgcccctggattggatgcactttcctgatttaaaggagtccttggccactcgtgaccccgacttgaactgtggtgtcccccaaagtctctttctttccgcccaggagtgttcacttgctgggcggggaggagaaattggggtgtgacccactcagcacaaacccacgccctggtcataaagccgcaccatttcccctgcaaatccagccgttcactgccccggccaccgggctgctttgaagggggatgaggcatgggggctgctgaacccacaactgtcactggcagccactggctggagttgagagaagtcaggctggctggggccgttgaccctcggaaggaccactgtcataagatgtgagaccagtcaggggcagctcagatggggagagaggctggccagggcttccttcagctggggctgagcagtggagggcctggttccccatcctgcctgccctcctgggcctgggtcttcccagcgatgggggcgactgcagcgcctcttgggagggcgatcgtgagaggcagaggcctctgagtgctggctgaggggtgtccacccgtgggacatgctccgtgctcttctgtctcgcctgcctcacaagctgagcatgaggaagaccaggctgtgaggtgacgcgtcccccccacccttccccacaggtgtgaatgacagaggtggtgccatccagcgcgctcagcgaggtcagcctgcgcctcctctgccacgatgacatagacactgtgaagcacctgtgtggcgactggttccccatcgagtaagtggagcggattgcagggttggggagagcccgtgagcctcaggtgcagaagctgggcggcgggggtgggggcctcttgggcccttaggaccgtgctgcaaagatgggaatggcctggaggggccacaggggtcccaggttacccacctcatctagggacccctgctgctgggctctttccacctctcagggtgtgcagagttccccagaagggctctgtgagaaatttcagttacagagctatcgggtgtggtgctatttataattcagaaaatttagaagccactcaagtatcttcacagcaaggagttggttacatgcattagagtaattagagtatgtgcatataaaagtgcaatattattcagccgggaaaaaaaaacctgtcaaagagttatattttttgatagagaaatcttttttacaagatattaaaggagcctgtaatcccagcagtttgggaggccaaggagggcagatcacctgaggtcaggagttcaagaccagcctgaccaacatggagaaaccccgtctctactaaaaatacaaaattagccaggtgtggtggtgcgtgcctgtaatcctagctacttgggagactgaggcaggagaatcacttgaacccaggcggtggaggttgcggtgagccgagattgcgccattgcactccagcctgggcaacaagagcgatattccgtttcaaaaaaaagaaagaaagatattaaaggaaaaaagtcagtctagaaaatagtatgtaccacgatcctatttttatttgaaaacatgtacaagataaaattttataatgataggtatgaactgagcgggggtgaaaaaaattttacaagggggtatgtaccatttaacagtgtttcagtatttgaggtgggtagattaatattaggccctatgattgtttcttcttgtctgtcttgcctacaatatatgcacatacagcttttttgatgaaaaaagttgacacaaactttgaaaatggaaaataaacaagatcttgccagccaccagcatttccttgagtgttcacctcagactgactgaacctcatgctcttggcagggcggtggcagggacccctgtgcgtctttgtggaagcgggaactgtcacagtccaggtgatgtgggctggcggtggcaacatgagttaaaaaactgttcttggctgggcgcagtggctcacgcctgtaatcccagcactttgggaggccaaggtgggtggatcacctgaggtcaggagttcgagaccagcctggccaacatggtgaaacctcatctctattaaaaatacaaaaattgggccgggcgcagtggctcacgcctgtaatcccagcactttgggaggccaaggcaggcctgaggtcaggagttcgagaccagcctggccaacatggtgaaacctcatctctattaaaaatacaaaaattgggccgggcgcagtggctcacgcctgtaatcccagcactttgggaggccgaggcgggtggatcacgaagtcaggagttcaagaccagcctgtccaaggtggtgaaaccccgtctctactaaaaatacaaaaaaattatctgggcatggtgcaggcacctgtaatcccagctactcgggaggctgaggcaggagaatcgcttgaacccaggtggcagaagttgcagtgagccaagattgtggcactgcaccccaacctgagcgacagtgagactctgtctcaaaataataataataataataataataaataggcctggtggcacgcacctgtaaccccagctactcgggaggctgaggcaggagaatcacttgaacccgcgagtcagaggttgcagtgagctgagatcacaacactgaactccagtctgggtgacagagtgagactccatctcaaaataaaaataaaaacgtgttcttcagcccagcaatttaactgctggaaactaatctagagaaataaaagctgcagtgagtgcatagatcagactctgcccagggttgcctgagagccagtggagccacgctggaccgtgggccttggccatgtgagccacccagcctgcctgtctctcctgcagttctcgtgggcctaaggtctcaggttcccaagactgtgacatgaaccgggctgtgaggcagcaaaactaaccctacacaccctagaaactccatgtgcctctgtcctcctgaccttgtctctctggggctggggctggattcgcctgttaatgaccatgtcctgggcctttatgcccactgttttttttgcctgctccgctcagaggggtcttggcctcattgttgatgagcagccgttagcagcctcagcctcacattccccttaagggcgggttcctccctgtcagggaaggcattgtaaactcaaacgcctgtcagctgtgaacctggctcttcctggaatcactccactcccctagtcttcagtgtccagaagtctcacagattctcgtaggcactcctccagtgtccaagggtgagaagggccctaaaatcttcactcacctggtggaggaacagggccctgctgctgactctccatgagttgcttccatggagacagtttcatgtcggataaaattatttttcccgggccaggcgcggtggctcacacctgtaatcccagtactttgggaggccaagacgggcagatcacatgaggtcaggagtttgagaccagcctgaccaacatggagaaaccccatctctacttaaaaaaaaatacaaaattagccgggcgtggtggcacatacctgtaatcccagctactcgggagaccgaagcaggagaatcgattgaacccaggaggcaacggttgcagtgagccgagatcacgccattgcactccagcctgggcaacaagagcaaaactccgtctcaaaagaaaaaaattcccatcagagatccccagtcctgtctagacagatcactgctttaagaaggtggctgtgacagttaggtagagacttaagtgatgggcacactcctcggcagccttagagcagcaggcagaagtggcccagagctccctgtggttctgatgtctagagcacgaccatagttggacttgacctgtggcaggttcacctgagtatgttctgtttctcaggtacccagactcatggtatcgtgatatcacatccaacaagaagttcttttcccttgctgcaacctacagaggtgccattgtgggaatgatagtagctgaaattaagaacaggaccaaaatacataaagaggtacgtacgtgtgtgcagtgaggacttggcagtcactgtcattggacgggccaagggggcttgcgatggaatcatgctgcctgctccacagccgtcgtccaaggagcctgtgacccaaggaatccaagtggccaacgacacttgtccctggctggtgcttttctgtgtgtgtgtgtgtgtgatttcatggtgcgtgggcctccagtcgtgcccagcagcaggcttcataaccactgtcgttctgaagcaggcatgagcgcagatgatgcattgagaatctgcagttacaacgtgctatgaaaatacccctgatttgtgttggcggcagtgtcatagaaaccgctaagactgcttcagcttgttgaaggaaatgctagttacagttagaggtcagggaaagtacagagataattttttttcctctaacttcacagagccctttaagatctaagaaccctttgggcatccgtggacccacctcagtctcacttcaggctagcaaaccccagtctgaatgtaaacagtaagaccatggccatattgttccaaatggttgagtttagtcaagattctgtgtgatgatgttggtcatcccagcatctgaggtaatgtttaccacccgaggatttagccaaggagggaaaaacccaccaacaactggcagatggttcaatttgtttggcttgaggttatttctttaaaagttagagaaggggccgggcgcagtggctcatgcctgtaatctcagcactttgggaggccgaggcgggcagatcatctgaggtcaggagttcaagaccagcctggccaacatggtgaaaccccatctctactaaaaatacaaaaattagccgggcgtggtggcaggcgcctataatcccagctatttgggaggctgaggcaggagaatcgcttgaacccacgaggcagaggttgcagtgagccgagatcgtgccattgcactccagcccgagggacaaaagcaagacttcgtctaaaaaaaaaaaaaaagaagaagaagaaaagttagagaaggcctgggcacagtggctcacacctataaccccggcattttgggcagatcacgaggtcaggagttcgagaccagcctggccaacatcgtgaaaccttgtctctactaaaagtaaaaaataaattagccaggcatgatggcgcttgcctttaatcccagctactcaggaggctgaggcacaagaatcacttgaacccaggaggcagtggaggttgcagtgagcggagattgcacttttgcactccagcctgggtgacagagtgagactctgtctataaataagtaaataaaagtgcaagaaggcctgtctctccctttaaggacccgaatccactggcatctaccctgttttgcctgtggtcatactctgtctggcacagcttttttctcctgagtcactttttctgccctagcttcctcctgagcttttttctttgatttttaagagctaagatgtagcagaaagcaagtgtcaacattcttttctctcctcttttttttttattgaaacggagtctcactatcacccagggtggagtgcagtgatgcgatcctgatcccggctcactgcaacctccgcctctcaagtaggattttagacgtgcgccaccacaccaagctaatttttgtatttttagtggagatggggtttcaccatgttggccatgctgatctggaatccctggcctcaagtgatccgcctgcctcgcgggagtgctaggattacaggtgtgagccaccgtgcccagcctgatctctcttgttaatgggacacgtggtcccccccttcccccaatgactcattcccctgaaccccatccccctccgggtggctttcctgagtgccccctggtgactgtgtgcctgcccccaggtggcggctgggtctcttcctcctctggaatgtgtttgtgttccctcgaggccgacatggggaccctttggctcatgttcccggctctcagtagagggccctctggcctgcacgctggcactcattcatctggccccttcctctcaggcttagtgagttcaaggtcagggcaaagtagaccctgttaagagatgtcagctggggaacagacacccttcctgcaggcctggagtaacaagagtgataaggacgccttcctccctggactgacatatctgggtgaactgtggcttgaagagggctgggagagcagggagcctggacaggctgaccccagcccagcacgtgggagcagaaaggccttcttgttctttacgagttggaagatgataagagcctcatgctgatcagattcatgactcccacccggaattccatctctagaaccaagagatggtgggtggctttacgcaggtgtggcggtgtcctctgcctgtgggggcagcagaaggggttggacggccgcccaagtctcactcctccaagatcacctggggcagcgtgcgattctttaactgaacctctaaaactttgcatttgtccactgtcctgcatccaggcctaccaggtgacatgcgtgcattcccatgaggcccgcgtggtgctgtgtagttgctgccttcatgccataactttaccttgtgctggcatcagagcctcattcccgtccttggctaggcctcccacacacccctaggagaagctccttttgtgtgtgttcttcttttcagctgtttttcaccagaagggcataaacgctctcatttccttggggagtgggggcccctctccagtacctcttgattctgcccctcccagtcggtgtccctctggctgtcgtgggaagtcggtgcggagcccgcctgggccgggctgtgcagtgagccgtgcaccagacgtgtgagcctgactttctctctgactcttcctctaggatggagatattctagcatccaacttctctgttgacacacaagtcgcgtacatcctaagtctgggcgtcgtgaaagagttcaggaagcacggcataggtaagggcagccgggcccgcggcttggcgcccaccccacccccttgccctaccccacccccatcccatctgcacccagtctcttccctggccccaacaactctggctcgtgaacatccctcagtctcatcttccatcctcgttcccgtcttgggccagaccttcatcatccctcccctgccagcacacccaccaccttcagccatcctctttccacatgcccccaggcctttctgctgcagcctcgctcagcccccaggatggagctgaggaaactggcacctctcacttctgctgccgccacacgcacaactcgtgtattcactgctcacgattcagagtagaaagcgtgaacacgcacgaggaagcaacactcaccgtttctccgatgtcccaccccactcggccacacggccagtgagcggcagagtcttaattaattttaaacccaggcccatctagtccatgttttcctgggctcacatttaccctgtttgttgtctgaaagggagtctccatgcgggcccagcccatgggagggcgctaccaggccacctctgcagtccctcccagcagtctgtagctaccaggctccatctggccatgagattttagggactttgacagtggtggtgaagaaaggctggtctctgatacggtgggccgagacatctccgagagactcatgcaaagcccccatcctagcccagtcatccttccttcctaactgctctgcctgcattacctttacctcttctccccaaggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttatatccttaacttctgggggagagggactgtggcttcctgtccataaggtggcagagccagtgagcaagttggagctgtggtccccctcagatgatgttcaggtggccaagcttatggatgcttctctcccttacctgatcgtgttgtgggtaaacctgacacacatttgggtaaatcgagttgcacatattaccatgttgcccaggctggtctcgaactcctaagctcaaatgatccgcctgccgcagcctcccaaattactgggattataggcatgagccctgcacccagctggagagcctcctgctccacttgcactggggatcagcagtgcacaaaacggacaggatcccctgtcctcccagagcctgtgctagcagaggggaaacaagtgcggagagaagagatttttactttttttgaatacttgggttcaaaccttccttataggatgcatgacccaaaggtatgcccttccctgcttcttcctccttaactttcactggcccctgacaggtcagagggaagccaggaaactttataatagtcagaatgtggcccaaaaaaatgctgtgcgtgtgtgtgtgtgttttcaaattcatgagtctaggatttattcattacatagaataataagcaggaaagagaggggtgaccccacactccacaggccgtctagcttatgtgaagacaggcatccagggggtcagcactgttgaccccctccttgtcatatggacagggctctgtccctcttgctgccacaaaggttgagaatctagggagaaccagaagcacctgcccttctgccaggccccttccccaccccccgtgcatccctgggtgtggtgtccacatgcctgctgcctcactcagaaggcccttctgtccccagaccccaccctctgttgttttgcacagcagaggccacttcgtctcatgagcctttccagctctgcagaggcttagcgggctctcagcctccgaagcctggcttgccatctgcacacagtcccacaggccactgcgcgggcccctgatgactgtgccctggcgagcgtggtcagggcaagtcggaatcttccttaacagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagtggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattggagttcgtcacatcctgtttcccgcacccgcctggctgcacctcgggcctcaccctgtagctgaagttggcctcgagctacttgtcactggcaaggcccaaggatggcttccagataaaggggacagtggttttgtgtgattaaccctgtcagagaatgaggacctttggccaggcacggtggctcacgcctgtaattctagcactttgggaggccgaagtgggcggatcacgaggtcagatcgagaccagcctggccaacatggtgaaacctcatctctactaaaatacaaaaattagccgggcgtggtggtgtgcacgtgtagccccagctactcgggagcctgaggcaggagagcttgaacccaggaggcggaggttacagtgagctgagatggcgccattgcactccagcctggtgacagagcgagactccagaaaaagaatgtgaaactggggaagaggttctagagttgagaagcacattaggtccttttttcactggaaggtccccagcagctgccctgtctgggcatctccctggctgtaggccttgagctggggcccagtccaggcaggcggctccaagggtgatttggtgcaccctgctgtggagcctgaggtgcgtgcccacccagcacagacctggtgcttccgtcagcctctcatggaaacttctggtcaccctcaagggatgatattgttcctcttagagatgaggagaactggctcgggggctgggagttaccaaggagccacagtttgtgagtgttgggcccaggcctgggccactctgaagcctgcgtggctgctctgttacaccattcctgtgcctttgacctcatccagtggccgggagacatgcaacttgccgagggtcctcccaggagagggtctgaagcatctgcaagatggagtaggggtggacgctggtgccctgggaggccaggcagctgggcgcgctggacccatgtccaaagccatggggtgagtgaaaccagattaacccgctgagcttgcccacgggagcgtctgctggggagacacagtcttggttactccagcaaggacagttgcacctttgctgatgagtcagcttgcggttaagagggtaactctttggggcccttggtcaatcgtgtgaccagttagtaacttgcccaggtggggctgcggctcctcaggccctgcttcagtgaggccaggcaggactgccactgctccaggcctctcaccatagccccaccggaccgcagagctgggacacaaacgctcgtgctccactggggggcagaaagggagtgtgggacccagggagaggtaggacacacacaggatgcacctggacatagcacggaggccagccctgaacggagctggctctgccccaggcctgctcaggggtggagcccgaggcagccttgggtctccccgctccctgcacacaccacccaaggatctcctatagggtaggggtccttcatactttcaggacggagacagactcctggtcttccattcctagcccaccggcgttcagggactcacggggtaaggggcgtgcccagggatggtcagtgtattttcttttttttttttttttttgagatggaatctcattctgtttgcactccagcctgggtaacagagtgagatcttggctcactgccagcttggcctcccgggttcacgccattctcctgtctcagcctcccgagtagctggtacaacaggcgcctgccaccatgcccggctatttttttgtatttttagtagagacggggtttcaccatgttagccaggatggtctcgatctcctgaccgcgtgatccgcccgcctcggcctcccaaagtgctgggattacaggcatgagccaccgcgtccggctgaggtcaatgtgtattttcatgagcgtccgcttgctcaggccaagtgctgctttctccacatcgactcccaccccagcgtgccatgattgtggcttttttgcctctcagtctgttggagtgcttctcaaaaaggctttgggaggttttgcgggagggactgtctagaggccaatttagggccagttttctttggggccagcatgtggctgcagcagatgtcctctcgggtaagatcctggctacagctgtctgtggctgagttacagactgtctttttttttttttttttttttttttttttttttgaaacggaacctgctctctcccccaaactggcgtccagtggcgtgatctcggctcactgcaagctccgcctcccgggttcacaccattctcccgcctcagcctctggagtagctgggactacaggggcccgccaccatgcctggctaattttttttgtatttttagtagagatggggtttcaccgtgttagccaggatggtctcgatctcctgacctcgtgatctgcccacctcggcctcccaaagtgctgggattacaggcatgagccaccgtgcctgccggagtaacagactgtcttaaagcttcacagcctaagcaggggccattctgtttgcttccaattccagctgggacaggagtcagcagggactccatgtggtattagccaggcaggctggcggggctggaggacctgtgtgaaagatggccctacccacagggctgcccacagtgagctcagcagtggccatgggcttggctccttccttccatggcttcctcaggctaggctggttttgcaccataccacagtcccagggtagactccttacggggccactgacctcctgggaagctgccaggcttccttactgcccagaagtgacaccccgccacttctgccacattctactggtaaagcaggatctggagcctgtcccaattcaaggggagggggctacacaggggccagaacacgaagacacgtggctcatccggggtagcagaagggccactgaccatagcctgggacccccccccccacccacccaaaatctggagcctggggcaacctgtgctcctctctgagcctccactctttgttcagaagtgagtggagtccaggtgcggtggctgatgcctgtaatcccagtacttcaggaggccaaggtgggaggatctcttaagctcaggggttcaagaccagcctgggaaacatagtgagaccctcatctcttaaaaaaatagaaaatcggccaggcgcggtggctcacactggtaatcccaacactttgggaggccgaggagggcagatcacgaggtcaggagatcgagaccattctgcctaacacggtgaaaccccatctctattaaaaatacaaaaaattagccgggcgtggtggcgggcgcctgtagtcccagctactcaggaggctgaggcaggacaatggtgaacccaggaggcggaggttgcagtgagccgagatcatgccactgcactcctgcctgggcgacagagcaagactccgtctcaaaaaaaaaaaaaaaaaaaaaaaaaaaaaaaaaaagctgggcatggtggtggcccacgcctgtagtctctgctactcaggaggctgagatggtagggtcacttggctcaggagctcaaggctgcagtgagctatgattgttaaacatagggcccagcgtggagcctcacctataatcccagcactttaggaggtggaggcgggagcattgcttgaggctgggagttggagaccaggggcaacatagcaagaccctttctctaccaaaaaaaagtttgtaattagctggacatggtggcaactgcctttggttccagctactcaggaggctgaggcaggaagatcacttgaggccaggagttcaaggctgcagtgagttaagatcatgctactgcactccaggctgggagacagtgagacactgtctcaaaaaaaagaaaaggggaaaaaaagtggattaggcccctaacggtctccaagctccaaggactttgtattgctggcctctgtgcggcctcagttatgcccagcgtccgcagctggtggctggtgcaggcgtccttccatgtttactcagcagcctccctaatgtcagtctttaagtggtctcttggatccacctggcctctgcgtctctggggaatgagtgttgtgggagagagagaaggcagctgcccctccgccaccccatgtgactcatcagtggacctcaggcccgctgcatcccacccacacctgccccatcacagctgctcttgggtgcagcatgtaaacacctgctctctcagagctccccctcctggggaccgctacagccttgggtgtcccccaccccgggccatgcctgcatacttagaacaacccataaaaccacccaaggactgaagtctccaggatctgctgtcccagggacacaagaactgtccagggtgggtacaggagaagggaaggagcctggctgtcctgggcacgtcacatgcgacctggcaggagcccaaagcaggggtggcgctgagccctagcctgacccgggctgcaccggctggagtgaccagacgggaaggtcactgaggcaaacccaggtgctcccgtcttcttcccataggatggagacctggtggaatagaacaagtgtgttagtccgtcttgacactgcttcctgagactgggttatttataaacaaaagaggtttaattgattcagcgttccaggtgtctgggaggcctcaggaaacttacaatcaccatggaaggcaaaggggaagcaggcaccttcttggcaaggcggcaggacagagagagagagaggcggtggtggggaggaagggtggaactgccaaacacattttattatttttttctttttttgagacaagagtctcactctatcacccaggctggagtgcagtggcacaatctcggctcactgcaagctctgcctcccgggttcatgccattctcctgcctcagcctcctgagtagctgggactacaggcagctgccaccatgcccggctaatttttgtatttttagtacagacagtgtttcaccgtgttagccaggatggtcttgatctcctgaccttgtgatccgcccgcctcagcctcccaaagtgttggcattacaggcgtgagccactgcacctggcccaccgccaaacacttttaaaccatcagatcttgtgataactcactatcatgagagcagcatggcggaaccccccaccccccaccccatgatccaatcacctcccatgagaaccctccctcaacacatggggattacaattggagatgaaatttgggtggggacacagcctaactgtatcagcaggcttctcatccacagtaacagtgctcccgagggacaccggacaatgtctggagacacttgctgtcacagcttagaggagggtgctacagataccaagtgggtggtggccagagatgctgcttaacatcctacatgcacaggacagcctccatcccaaagaaagatcccatcccaaacatcaacagagtcgagtggagacaccccggcacagaggaagcccacacctgggtgcgcagagtctggtccggctgggaggagaagggctgtgctcatcctgcccagagggacctgggagctggggtcccgcggagcagtgacctcacctggtagggggcaggtggggccgaggtccacatccctgcctctgctgctgtcctccctggtgccctccctgaccccgccctgccttccttcatccgctgcgccctccacccacaatgccatggcctgcatttaggatcctcctgaggcaggaggatcacttgagctcaggagtttgagaccagcctgggcaacagcaggaccccctccccccaactcttaaaacaacagaaaattaggccgggcacggcggctcacgcctgtaatcccagcactttgggaggctgaggtcaggagatggagatcatcttggctaacacggtgaaaccccgtctctactaaaaaaatacaaataaattagccgggcgcggtggcgggcgcctatagtcccagctactcgggaggctgaggcaggagaatggcgtgaacctgggagttggagcttgaagtgagccgagattgcaccactgcactccagcctgggccacagagcaagactccgtctcaaaaaaaaaaaaaaaaaaaagacagtctgtaactcagccacagacagccgtagccaggatctcacccctgagaaggacatctgctgcagccacatgctggccccaaagaaaactggctctaaattggcctctagacagttctagactgcatctcaaaaaaaaaaagaaaagaaaattagccaggcatggtggctgaaaaggtgggctgttgagcccctacccaccctatggagccaagctcagcagtgtctcatccaggaagctctcacagacaagtatggtgttcccacaggcccttgccctagctcacgcctctcatgccctggcaactaagagtgggggcgcggcagacccatccctggagagacacaggactgtttttctcaccaaactggcctgatgacagacaggcagatggacaagaacgtgcaggccttggcttttattgagatcagagctgtgggctccccggcctctcagggaggcggtggcgggggggcctgattctgcactcagcccggcctcccaggtacaagtggctgactggagtctaagcaggctgcaagggcacggccatgcttctattgcttctgcccctccctcggaacctcctcctcctccctctccccatcacattctcccgaggcccaggcctgggcgctgggccgctgcctgggccaccccatgtggcagggccactgccgggggccgagcccctcctgctcaggctgcctcctcggccatcctgcccctcctgtacccagtcctggcactcgggatccctatggcctctccagggccccagagcgggttctcttgcacaagggacacatggcctcttcccaggtcccccaggacctcttgggcctgagcctagaaggactaggctgggggagggcacccttgtctgggtccatgctggaactggaagctgaggaaagaggagagaaaggagtcacttgagggacccaaggggaggctgggggggaggctggcagcccaccctggggtttccagaatccgatattcttgaaaacagaagggaggagggcaatgcttcctccttaacagaatccccaggggagggaggaggttgagggaacagaatggttcaagctggaaggaccctcatctaacctgaaccctcattttacaagtgagaaaactgaggcccagcaagggagacagattccaaggcccctcaccgagtgtggagctggggcagtcacccagccctccctcccagatcctccctttttctcgcaccgctttgtccctggtggattctccagaccccgcttagctgtgcgtgatgcagagatggggacagattcatcaagatcttggccttctggggcatggtgccactgtggaggcttgggagtggagaagggcccgcctgaggccccagcccaaccatcccctagggtcttcccccgtgcccagtcctgccttgacagagctcaccactgcttcccaggctgtccctgggcaatcgggcttccagaagggctgaacagaggctgttacgtgggcccagagtcccctgtggcaggtccagggcccaggctgtgccctcaggctgtggcaggcagcccccagccataagccggcccagccagtggctctcacactggccagtgggtggcgggtggctctccaggtagaggcccaggccccggaggtggcgcagccggaagttcttgggcttgcttccctgggcactggggcactgcggctgcggggaccccaggcccccctcgtagatgttggggggtgcgtcagggtggccggggcgtccttgggcctggctcactgcatctgcagaggagacagcgggagggtggtggccagccccccacagcagccatgaggggagggtgcagtcacatacctctgagaccagctcacatgatgggctacacccccagccaacctggcctcagtttacctgtgtgtcaaatagtctcagtccactgcctcccctgcccatgcccaagacacgactcctcttcccactcccaaccaacagggaggcctgggaagcctcgggccttggtactaagagtgctttcaggacctcaagtcctttctactaccctgttctgcccgctaccctaggaagagtattctggtccccacagagaaattgcacagtgggtttgagagaaagtggccagcccaggggctcatggcctggcccagtggccattcccctctcccaagcatacatgtccctgaggccacccctcggctttgggcccaggtggggacagaagcctatctctcttcctgccactcctccccacagcccggcaccttctcttatgtgcagctcagaaaatgcacagaccaaggcttccatggagggccagtgtggtggggaggagcaaccaggacttgggtgcagcagggccctgctctcccctgcctagggggtacattggcaggtctcccctggcaactggttcttatgacatcacggggaagactcccagccttcctggacccctagtttgggagaggacagtgcccaaggcaagggcagggtgaaagaaaggcatgggaaggggccagaaccctgggggaagtccctggtccctctggctggggtcaggccacataaaacagacagctctggcaaactggagagtccttctctcaggtgatctcttggggccagcttcctcatctggggtgggaaatgagggttcaggagtacagacctaggaagacctaggtcggtactttgaaaatgctgaaaaggggctgggggcggtggctcatgcctgtaatcccagcactgtgggaggccgaggcaggctgatcagttgaggtctgtgggaggccggggtgggcggatcatgaggtcaggagatcgagaccatcctggctaacacggtgaaaccccgtctctactaaaaatacaaaaaaattagccgggcgtcgtggcgggagcctgtagtcccagttactcaggaggctgaggcaggagaatggcgtgaacccgggaggcgaagcttgcagtgagcccagatcgcgccactgcactccagcctgggctgcagagcgagactccgtctcaaaaaaaaaaaaaagttaaacattcatctttccggacctggccaagcaggaagcgccatcatgggagctgacgtccgccacaagaaggacctaaaggttcggcgcaaagagcccaagagccaggatatctaactgaggctgtttgttggtcaagctgtacaggttaccgtccagacgaactaactccacattcaaccaggttgtgctgaagaggttgtttatgagtcgcaccaaccggccacctctgtccgtttcccggatgatccggaagatgaagcttcctggctgggaaaacaaaacggccgtggttgtggggacgcttaacggatgacgcgagggttcaggaggtgcccaaacttaaggtgtgtgcgctgcccgtgaccagccggcccacagcggcatcctcagggtgggggccaagatcctgactttcgatcagctggccctggactccctcaaggacggcggccccgtcctactctccggtcttcgcaagggccgacaggtgtaccggcatttcggcaaggccctgggaaccccacacagccacaccaaacgctatttccgctccagggaccagaagttcgagcgcgccagaggcctacgggccagccgaggctacaaaaacgaaccctcttattaaaaagattttggatgctgacaaaaaaacaaaaagttaaaacattcaattttctcttgtcacagacgacctgatttttctttttttcttttctttttttttttttttaagatggagtctcactttggcgcccaggctggagtgcagtggcgcgatctcggttcactgcaacctccgcctcccgagttcaagagcttctcctgcctcggcctccccagcaggtgggattacaggcacccaccaccacgcccaacggatctttgtatttttagtagagacaggctttcgccatgttggccaggctggtctcaaactcctgacgtcaggtgatccgcccacctcggcctcccaaagtgctgggattacaggcatgacccaccgcgcccagcaacctgatcttgtatgtaggaaatattaaataattcatacttgaaaaaaaaaaatcctgaacctagtagagctttttcagagctaatgaagttcagaaaaatctcaagtcataaaatcaccacacaaaaattaattgtatttctagatactagcaaagaataaaaagaataaaataggaatacatttaaccaaggaggtataagacaactctgaatactataaaacattgctgagagaatctaaagacttaaataaattggaaagcatcacatgttcatggactgaagacttaatattgttaagatagcaacactccccaaagtgctcagtacaattcttatcaaaatcaaaatggccttcatgtagtgtattaggcttctccagagaaatatagtcagcagaatgtatatagatatttacagagaaaatatttattagaggataaataaatctccttatataattttttctgagatagggccttgctccattgcccaggctgaagtacagtgacatgatcacggctcactgcaacctcaacttaccaggctcaggcaatcctcccaccttagcctcccaagtagctgggactacaggtgtgcaccaccaggcctggctaattttttaatttattttcattttttaatttttaattttttaaatttttgctgatggagatctcaccatgttgcccagagctagtcttgaactcctgggctcaagtgatcctcctgcctccacctcccaaagtgctggggtgataggtgtgagccgccgtgcccagccaagagaagatttattagggatattggcttatgtgattatccgggctgagaagtcgcacaatatgctgcctgcaagctggagaaccaggaaaactggtgctgtaattaagtctgggttcaaaagcatgagaatctgggtaggggtgggggtgagggctggtgtaagtcctggtgtccagaagtccaagaaccaggagctccaatgtccaagggcacgggaagaaggatgtcccagcccatgaagagagtgtgaattcacccctcctctgcatttttgtcataattgggcacccagcagattggatgatgcccaccacactggtgagggcaatcttctttttttttactcagtctagcaattcaaatgctaatctcttctggaaacgcttacacaagcacactgaaaaataatgttttaccagctatcaggcatcccagtcaagttgacacacaaaattaagcatcacaagcagaaatggaaaagctaatcctaaaattcatgtgaaattacaagggagcccaaataaccacaacaatcttggaaaagcaaatcttcagaaatcagaaacacggctgggcatggtggctcacacctgtaatcccagcactttgggacactcaggtggtcagatcacctgaggtcaagagtttgtgaccagcctggccaacataggcgggcggatcatgaggtcgggagatccagaccatcctggcaaacacggtgaaagcccgtctctactaaaaatacaaaaaaattagccgggtgtggtggtgggcgcctgtagtcccagctacttgggaggccgaggcaggagaatggcgtaaacccaggaggcagagcttgcagtgagccgagatcgcaccactggcactccagactgggtaacagagcgagactccatctcaaaaaacaaacaaacaaacaaacaaacaacaacaacaaaaaaaagtgaaaagacaacctatgaaatggaagaaaatattggcaaatcatatatctgataagggtctcataggcagaatatataaagaacacttacaattcaaaaacaaaaggatgttcaacccaattttgaaatgggcaaagaaaatgaatagacatttttccaatggaaatatacaaatggtcatcaaacacgtaaaaagatgttcaacatctttaatcatcagggaaatgcaggccgcgtgcggtgactcacgccaacatggcgaaactccgtctctacccaaaatacaaaaattagctgggcgcggtggcgcgcgtctgtaatcccagctcctccggaggctgaggcaggaaaatcgcttgaaccctggaggcggaggtttcagtgagccgagattgtgccactgcactccagcctgggcaacaagagcaagagtccatctcaaaaaaaaaagttcaagttgatcaacatcctttcaagcccttggcattgtcaagagttttttgttgttttagccattttatctagatttaatttttaggtttttaacgtgttacctgatattttagccagtttaataacttcatagtgatatctcattgtggttttaatatgcacttctctaataatagccttgatcatctcttcatttgcatattagccatccatatatcttcttttgtgaagtagcttttaaaatgttttctccattctctaattagactgtttctcattattgagtgttgagagttcttgatacattctggatacacgtctctttatcagatatgtgttttgtgcatattttcttctagactgtggcttatcttttgtttttcttaataacacgtgaagcaacatttatgggaggccattgttttggagcgagctcctgcacaaggtaccaacggaccagaccaaaccagaatggaatcgctagtgcaaggtgccacgtaatcaatgcgaacttagagacaggccagtctgccaaaacacagaagattcactgcaaccaacaaaaggggccctgtccacctaggctggcataaggaagccccctctgctttaacccaaagaaatgcatctgaaataacctgatgccaaccaatcgctttgtgcactacgctgtttccttgttcctgctcaagctaccttacaaaacccggctgctgtgccacgcctggcggggcatctccccatttcacacgtggaggccgccccttcctgccgtctcctcgcgcccccatgcagaggctagggctgccgggacccgcgcggcgcgagcggctcagggcccctttccggcctgttgtgcagcccgagccgtctgcgcgtgcgcgagaccgaggcctggcctgcctctgggcgcccacagtgatcccgtcctccgctcggcaaccagattccgacgaggagcgcgctgtgcctcggacgggggaaggcgggcttcctgagtatagtgcattttttttttttttttttttttgagacagagtctcgctctgtcgccaggccgaagggcagtggcgcgatctcggctcactgcaacctctgcctgccgggttcaagtaattcttctgcctcagcctcccgagtagctgggattacaggtgtgcgccaccacgcttggcaaatttttgtattttttggtagagacggggtttcgccatgttggccaggctggtctcgaactcctgacctcaagtgatccgcccgcctcggcatcccaaagtgctgggattgtaggcgtgagcccccgcgcccagccaagcatcgtgcattctttatagaaatgagggggaaataagcaatatggaaagcgcctagcgcaatatcaagcacgtagtaggtactcagaacctgtcacccagcgcgaaacgtccgcaaagcgtgtaaacagacgcccagaagctgggaagcttgcagccctcatagacgccggtatcgccacgccctctgccctcggcgtctcaggagcgctctctgccggcccgctctccccgtgcgtatgcacgtgccgccgcgtcttcgcttcgctttttgtttgtccctgaccgtgcgccgtccaagggtccattggttgccatagagatcgtcgagcgctgggcctgtgatcgctgaggggcgagcagttgcgaccctgggctcctggggacctgagcgttatgtctttccgcgacctccgcagtaaggcagccccgcgcccctgtgacctgcgggtcttccagagattcagggctcccgcccgccgggtcccctgtgtaggcgatccctgaggcttgcgctgccggaggctcctttcgggcctctgcgcctcagggaccgcctgacccgcggctgcaacccggccgagcgtcccaggcccttcttcggccatttctagcgaggatggaaagttctctatctgccactggccgcgtgtggctcagaacgcttgaaatgtggctagtgcagatgaataactgaatttttaagtgtaatttatttctgtttgtgtagctgcatgccgctcttcgctaccgtattggaaaatgcatggagagtttagagactattttttgagttgggttagcttagcgcttagaaaaccgaacagcaggccgggcgcggtggctcacgcccgtaagcccaacactttgggaggccgaggcgggcgaatcacctgaggtcgggagttcgagaccagcctgaccaacatggagaaaccccgtctctactaaaattacaaaattagccgggggtggtggcgggcgcctgtaatcccagctactcgggagtctgaagcaggagaatcgctttggaggttgcggtgagccgagatcgggccattgcactccagcctaggcaacaagagcgaaacaacatctcaaaaaacaaaaaacaaaccaaaaaaaaaacaaccagcaacgaaaccgaggagaggaggctgggtgataatcattgcggctaacattttttgagttttaacgatctgccagggcccgctctgtgttatgcgcatttcattttaatcatctgaacaactctgtgccccctgtatttggtagtgaggaaacgggcacagagaggtcaggtaacttgggcaggtgatacaggcggtaggaggtggcactggggcttgaattcaggttgcctgaactccagacatcctgaactccatctgcatcctttctgcagggctggtaaggagaagggagctcgaattcctttgctaagagggtggggaagtggaagaacgaggctaagagtgttggttacggctgggcgcagtgggtcacgcctgtaatcccagccctttggaagaccgaggcaggcggatcacttaatttcaggagttctagactagcctagctaacatggcgaaaccctgccgctgctaaaaattcaaaaaattagccgggcatggtggcgcgcgtctgtagtcccaggtacttgggaagctgaggcaggagaattgcttgattccgggaggcagaggttgcagtgagccaagatggcaccactgcgctccaccctggccgacagagtgagactgtctttaaaaaaaaaaaaaaaaaaggaaaggtagatgatgattgccaatttggtgtgatccgaggggtctcttaaagccagttttctcgtccaattgttggtgcctgaaattttagcattagagattactccttttggttatgaattgctcttttctacaatgtaaaaatatctaggaagacgcattaccttttatccatgcagccactgagcaccagagtgtgaatcctgccctctggggtttgaaggtttttggtggccacacatcatgcaggatgactgtctcctcccacatagtttttagagaggccagcaccctgccgggggacgtagaatggggttttgttggggagcgcacacacggagatttcggaatattttgatcttaaattaatgctctgcagttgtgcagtgtatggtaaggatcttactcaaattagtgtctattttgacaataacaccgcagcattaacagaacttgactagtacctagtggtcaggagtatttaggcagtgccttactgtgtgaaggaaaggctgctgctttcttttctgttctttttttgagacagtcttgctctgtctcccaggctggagtgcagtggtgtgatcttagctcactgcaacctctgcctcccagcaattctcctgccccagcctccccagtaactggaattataggcgcccgccaccacactcacctaacttttgtatttttatttttattttattcttttctttttttgagatggagtctcgctctgtcacccaggctggagtgcagtgacgcgatctcggctcactgcaagctccgcctcctgggttcacgccattctcctgcctcagcctcctagtagctgggactacaggtgcccgccaccacacctggctaatttttttgtatttttagtagagacggggtttcaccgtgttagccaggatggtctcaatctcctgaccttgtgatccactcgcctcggcctcccagagtgctgggattacaggcgtgagccactgtgcccggcaacttttgtatttttagtagaggtggggtttcaccattttggtcaggctggtcttgaactcctgacctcaggtgatctaccctcctcggctcccaaagtgctgagattacaggcgtgaaccacccgcgcctggccttttttgtttttgtttttgagacagggtctcactctgtcacccaggctggagtgcagtcacatgatctgagcttactgcaacctcctgggcccaggtgatcgtcccacctcagcctgctgaatagctgagaccacaggcatgcaccaccacacccagttaattttttttttaatctctgtattcacatttcccagaaaacagttacagagtccctttgtgactttgctgtttcctgtgctcacactttctgtttcattgtcttgcgaagtctgacctgacttgcagtacctaggtaggttatttgtgaacattgatggaccattttgaacatggatcttcaagaagagtgcagacagaccttaaataaccaggaagcacactgaatgtagatcttggtacatatgggaactcaacaaatgtttgtggtgttcatttccaagtcctgctctcttgaaagcactaaggcttttcctgaggtgaccccaacctatggatcaacaagtattagtattactgtttcttaatctgttttatagtaaatctaaatatggttgtatagttcaaccactctatttaagatttctctaaatacaaggcgactgatctttaaaacttgtgttatttgggtcctatgtggtcactaaaattaaaaaaaaagacaactcagaaacatgaatgtcatcctacggattcccctcagaaataaccactgttaacattttaaaacactttttaatcagctgaatttgagtcaaaccactgttgacatttaaaaatactttttcttcatgacattttataaggacgggtgtttcttccttttagcagtaaaaagaaatgagatactaaagagagaaatgaaattcacagctaatccctcaattccattttcatgtatagccatctacttctcccattgaacttaaatatatgctttttaggtagcatttttggtattttaaattttatctcctttttgctttcccttgtagaaagttgacaaatagtccctaaagctgtcaataggttggaaataagaaggaaaagtaaagacaatatctaagttaataagtagttgctgtgtgatggggaactgaatgaattgtatttttccttggacagatttcacagagatgatgagagccctgggataccctcgacatatttctatggaaaatttccgtacacccaattttggacttgtatctgaagtgcttctctggcttgtgaaaaggttcgaacggcactttattgacatctaagagtgaatactgggttttatttattagtcatctagaaaacaggacacagctgtgatgctgcaaaagggaaagtttttggaatttgacagacccagctgtattctgttacaaaggagttgtggctgggcacagtggctcactgctctcatcccagcacttcataatctcagtcattcaagactagcctcatcaacatagcaagaccctgtctccatacacaaaagaacaattagctgagcctgggtggtacacactcatagttccagcgactcaggaggctgaggcaggaggatcacttgatcccaggagtttgaggctgcagtgccactgatcatgctattgcacaccagcccgggcagattgagactgtgtctcaaaaaacaaaatcaggccgggcgcagtggctcacgcctgtaatcccagcactttgggaggccgaggcgggtggatcacgaggtcaggagatcaagaccatcctggctaacacggtgaaaccccatctctattaaaaacacaaaaaattagccaggcgtggtggcgggcgcctgtggtcccagctactcaggaggctgaggcaggagaatggagtgaacccgggaggcggagcatgcagtgagccgaagtgtgcagtgagccgagatagcgccactgcagttcagcctgggtgaaagagcgagactccgtctcaaaaaaaaaaaaaaaaaaaaaaaatcagtggagtttaaagaatgctgtgggagtgggaaatataccaggaagtcgtgaaaggagacgactattcctcagtaggatgctgggccaggctgctcttcagcccctcatggcagagtgacaggggcctttttgcacattctgatcagtacactggattagaaataatggagatttctttttctgtgaaaaaattgaatatgttatatgattcagggttggcagctttttctgttaaggaccagataatattttaccttttgctaaatataaaattcataagatctctattgcgtctcttctttttgttaaaatgtaaaaacagttcttagcttgcaggctgtacaggtcggaggctgcagtctgctgacccctggtttcaataccttgaagaaaataacttcaccaactctgctgctgcttagagctgactaatcggccctagcactgatctctgagtcaagggctgtcagccagggtagcagttctgattagcttcatgacatggtgagatctgagagagatttaattttataagctgagatccacatttagtttttgaaatctgtttttcttaggtggggatttgctcccttggtatttggttttgcttttgaagtttgccttgatctcactctcccacttggggacttggagagcgttgtgttccagacccgctgtcctctcagttgcccacattctctttagtagactttctccttggttaacccgtgctctctcctcttacctctcttgatagatatgagccccagactgacatcccgcctgacgtggatactgaacaggaccgagttttcttcattaaggcaattgcccagttcatggttagtggacacttattttgtggagttgtaaaattaaataaactagaaaggatgactccttgttagggcgactttcaaactgtgtaattgagtttttctttctttttttttgagatggagtctcattctctcgcccaggccggagtgcagtggcacaatcttggctcactgcaacctccgtctcctcgggggttctcctgtctcagcctcccgagtagctaggattagaggcacacgccaccacacctggctaatttttgcatttttagtagagactgggtttcaccatgttggctaggctggtctcaaactcccgacctcaagtaatccaccctccttggcctcccaaagtgctggaattacagatgtgagccaccacgcgcctggcctgagtttgctttctaaaaccattccattgctgggtttctgtggcaccatttcaccagcgaagttctttttgtttgtcttttaattcattatttgttaagaattttgtttatgccaggtgtggtggctcacgcctgtaatcccagcactttggaaggccgaggtgggcggatcacgaggtcaggagattgagactatcctggctagcagggtgaaaccccgtctccagtaaaaatacaaaaaattagttggatgtggtggcgggcacctgtagtcccagctactcgggaggctgaggcaggagaatggtgtgaacctgggaggcagagcttgcagtgagccgagatcacgccactgcactccagcctgggcaacagagcaagactctgtcttaaaaaaaaaaaaaaagaattttatttatttatttttgaatagataacatatttcatggctcacaaattgaaagtaggctgggcgtggttgttcatgcctgtaatcctagcactttggcaggccaaggtgggaggatagcttgagtccaggagtttgagaacagcctgggtgatgtagtgagatcctgtctctacaaaaaataaatttaaaaaaaattagatgggcctggtgacacgtgcctgtagtctcaggtgcttgggaggctgaggtgggaggattgcttgagcccgggaggttgaggctgcagtgagccgggatcatgtcattgcactccagcccaggtgacagagtgagaccctatctcaaaaaaaaaaaaaaaattaaaaacattatgaaacaaaatggagtaaaatgactttttaccctatctgccctgggccaagttccattccaaataaccactattttaaatctcttccagagtttgtgtgtgtgtgtgtgtgtgtgtgtgtgtgtgtgtgtgcaaataaaaatatatatttttcctttgttttacacaaatggtactgtattctacttgatgtacttactgtacactacaagatgtttagcatcttgctttacttaatggtatattttagagaactttccaaatacatatagaatttcctcattctgtttacgcctgagtggtattgcttgcatggatttgccataatttatgtaatttatataggtaggcttttaggttgtctgaagctttgctctttggaacagtgctgtaacaaataacctgtacatctcattttgtttgtgtttgagtgtgtccctagaataagttcttagatttgggattgctgggtcaaaagatatgtgcatttgtaattttgatgtcttttaccaaattgctctccatcaagattgtcccagtttatacaaccactcacaatgtttgagtcacttgaatgctttgcttttattaggttatatcccagttgtcagcagaggcattttcaactcacctacatgggatttagtttagacattacatggaaagggccttcaactttttttttttttggtctaaaaataggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaaggtaaggacaacaaaagccttgtagtgggcgatggagcgttgatttcttgagctctgaagtggaaggagtctgctacagctccgctgcttttcttcctcctcagctgagggcagtttgtcagttttgtgctcatcagcatttggataaagtcaaagtcacaatccactaattcaactatttattaaaagcttagtatttgtcaggtagcattcaagcgctgaggatacagttgtgaacaaaaaggacaaaaatcgtgtgtttattctcttcagttaggggagtcagactgtgaacaataagaggtgtggaaggccagatgcagtgcaggctgtggagaataataagctgggatggggatggatgctgcccagagtgatcttaaatcgggtgatcaggaaggcctcatggattggatggtgtttccagcagagatccaagggagggaaagagtgagttgtgcgggtggcgggtggcgtcagggtgtctcaggatgataatttgttttgggctgggtgcagtgactcactcctgtaagccaaacactttgggaggccgaggtgggaggatcctttgatgccaagagttccagaccaacctgggcaacatagtgagacgccatttttaccaaaaaaaagaaaaaaattagctaggcgtggtggtacacacctgtggtcccagctgcccaggaggctgaggtgggaagatctcttgagcccaggcagtcaagccatgttcatggcactgcgctcccgcctaggcaacagaacgagaccttgtctggggggaagaaaaaaaatgtgttttgtgtgtttgaggaaaagcaaggaggccgtgtgatgagggttgggattgacagaccctctggcgcctgggaagcccctggaaagcctttgtctttgcctctaaggtgggaatcgttgggatccaagcggaaccttctgtgcttatttcccgtccaaagggttgctctggctgctgagccgccatcagaccgaagcaggcggcagggctggaagcagcgagcctgtttggagagtgaggggtgaccgtggctttgagcagagtgctggtgggacaggtgccgtcaggtgtcagggagcgaccacagcagcaagccagaaataaaggttaagccgttactctgaggcccaaggcctcagagcaggagacctaggaatgaaggccccggggctgggagtgcacctaagagtgtggccacgcagggtacgtgaaaccacagtgcactggctgagctccaagtctgctgcagggaagaaagcttcccctgtgaggcctgctaggtgaggccttgtcatggtctatagttgggcttgaaaagccacacacagcttttttgttttgtttttgttttgttttgagacggagtttcagtctgtggcccaggctggagtgcaatggcacgatcttggctcgctgcgcctctgcctcccaggttcaagagattcttctgcctcagcctcctaagtagctgggattacaggtacacaccaccatgcccagctaattttttttttttttttttgagatggagtttcactcttgttgcccaggctggagtgcaatggcacaatctcagctcactgcaacctctgcctcccaggttcaagtgattcttctgcctcagcctcctgagtagctgagattacaggcatgcgccaccacacccagctaattttttacttgtagtagagtcagggtttctccatgttggtcaggctagtctcgaactcctgacctcaggtgatctgcccgcctcagcctcccaaagtgctaggattacaggcgtgagccaccgcacccggctttgtatttttttttttttttttagcagagatggggtttcaccatgttggccagctagtctcaaactcctgacctcaggtgatctgcctgcctcggcctcccgtagtgctgggattataggcgtgagccaccgcgcctgtcctcacatgtgggtttttaaccaggagcgacactcgtcagcaagagaagtgtctagagattggggcatattttgatggtagatctcacgggatgaggcatgggttgagagtaagtcaggtgctacaggccgggtcttggggcagccgtgcggcagagcttgcagagctcatgggtgtgttccgcctctgtgctgtactctacgggaaccactggccacatgtggcaagcacaactgaggaactgagttgagttctgcattttctttaattcttaagtaatttaagtgaaaatggccacatgtggctattggttactatattagacatcactgctctgaagttttttgtgtgagcccctggaaggatgaagttgccatgtactgaagcagagaaggttctgcacatgctccatttgccacgccgattggctgtccaggtggagatggtgcacaggtagctggtatgtgaaactagagcccagggaaagcccaggctggagctgggagctggggagcaatcagcacacagatggtattaaagccttgagggtaggagcagagccagcagaaaagacggggggtccaggaatgaaactctgactcgctccacttttgagaagcagagaaggtgacagactcctgcaaagaagtttggggatgtgctgctcggaagggaagaaaagcagctagagccagagcaggctggatcctggaggactaaggaagagggaagcaagctatcaaagccatcagctgcaaatgaagagggagagttgttgctagtgggttgaaaatgagagccagaaggtgaggattggttgtccaggagagagggagagtgagcagagcagggagacgtttatgtttgggctccttagaagagttagcatattctaggaagaaggggtgacacacacatcctaagaaagaagcctgtgcacagggctcagtgctaaatcctcattgtggttgtcatcaccttcctggcaacagctgcccatctgtggagcccagaaccattgtaagtccttagtgggtgccacccgatttgcgcctctccaagcctgtggaggaaagtctgaggcagagaaggagggcaggggaggacgaaacacaggacgtcaggctgctgcaagaggatgtgtgtccctcaggctgtccctttgtgtggccgctctgctgccgtcaggcaccctactgtgacaaagtccaagtaggaagcacgtcagctttctcccagctatgccctcctggttgtggcttcagtttgaggtgacattaggttttttggagagacccaggcgtcctggaattggtctctttagtacttagatgatcatttcctgagcgtgtgtcccgcagcctgtgagcatgtaactggggaagcacatgtttgtggtcacgtgtcccaaccaaaggtaggagctgacatgaacaggctagtggttgaatgcatgttaaaaatctgtggctggccgggcacggtggctcacgcctgtgatcccagcactttgggaggccgaggtgggtggatcacctgaggtcaggaattcaagagcagcctgaccaacatgtagaaatcctgtctctactaaaaatacaaaattagccgggcgtggtggcacatgcctgtaatcccagccacttgggaggctgaggcaggaaaattacttgaacctgggaggtggagattgcggtgagccgagatcgcgctatcacactccagcctaggcaacaagaacgaaactccgtctcaaaaaaaaaaaaaaaaaaatctgtggctggctgaacatggtggttctgcctataatcccaacactttgggaggctgaggtcggagggtcacttgaggccaggagttagagagcagcctgggtaacatagccaagaccctgtctctattaaaaaacatctgttgctgaggtttctgtttttgttattttccttccagattgcagatttgaaggcagccaggcagcttgcgtctgaaatcacctccaaaggagcatctctgtatgacttgctcggcatggaagtagagttgagggtaagcattccagtacttccttaaccatgcagattttctcttcaaggttttctttttcaattctgtttctcccttttcagttctgatttaatgaaatacacctggttgaatgagctaatgtgtggaaaggtgatagaggatattagctgtccttcctgcttctggtgggcactggtctagctttatttatttatttatttatttttatttatttatttttgagacggagtctcgctgtgttgcccaggctggagtgcagtggcgcaatctcgtctcactgcaagctccgcctcccaggttcacgccattctcctgcctcagcctcccaagtagctgggactacaggtgcctgccaccacacccggctaattttttgtatttttagtagagacagggtttcaccgtgttagccaggatggtctcaatctcctgacctcgtgatctgcctgccttggcctcccaaagtgctgggattaccggtgtgagccaccgcgcccggcactggtctacctttaacttcttgtttaggagtggcagctccatggcatgtgactgagctgtccttgttgtgcccactggcagactttattgatcatgatgtttttttctggtgtactctgcttcagcattttctcaaaaatgatcttctgagcttgcagttccccgaccttgctgcccagtgcaaacacctggggacctctaaagacttctgaagcctggctttcactctggggtccttgttatggaatgtgacctgggcattgggagttttcagattctcccgggtgattctaacagcagtttgggaccagcaatcttggcatcacttccagtcagctgaagttgatgttgcagtggagactgatttgatttgcaatccttattccagccaatgccagccaagaagtatgtgccatcacctacatttaagtagctgtttaagactggagtggtgtttattttttatttttttaattttgttattttttttgagacagtctcactctgttgcccaggctggagtgcggtggctcaatctcggctcactaaaacctccgcctcccaggttcaggtgattctccttcctcagcctcctgagtagctgcaattacagatatgtgtcaccacacccggctaatttttgtatttttagtagagatggggtttcatcatgttggccaggttggtctcaaactcctgatctcaagtgattcgccttcctcggcctcccaaagtgctgggattacaggcatgagccactgcgtctggcctagagtggagtagtgtttaatccttacctgtaaagatttatggcatttgaagcatatgtgctcaatctaatgctttaaaactaaatgaatttctttcattcacttcctagcaagagtgccagccatggcttctctctctcactgccttgcctgtgttctggcataccctgggagcaaactggaagtggaagtctggggaagagggacttaggtgctagattgctatgtctgctcatcatatattgacccggcagttgccacctgatgaagtgtggttggcagaatgaaactgccactgacatctgctagctaattcagatgatgagtaaggtacctccaggctttcccctgttctgtttgtagtgcagtggtgtacatatgtctgtacatgtccctaagagactcagagacaggagctggccacttgctgattgccactagagctgtggcatcattgtgagacttcatttccatcccacggggtctctttcaacaccatcctgtaaagaatgatgaagtaaccagtggctgaaactgttcccaaggaaaccatgagaccctgaatgtagtacttgtcaaattctgtgtgtagtcatgatccgaggaagagcgcctatccagtgtttgtttttctttcattcagtaaacatttactgaggtgcagcctcagccacaggcaaggcactgagctctgcctccttgactaagtcctcaccctgccctcagccattcccaccaggtgcaccgtggatgaaaggaagcacaagacgagttttgacacagtgcttcaggaaccttgtcttactttgttcaggctgccgtcccaaaacacaataagctgagtgacttataaataacagatttgtttctcacagttctggagattgggaagttctagatgaaagcactagcagcttcagtgtctggcgagggcttgttccccacagatggtgccttgttgctgagtcctcacatggcagcaggggtgagggatctccccagggtttctcttaggagctaatcacctcctaacatcatcacattgtggtttcgagtttcaacataggaattttggggtcacacaaacattgtctatagtaaacctcataactatatccacattacaatcccatgtctcagaagttttcagcactgatatgatagtcacagatgtctcccttgataggttaatggttcatgctaggggcagggccatggtcactgttcttatcggttgcgtttgttagtgataggcaactgagagggacttcatgctaagaaagatgcttagtttgggagtcacctggacagaatgcaggtaaagaagcaaattggggctgggcatagtgactcatgcctgtgatcctagcactgtgggagaccaaggaacgtggatcacttgagcctaggagtttgagcaacatagtgagaccctatctctatttaaaaaaaaaaaaaagaagcagcagcaaatttgggagaaaagataatggatgctaagttcagttttgctcatagagttggggtcacctaggcctctggctgaaaaggaggaccttgagctctggagagagctgggtaggcactcagataatggaagacattataggaggtgatggtggcagtgtttttgcatcagagatccacatggcaataaacttcggagaatcagtctataaggcacatctagatctaggaatactggttttgagaactccttttctgaaaatatacgtaaatgattttactgtttcctaggaaatgagaacagaagccattgccagacctctggaaataaacgagactgaaaaagtgatgagaattgcaataaaagagattttggtaagatgactttgcttttatataatgttttttatgcctgggattcaaaaatactgatttcttgcccatacaagacagaacaagctaggcttagtaacaagggatgtgttagtggggaaatgaaaaactcaagaggacattcgagcttacctaggtcacttactatcatttttttcccctcgttataaataaaaacagcttctcatgttattaaaaattgatcagtttcagtaatttgataattatcagttattcaataattttaataaataatgctctattttattttgtttaaccaattcctcactgcttagtatttaaatgatttcagggttttctaaattccagacagcactgtaataagtagaaggatcactattgtttactgctcgctcacatcagttatcctctcatctaaagcagtcagttggaaggcagatcatgagggtgactctagactcagattgcttgggtttgaattccactgtgtgatattaggcaagttacttaccctctctgtgcctcattttcctcatctgtaaaatggcaagaactgcattcccaactgtgtggggtccttataaacatgaatcacgacagggcatatcaagcctcgtctctgatgcacaattgataatcagtcatcactggtgatttattttactcagtagacacggatgagggcccctgtgtacattcagagtaggcataaaacaagaatttgctatgagttgtacaaaattctaaaaatcataggtttttaaaaatatgtaattcttttgtcattaaacagtaatacctgctgggcagcccagcctagggagtcagagcctcacagcgggagaagggcaccacagccctggtgggagattggtgacagataggcagatgggtcagataagtaaaaatatggcaaggataatggagccacgttcctcactgttggagaaaaaagtcacaaaaatgtcacaaaaatggaaagagagaaaattagggtgaacttgaaattggaggtgttggttaaacgcatagttttcaatatatagataggtataggaataaattttgatatacatgtatgcacatttaaggaattacgtatatatgtatataaatgttttatttatatacatacacgtagagacacccacactcatacatttcttagctctgagcacacgtagcacctggcttaatgccattctccactaaaaggaaccaggactcttaggggaaaatggctaattccagagttgggcaggagaagtacgagaaagtaaggaagagttcaaaggaggaaagggaactattggaagcatgcagaagccaacttaagtgggcttctcctggccaaagtaaggacaacttaagcatcaaaataaataagttagaataattaattttatggtataatagaatgaaataggaaaccatgagttttcactggcataaaaaaataaatgaatattggaggctgaggaggagcaggtcattcacacagattcgaagtaactttccacaaagtactttttttttcttttttttttttttgagacggagtcttgctctgttgcccaggctggagtacagtggcacaacctcggctcattgcaacctctgcctcccaggttcaagtgattctcctgagtagctgggattactggcgcacaccactacacccagctaattattgtatttttgttttattttatttatttatttgtttatttttttagacgaagtcttgctatgtcacccaggctgaagtgcagtagcgccatctcagctcactgcaatctctgcctcctgggttcgagcaattctcgtgcctcaacctcccaaatagctggaagtacaggcatgcgccaccacgcccagctaatttttgtttttttttttagtagagatggagttttgccatgtttggccaggcttgtctcaaactcctgacttcaggtgatccgcccgccttgacctctcaaagtgctgggattacaggcatgaggcattgtgcctggcccgcagagtacttattaattacagaggggaaaagagtcacttctcagggagaagcctgccagtcacccccttaatcaagagatcaaagtgaacatcatcgttacagaacaaatcaaaatcatgcacgcctggtaggatgcagtcacttctgagtattcctgccaacgatgcatatctgactctaatgagacaaagccggattgaggggcattctacagattaaccagcctgtatgctcccagagtgaaaaggttctgaaagtcaaggaaagctgagggggcatttcagactgagggaggctgtggagatgtgataactggacacataggcagctcctatctgctgttggggacttcactgggacaagtggggacagtggagtggggctggagttagacggtggtagtgtgttagtgctggcttcctgttttgatgattgtattgtggggatgtaggagaaagtccttatttgtaggaaatacacgctaaagtattcagggtattggaacgtctggtcagcaacttactgtcacctaggttgggaaaaacgctttgtgttgtacaacaggttttccgtaaatttttgattgtttctaaatttaaaaattaaaaaaaaattattatacctcttatccttgccagtgttctaactgaatcaggtgaacacggcatgaatgtgcccttagcactaatatgttaaaagtagaacacccaagagaggacagggttcatttcttggtagacatctcttaagactcctttcattgttagaaaatatctgtgatgtttgatcattctaaaaacaaccaaaacaacatgggtacttaaaagggtttggggagtacaggccatttatttcagaaaccagggaaaattgcttgtgtttacacagctgttttgcattgtggatctttcttgtttgaggaacagatatgtttaaggtgggataaatttactaggttttaatctgactttggttcgaggaaacagttgccattaactgaagttgtttagaaaggagacccacctttcttcctgtgagggtgaactcgcatttctcctgggggctctaaggcacttgcagcaaatcgatgataagggtctgattattttcatgaaagtatcttagaagtggctagtgtacttagaccaaaaaaattagaccataaacgcattgtcagtaacagtggctggttccaaaacacaccatgcctgagagttgtggagagtgtctgggcttcgtaggccatttctctgtggagcccatagcttttcagagacttgcaggaaaacagagtaaccccttcgtgggatgctacacataggcaaagagctggaggggaagccccaccttggccaccaggaacttaatgcagggctggaaagccagaaccctggggggcagttccacgctcagctgggtggcagtccagattcctcataaagagattggagcctgaaccccaggcatgtgatccagccagccaccggacaagacgcatgtgaagacggcgcactaccagtgactctacctgcttcaaatgaaccttctcttaggatagggagacttgtgtcaccgtcagtgggcccgtgtcccccttcccttctttactcagcctctgttgcccaagggcctctgtccaactgttgccctggaccccttccagagctggtgcacaccagtgtggccattgccactgtgggaactgctttcgtactgtcttcagagtggtttctcctcgtttttagtctgtagtcaagcttctgttgccagggagagggaagaggaccttctctcaatcccagcaggcagtgggttagggctgggaccagctgtttctttctctcccctcctagtagagcagtacttggtgtgtgtgggtattctgtaagtcgggtgtttgtaactaggggcatggcccgaatgataaaaaggcagactgaccgtccagagtgatgtgcaccttgttctaaccgagtgagccagagaaaagactgcaggcctctccaccttgaccaggacactcttctttgcatcttcacttctttccctgggtagaaatgcctgcttttcatggggaaaaaaaaagagatacctttttctggacctgtgtgacattctccctggaactagtgggttaagtgagtcattgcttggggaagtgtctatttgtttgcttttgtgtttgttgagcataatgttgctatgcctgaagagttgcaaaattcttctaagaattaggatggctgtttttattgccaccttgtctcattatttcccattaaatatagacacaggttcagaagactaaagacctgctcaataatgtggcctctgatgaagctaatttagaagccaaaatcgaaaagagaaaattagaactggaaagaaatcggaagcgactagagactctgcagagtgtcaggtagatatgaacacttggagaatgagtagaaagatgtcctggaaagttcaaacaaactgggcgtggtggctcatgtctgaaatctcagctactcatgaagctggggcggggggttctcttgagcccaggagtttgagaccagcctgggcagcataatgaaaccccatctctaaaaatttttaaaaattacctcagtatggtgatacacacctgtagtcccagctacttgggaggctgaggcgggaggattgcttgagcccaggaggttgaggctgcagtgagctatggttgcatcactgcactccagcctgagccacagaacaaggccgagtaacagaacaaggccctgactctaaaagaaaaaaaaagttagaacaaagacttaagagaatagaatgtgatcttaactcttctcaagcaatgaaaaaaagccttacataagggtatcttcacctcaaatgtacatgtgttgcctgtcataacaagcagatggctaaactcattctctttactgcttgcggtatgtctggaaaactgcttaaagcttgaactgccctttaagcttttatagcttcttggaactcaaggcagagtaagtgaatccagacggggaaatccagacgtggtctcctaagatcttgccataaattaggtagaaacagaaacatactcctgcctgtttgttggcatagattttagactttatttaaaccttgatcattcctcaccagtcagtaattcatctttcttcctacgttacctcattggaaatatatttcccaggaataccgatggagaatagtggtgccggctctctctctcttctcttcctcgttctgtgcctctttccctcccccatgcttctgctctttctcccttttcattcaccctttatttttctttcttcttggctccctcctcttcccagctgcctactctgctcggatgttttgcctttttggatgttggtggctggctacaccctgcccactgtcccgaggtctgtggggaggcagcacctggaggcagcgacagcaaccacagggagcgccctggctcctccctgcccagcgcaaggccaaggcccttcccctcctgaaactggctctttacctctggagcctcagagagggaaaaaaaaaaaaacagaagtcattgccgccatatagattgatctccttgacacattccacttttaaagcatcaattcatttttgttaagctccaaatcattttaacagaaaagtctctttgttttgctctagttcaaaagattataattatttctgagtttatctgcttatatttttaaaagagtagaattttccctttaaggtcaataataagaaaaaagaaaaagttcagcaaaccagtatagatttttatggttttttttgtttttgttttttttttttgagttggagtttcgctcttgttgccgaggctggagtgcaatggcgcgatcccggctcactgcaaactctgcctcccggattcaagcgattctcctgcctcagcctctcaagtagctgggattacaggcggccgccaccacgcccagctaatttttgtatttttagtagagacggagtttcaccatgttggccaggctggtcttgaactcctgaccttgtgatccacctgccttggcctcccaaagtgctgggattacaggcatgagtcatcatcacgcctggcctttttaaaaaattttttatcgtttaaaaacctctttagactgggcacagtgattcacgtctataatcccagcactttgagaggccaaggcgggcagatcgcttgaactcaggggttcaagaccagcctgggcaatatggcgaaaccccatctctacaaaaaaaaaatataaaaaatagctgggcatagtggcacatgtctgtagtcccagctacttgggggcctgagacaggaggatcacctgagcccaggcgttcgatgctgcagtaagccatgatcacaccactgcactgtagcctgggtgacaaagtgagaccctgtctcaacaaacaaaaaaaaaccaccagccttaattcgtaacaacctgtggtcccctttttagaggattgctttaaatttataatatcctgacagtagaacattattattattattattatttcttttgagatggagtctctctgtgttgcctaggctggagtgcagtggcgcaatctcggctcactgcaacctccacctcccaggttcaagcagttctcctgcctcagccacccgagtagctgggattacaggcatgtgccaccacgcctggctaatgtttgtatttttagtagagacgaggtttcaccatgttggccaggctggtctgaaactcctgacctcagttgatccacccgcctcagtctcccaaagtgctgggattacaggcgtgcgccaccgcacccggccaacagtagaacattatacccaaataagataataatatatatatttattgatttggagagatgtgtctggtatgtgatttttttgcctttagagatggggtctcaatgtgtcacccaggctggagggctggagtgccacggcaaggtcagaggatcctcactcactgcagccttgaactccagggctcaatcctcctcctacttcagcctcccaaagtgctagggttacaggtgtgagccgatgcacccagcctgatcatttttaactctattgagattacggtatattgaaatgaaataaagattataaaatttcttggtatatttaattttttttttaaatgcattcctatctatatttatgcatagaaaagtctggaaggatgtatgtcaactatcaagcgcttatacctggtgatgggattatcagtaatttttacgtcattcttcatactttcaggattatttcaagtttttacaaagagcacatcttatttatgatgaaaaagaagtatgttcattttggggggagaaagcagaaaagggaaaatatttttaagcattacaagaatgaaggaccttctctaattaagggtttccagagaaagccaccatggaatctgaaactgtgaatacccatttcaaactactgcatataattcacctttcctttttatttcatttgcttcttttaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggtgagctgagcctgtcctctgttcagccattccttctggtgtgttattttgtactgggtgacaggtcattttgttaatatcattgtgaaaaaaatatcagtacatgttttttctccctggtcagtctgaggattgctcatgtaatgtgtttgttttgctggcagtgtacactggactccagggttgtcaaatctttgatgtcatatttcatcaggtttggtcagttaagagaacagacagggccgacatgaggcctgtgtggctgcgtaagaccctgtgccgacatggggcctgtgcttgctttcaggccctgttgtcactgtcttgaaattcataataatttttaagtgcattttattttccactgatcccaaaaattatgtagctggtctcgagtgcagatttaaaagcttgcttggctttgggaggccaagacgagcggatcacttgaggtcaggagtttgagaccagcctggccaacatggtgaaacccctcctctcataaaaatacaaaaaattagccgggtgtggtcgtacacacctgtagtcccagctactcggcaggctgagacaggagaatcgtttgaacatgggaggaagaggttgcagtgagccaagatcgtgccactgtactccagcctggacaacagagcaagatcccatctccaaaaataagaaaataaagcttgcttagtcagttcacataaagattttcaaggcaaggtgcgatggcttatacttgtaatcccagcactttgggaggcttaggcaggaggatcactggagcccaggagtctgagaccagtttgggcagcataatgagaccctgtctctacaaagaagtaaaaataaattagctggacatggtgttacacacctgttgtctcagctacttgggaggctgagatggaaggattgcttgagcctgggagtttgaagttggagtgagccatgatcatgccactgcactccagctcggttgacagagcaagaccctgtctcaaaaagaaaaaaaaaaagggccgggcgcggtggctcacgcctgtaatcccagcactttgggaggccacagctggtggaccacgaggtcaggagtttgaaatcagcttgtccaacatggtgaaaccccgtctactaaaaatacaaaatttatctggtatggtggcgggcacctgtaatcccagctacttgggaggctaaggcaggagaattgcttgaacccaggaggcagaggttgcagtgagccgagattgcgccactgcactctagcctgggcgacagagcaagacaccatctcaaaaaaaaaaaaaaaaaaaaaaaaagaaagagattttcaagtcctggttaattgaatcaccagaatagctcattggagattgttttgtaaagaggaatggcagtttatttattgattgtgggaaataaatgtgtggccttgagcctgaccaaccatcttacaggttcctctcatccctgtgggtaaggccatttaggaaaagagtgttttagacccgagcatgagttgataaatgtggaatttagagcaaaggaaattgaaccaagttgtgatcagtttttgaattgccctatccttaacctgagaatggtcatttagactccattttcatgatgaaattggtctgcagtctccctttctcatgcccttgacagcttttggtattaaggttatgctaggcttcttacaatactgagcatttgagtttggcagagctattttgttgtccaggagggctaactgggagtacctaacgcatccgtgtggacacatgtcatcttgacgaggaattcattgctagcattactctgtggcagaggcaggccatggagaaatggtacgggacaggcacatttcgagggcactagaaagagcttggagtttagaacattttaaacattgggtacctgggaaagaacagtcaagggcagtgaaaagaaacgttggccatttttttgtattatctggggccacctctgggttcagagaacaaaccaaacagtatgcctcagagtggcaggtaggtggcccaggaaacttcccagggagcccctctaccctacccttccttcaacaagtacatctctttttctcttactcactctcgctctctgtcgttagaatacctgttccctcgaaataccccatgccggaaacacagtgctttatttttaatgtttagaacaacaatatataaagccaacttcctccctctgtctgtccctcccccccactctctctctttgtctctttctctttctcaacggggtctcactctgttgcctgccactctgtctggagggcagggtgtgattataactcactgtagcttcagacctcttgggctcaagcgatcctcccacctcagcttcttgagtagctgggactataggcacttgccaccatacctggctaaattttttaaatttgttgtagagatgaggtttccctatgttgcccaggctggtctcaaactcctgggctcaagtgatcctcctgccttggcctcccaaagcgtgggggttacaggtgtgagccaccacgcccagcccccattctctttcttgataataatcaaggccacattttatgatctgagatatttcctcctgtccccacccctgttcccatccttacctgtcccaccatttagcatcttttgagctggaatctgaaggcagggcaggaaagataaatgataaaatctatactttcttcctttgaaagcaggaggcctgtctctgccctaaaattagatgtgtctgttctgtgtccccaggtcatacaggcatgcgtgatgggcatttagttctcctcagaggcagggaaatgcaatcggagaagcatggggtggggcagctgcttcactctgggcgcccctgtccaccaggccacgaggcaaccgcagagagaaagggcagtaagtttcaggaccctggagttgctcaggcagtgttaattctcttccccttccttgagtttagctctttttttgttctgtagcacaaacttagcagtccttacacagtggtgaagaagaatagaacagtccagaaaagggccatctctcctgagtctgtatttcctcttccacaggaagctaaaaacactctctgcctgatacagaacaagctcaaggaggaagagaagcgcctgctcaagagtggaagtaaggctgggcttcgtagacgagcagtttactctggactagtattttcagccttgaaatatatatagagagatatatatatattttttaatatgtattttcttctttttttcagcagttttttttttactgtagtaagaacacttcactttacatcttcaattttgaaaagtataataaattattgttgactataggtacaaaaatattttcaaaaggcggttttctcacaacttctatattgggtaccattgtattcactcaagagtctggtttaaatatagcatttaaaacacatttcgttcttgtgccagttaagatagtgttttcccctgtttaaatgatagtttgaattatatatgatgcgtaactataagaaaacatggccctagatgtgtgtagggttctgtattttcaggctgaatgatggaaagcaagcactgggatgcagtgcagggagaggggccgctcgctttgtgatggtccccatgctgctgagatgccccccataatccagaatggctcagcaagacactcagctggagagacacagggttacgtccatgcaaagcctagattccgggaaggagctctctgtgaccaggcagcttcccttatccttgtgtgggcggcaagccgcccaggtgccgaggcaagagaccgagagcacgagctgttccagtataataaaatatataaaataagaatagttatactagatatagatcatagatatgattatatatgaatatcattaatcattagtttatagcaattactctttattccaatatcataataatcctcgctctacaatcataacctaggaaaaaacaggccatacagatataggagctgaggggacatggtgagaagtgaccagaagacaagagtgcaaaccttctgttatgcccagacagggccaccagagggctccttggtctagtgggaacaccagcgtctgggaagccgcccgttgccaagtggaccgtggtctagtggtagcgtcagtgtcaaggaaaaacacctgctacttagcagaccaggaaagggagtctccctttccccgggggagtttagagaagactttactcctccacctcttgtggagggcctgacatcagtcaggcccgcccgcagttatccggaggcctaaccatctcccggtgatactgtgcttcagtggtcatgctcctagtctgccttcatgttctgtcctgtacacctggctctgccttttagatagtagtagcaaattagtggaagtactaaaagtctctgataagcagaaataatggcgtaagctgtctctctctcctctctgtctctctgcctcagctgccaggcagggaagggccccctgtccagtggatacgtgacccatgtgaccttacctatcactgaagatggctcactctccttaccctgcccctttgtcttgtatccaataaatatcagcacagcctggcattcagggccactatcagtctccacgtcttcgtggtagtggtcccccaagcccggctgtcttttcttttatctctttgtcttgtgtctttatttctacagtctctcatctctgcacatggggagaaaacccaccgaccctgtggggctgtaccctacatccctgaacttcagtgtcaagtcactgtcagggaccggtagcagcccaggatcttcctgctgaattgatggccttgttgcacggagttcctcctcctcttgctggttgccctttcttttcttcagggtgaaatattctattcactctcatgttgagggcagcatacttgaggcatcaggcccacacacatgctcccacacacactctctctctctctctttctctttctttgccatttcccttgtatctctctcattttgcacctgttctgtgactctctcgtctgaatctcaggaaactttggaggaaggatagggactgctgggaaatcctccaggaacaaggttaggaaatttgaagggcctgtctagccaaagcagccctcccctttttagttccatgtcagccaggagcatgtgaagcagccctcagtgatcagcctgcatggggtttgtcccttgcgagaggcccagctcagctaggagccctggtttgttgcttgcatcccatgctgtccccgggccaggatgctaagacctgccattctgatcttgctttattcaccaagatttacctttgtgttttcttctaggagttctatagttttagctcttacatttaggtctctgatccactttgagttaatttttgtatatggtgtgagacagggggtccaacttcattcttttgcatgtggctattcggttgtcctattatcatttgtggaaaagactattatttccccattgagttatactcgcatgttgtcagccattaattttaattgtcactgtcagctcagtggtttcagtgtcagcatgcattaatgtcttagtctgttttgtgctgctgtaacagaatacctgagactgggtaattatatattttacataaaatatatacagcattgtatatatggatacatgcagtcatccctcaatatctgcgaagaactggtgccagaacccacctgtggataccaaaatccacagatgttcaagtccttttcatgtaacctatgcacatcctcccatatactttaagtcatctctagattacataaaatacctaacataatgcctatacatcacttcattcacatggattcaacatagtacttggtatgtggcaaattcaagttttgctttttggaactttgtagatcttttttgaactttgtagattttttttccaaataattcagatccatggttggctgaacccatggatgtgaaatccatggatacagagggccagttttgtatgtgtgtgtgtgtgtgtgtagtttatatatatatgtcatatatattattatatataatatatattatattatatattattatatataatatatattatattatatattatataattatattatattatatatattatataattatatattattatatgttatatattattatatattatatattattatatattatatattatataatattatatattattatatattatatattatataatattatatattatatattattatatattatatattattatatattatatattattatatattatatattattatatattatatattatatattatataatattatatattatatatattattatatattatatattatataatatatattatattattatatattatataatatatattatattattatatatatattataatataatatattatataatatattatataatatatattttataatataatttataatttataaatttatatttataattatatatgttatatagttatatattattatatataataatatatgacaattatataacatatataatatattagtattaggttatattattatcattataatcagaaacttacttgtctgaaatttaatgagccacagttctaggagcaagcccaagatcaaggagctgcatcttgccgcaccatcccatggcagaagggcaaagagagggcgagagagagcaagagatcaaactcacagcctcaagcccttttataaccagcattaatccattcttcaaggcggagccctcatgacctaaacacctcccagtatgccccacctcccaacactgttgcattgggatttaagtttccaacacaggcttttcggagacacattgaaatcatataatagcaattgactttagtttacctgctcacttctcaggtctgtattggtttgagttgtaagaagaaatcttattgagcctgaggtacatgtattaattttattttaaaattgattatataatttgatttgcattgcatgggataaggatttaatgtcttaatttcctggatagaataagaaatgaacaaatgacttttgcacacagaccttactgggcagagctgtttcgttgtgatcatgaagccactcctttgttttgcctgcttgtgttcctgctaggtaacgatgactcggacatagacatccaggaggacgatgaatccgacagtgagttggaagaaaggcggctgcccaagccacagacagccatggagatgctcatgcaaggtaccccggcgtctttcgctggacttcctccctgcgccctgtttcacagaacacctggccaggactggggcaggctgcttagtattgaggcccacaagcgtgctgcgaatggcccctagaagcagctcttgctcaggtttatcctgtcctgttgtttatggctcttgaactgctcagtggtcatgtttgctccttgtctgtgatcccaagactggatggttcatatttatggcttggtatttctcacagccacaagaacacattgcctctgccactctcagtgcagtgatatacttaatagcctgagaattaatgcagaaagggacttaaatgagcatctctgccttaaaaaaagttcttctaattcctttactcatcacaaaagattcaagcaacaaagctcagcgcagtggtgcacaccttattcccagctactcaggaggctgaggcagaaggatcatttgagcctaggagctcggagctgtagtatgtgatgattgtgtccgtgaatatccactgcattccggcccgggcaacatagaggggctcttaaaactaagttaagccaggcgcggtggctcacgcctgtaatcccagcactttgggaggccaaggcgggtggatcacgaggtcaagagatcgagaccatcctggctaacacggtgaaaccccgtctctactaaaaataaaaaaaaaattagttgggcgcaatggcgggcgcccatagtcccagctactcgggaggctgagacaggagaatggtgtgaacccaggaggcggagcttgcagtgagccgagatcacgccactgcactccagcctgggcgacagagtgagactccgtctcaaaaaaaaaaaaagagttaaaacaaaaaaagactcaggcaacaaaatttgtagagcaaatgtgaattctctcctggggtcttcctcatgtcccactcccacctgggagggctcatggctagtggccagggtgggtgtgtctttacagattacctttctgtacatatacatacgcacacacatacacatacaaagatcacctgaaaaaaatttaacctgagtgcaaccagacggtatgtatggttctgcaacttgcttttgtttttaaaaattaagtacaattggaactcttcctctgtcagcaatagatctgccccctaattttttttttttttctttttgagacaaagtctcgctcttggtccccaggttggagtgcaatggcatgatcttggctcactgcaacctctgcttcccggagggagcaattctcctgcaatcccaagtagctggggttacaggcccgtgccaccacacccagctaatttttgtatttttagtagagacggggtttcaccatgttggccaggctggtctcgaactcccaacctcaggtgatccacccgcctcggcctcccaaagtgctgggattacaggcctgagccaccactcctggcctgccccctactttttaatggctatgtcatattcctagcaggactgtacccatgatttactgggcgttctcgcattgatatttcccctcttttccttgtatatacatctttctgcatgtctgcatatctttaggttgcatcattaaaagtcaaattcttaggtcaaaggttccataaatttttattttaatactataaaattctcctatatttgcctttaaaaacatttcttatctaccacctgttaatgtttggagcacagttgcttttttttttttttttttttttttttttggagacagaatctcattctgtcgttcacgctagagtgcagtggcacgatctcagctcactgcaacctctgcttcctggtttcaagcgagtctcctgcctcagcctcccgagtagctgagactacaggtgtgaaccaccatacctggctaatgtttaaaaaaatttctgtagaaatgaggtttcattatgttgcccaggctggcctcaaactcctggcctcctgtctcagcctcccaaattcctgggattatacgcaaaagccaacatgcctggccagaaaacaaatcttgaatgctatttcctgctttattttccaagatttttatgacttcttcatgcttttgttgttctcaggaagacctggcaaacgcattgtgggcacgatgcaaggtggagactccgatgacaatgtaagtcccccgctcccctcagtggttctgtgcactctgggtttggctgtccccatagatgggagtggctgagttgctgtcagcagccagggagccgtctatggtcagcccggccgtgcctcgatgcgtggcagggtttggcctcatgaggctctggactcttcgttgctcgtggatggctcatctcttttcaagtgaatgtgcttgctctgctttttttgccttctcactgttctttccattctcgctttccaaagatggaagcagcaccagctctcttaggtaaatgcaagacttccagctccaagaagcaggttggttttctgttctgcctcatgtgtttgtgggtgtctgtcagccctcccggggccagccaggggcctctccctaggagtgatgcttcctctctcctgggcaaaaaggccactcaaaagagatcctgtggtgacagcgggatcactgaaggcccctgtgctaaagtggaggcgcaggcacggagcctggaggcggggaaagctcaggccgggccatcctcaggccctgggccgccacctagaaatgaaggaggacgccgagggccgggctcaggaccaacccccctccctgttctgtgctggggacggaatggtgaagcagcactgtccccagaccaggccctcgaggtgccaggcatgaggctgagacataagctgccttgagctttactgagtggataactccctggagcacttaagcaaaaggggattctaggggtcctcagtgaggtccagtcatcagggctctgccgcccattgctcaagcctacgttctttgttgcgtccctggcagtgctgctcggcccacacagcaaagggcgactcaacagagactgaccccaggctgcctccatgtgccctgaatttacagggcacagtctgtagagaagcagagagagcaactggaaaataattttcctaacaagctcgggtgtggatggtatacagcgtctctccgtcttgcccacccaagacagaagcagagggagtgtggcgtgggtgctggcaatgctgaggcagcaccgcctgcctcttctccagggtttgccttctctctcctcagagcgaatgcattagtcgcagctgagctttatgcctggtggtcacttgtttatttcaaggaggctgtgtccatgccgccctccaggcacagggttccatgctttacgtgttcaggcatccaacacgtgtctgttgagtgcctgccacatgccagtgctgtcgtggattatggggaacgcagcaggggcagaggcaagcccctgcttcatggctcacaccccagcaataatgatggattgtcggatcagggctcatggtgttaacaggaggaataacagcttcaggggacagggagtgacagggaacaaggagggggtggcgtcttctgcgaggtcagtgaaggcccctgacgtggtggtgtttgagcagggcctgagtggagggagcgagcgcatgggttggcggcacctgggcatgtggaatgcactcctcgcatcgaggagcagaggcagctggtgtgattgtgggtgagtgcgagaggcagcaggggccatgcagagctttgcagggtgagatgaagactctgttttctctgagtgtgaggggaaggccctgaagaatcatgagcccagaagggtcaagagctgatgatccctgtttgagagaagccagttaggaggcgcctgcacccgtggaggtcagaggtgacggtgcttggccgaaggtgtggcagcagaggtgttgagaaatggtcaggtcctgggtctctctaagaaccatcaggttttgtgaattgattggacataggctgttagagaaagagaaaaatgagggtgcctgggcttggtctaatcagcagaaagcagagtttcattttctgagatggggccgacttgacaaaggggcttggaaggcagatcgaaagtttgattttggacattctgaatgtgacagccacatgctagggttgagtagccaggtggaatttaagtctggagttcaagggccacgtctgggctagagattgaattttgggagccacccttatttggttggtatctaagccacaaggatagatgtgactgcctagggagagcaagtagaatgagaagagaggcgacccaaggtcctgagctgcatctgccctgcagaggtccgggaggaaggggcaggcagaggaggctgaggggcgtcagcagtgaggaagggggacctggactagagaaggggccctgggggatggagaagatgggttttaaggatgaaggggtgattccacagctcaagcaggatgaggcctgagaatcgatcccagtccgttgaatgtttccttcttgacaggagcagtgctggggtcagtaggtgagagcccgggggaactgaagcagtcgtgaggggcacaggtgtggacagtgagttcaacgactcgctcaggagctttgtgtgaggggagagagacagggcagagcagctggagaggaaggtgggattacctttggggttttttttcaagaaggaaattacagcatgagtgtgcaccgacaggaatgatctagatagaacgaccagccatcctggtttacatgggacgcaggaactgccgttttaaagctgggctgagttggtcaccctggagccctggatccgatgaggagagagagggtgtgtctttcactttgctccctttttttcttttttttcttttttttttgagatggagtcttgctttggagtgcagtggtgcaatctcggctcactgcacctctgcctcccaggttcaagcgattcttctgcctcagtctccggagtagctgggattcactttgctccttataccaatgtctatgttgctttccatccacaatctacaaaaagccaaaacaggcctcccttccctctctccaagcccctgtccttcttgccatctgtagggggagtctctaggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtctttaaaaaaaagaaaaagaaaagcacgctgcttgtaaaaagcgtacagtaggtcaggcgtggtggctcatgcctgtaatcctagcactttgagaggctgaggtgggtagatcacctgaggtcaggggtttgagaccagcctggccaacatggcgaaaccccacctctactaaaaatacaaaaattagccgggcgtggtagcgcatgcctgtaaccccagctactggggaggctgaggcaggagaatcgcttgaacctaggaggcggaggttgcagtgagccgagatggcgccactgcactccagcctgggcagcagagtgagactccatctcaaaaaaaaaaaaaaaaaaaaaagcatacagtaaataaaaaagcacaaaacagttttcacttattttacaattaaaaagtcagaagacttctgaagttacttatcttttaatacatgtatttaacaccatacttcatattattaaataggttttacttaaaaatataattattgtatttgtacctgtcagatataaatacttattcaggagttcacaggtacgaaaagatacacataaattttaggaacttttgagttatttctgtcatttttgcttttttctctttcttttcctaaattttatgtataagattacccctaaaaaaaaaaaaacagccagtattcagtgaattcaccagtaatttgaaatgcaccatattgtaaatgatccactgacagggaagccagcgtgttggagccatgccagccacctcagacaccgtggctctaagatgcggaagagtcactgcatcttcttgaatgttacagatttggtttgcctgaatgtgacttgacttctgttttgaaaaaacatacgaatagagttctattttccttatgtgatgctttcttctaacacactttaacacagaagcctaacctagctacaaagagcctatccacagacataggcaacagctccaaagggtatttcattgtgtcacctgcttctagatcatctgttagttaactgactttgtgcaaggtctcaccatgtatagcactgccttgcttgagcacggaagtttctgtcaacagcaagctttatgtgctctatcatttttattaaagtatttcagtcaatagtgacccattgtagaatggatgcaggattcacatgtgcaagtgctttgtgacctggcaccatttggttttggccaagcagcagagcagacctcaggacctaacgaggatggttgtgattaggtcaaatagaaaactagcaggccattgctgacaatttttactatataattagaggacttcctaaaatgctttaaaaaaaaatgtgtatggatggaaaatacaaaggaatttttcaaatactcaatttttattggtagtagttatcaagaacaaagtcctcggacttctgatgggaaatctgaactgctgtttctcttttagcgtacaagaagaaatagatccctctcattagcactttaatatcagtgtcacgtgtctggaaggaaattgtattcatttaggtaagcaacacactacataaatatcatagctgttagacccaggggactctcaggtgccagaattggggactcctttaattggaagggagctaaagggtctacctcctacctagaagtcctttctatgtggatatgaattaaattctcttgtctgttttgctctgatggggtctgtgtgggctagctggctctggtgtgtgcctgacgacagactgaactccttaaccatttcagacagcttgaagatgtatgatcattatttgaaaagggagagagggaggactctttgttttctccaccagtttggctcctgaggtttcttcagcgttaggtttctgtagggcccagctttctccagtgtttggctactgcaactctgtgttctgccagtctcttaactcagacagaaacaatgcaaaccagcagacagagcatcaccttgaaagtactaaaacagctgtcaatctagaaatctctgccccgcaaaaactgtcataaatactgcaagacccatgttcagatttccccccttttacaaataatgttttgttttatttcccagctactacaagtgatccaaatgttctttatagcagactttttcctgcagtctaggatccagtcagagatcttgcattaaattatatctctgtaatctttaatttcacgctatctgcaatgttttgtgtttttcatgacattgatgtttttgatgaggtcaggccatttattctgcagaatatctgtcaatttggattttttctaattgttctttcatgattagaatcaggcaaacattttttgacaagaatacatcagagacgactccgtggtgcatcagactgggggcatgtgatgtctgtgtgtcccattattggcgatgttcaattctgtcacttctgttgaggctgcatttgccagatttcagattaaggtacctttttccctttgtaaattaggatatcacctttgtggggtgccgttttgagactgcaaggatatcatcttcccgagtaggccttcatccatggcctcagcatccatgatggttcctgtccggatgctcacttttgaagaaacatttcaaataatagtgattcctttccaattcaaaagtaatcattgctttatagtcttcataaatattttctgtggttatttagttgatgaaagctgttgatgtccatttggatttttttccctccaacacaaacagctgcaggaattggtgccacatagaggctcagcttgcctgtctccatggaagctgtggccacagcagtggctttggaagcctagtaaggaatgacatcactgccaggtgcagtggctcacacctgtaatcccagcactttgggaggctgaggtgggtggatcacttgaggtcaggagttaaagaccagcctgatcaacatggtgaaaccccatctctactaaaaatacaaaaattagctgggtgtggtggtgcgtgcctgtagacccaactacttgggaggccgaggcaggagaatcactggaacccatgaggtagagcctacagtgagctgagatcatgccactgcactccagcctgggtgacagattctgtctcaaaaataaataaagaatgacatcactgaatacactgaatgtgctattgataaccagtgtgccagactccagacaacatgtgccaggcatcacccatgtctttgattttgtaataaataaaaaatggggccaggtgtggtggctcatgcctgtaatcccagtactttgggaggcccaggctgatggatcacctgaggtcaggagttcgagaccagcctggccaacatgatgaaaccccgtctctactaaaactacaaaaattagccgggcatggtggcgggtgcctgtattcccagctactggggaggctgaggcaggagaatcacatgaacccgggaggcggaggttgcagggagctgagatcgtgccactgcactccagcctgggcgacaagagcgagactccatctcaaaaacaaacaaaaaaggcaaaatccttggagaactcttactgtctctgtttccagaatcctagaattaaaactttcatttatcttcacaattttcccatagctttttcatgtctgtaaggatgataccctgaaatcttcttcttgagaagataaagaagggtcccctctgttacccctaccaaacggatgctcctcacgggcttgaggtggcagctcatctcagagcatgggatgatttttaaccaggtgagtggaaaggggcagtaataaacatttttaaaggttggggacacatgaagtcctcagggtgtaaagctggaaccagcctcctgtactgctcagctttcaggcctttggcccctagtcccttgggggtggcccctcccttctctgtgccataacagagtacccgtcaccccctgcctggaccactcctgcagcagaagaggagctcacgacctcctccggcagcacctctccttcctccctgcagagcccggctctcgtgctgagcaagcagcgttcccagctcccagacaggccccccagaagtcggcctttctgttcaaaagcttccagctgagcatctgcccattctcctgatccgtccaccaggatcacatttcaacagtgcacgtgggagcatttgtcttgatggcctctgagatcatcctggccccggagtccccaatgtggtttccctggagactagaagagtagggttaaggcagggctcaaagcctgcaggttctctttagtagagcaggccatacaatagaaaatgcaggaccccatgcaaagcctttgtgcttctaggatcccctcgctacatggacaaggctcagggtacctccccttagaccaggtttccctataggcctgctgaagcgtctgggggtcagctggctctcagaactgggcaaaaggcagtgcgccacctggaagcagttctaagggtgagcaggaagggcaggtgcactcacttgatatgctggagcctgtggtttccagacagtgctgtggcaatgcatatcgccccgtccatccccagagaattctcttgaagactaagtggaaaagagatggagacacacggtgagccatcagggcagaaggaaaacacccggggaagcaacagtgcattgtctgggggcagtaacccaggcagatgtgtccacaggtgccatggcaactccaggtgggagttgaccctggagacaggtgtctacgagtggccagattgtcccacgcaagtgcgctggaggatgtaaggccataaatgcaagatgtgagtgacttctgactgaagctaagcacactcaacaaacccagctgcagtggaatgtggactataataagtctgattgtttatattcagaaggaaatagctacagaagaaatcaggagcattttattccatcagggaggacccagcagagaactctgctgctccaggatgcaggtaggtccctccagccacttacttgagtctccggagacttgagtttaccttcagagcatttgccagggctttggctccagccaccccaatggcatttcctcttaagctgttgggaaagacaggaagcctaaggcatgggtacaggctgagaggtgatactgacccctctgcgggtgggcttggggctgcttggtagaggaaacaaggacttcagcagtcacaggaggccagggctgtgccttcctcactccagggcaacagggcagagctggctctgggaagcagggcacacaggggcatggctggcctagccaggagggttgttggagccttcctcctcttccatttcaaacagaaaagcggggctgagacaggagaggcagccctccatctgggcaggtccccagtgctcccagcaagggcaggaattctgaggacatgcctgagcctcagagctgtaacctcaccccaggactttggatctgcccagagaacaagatcagcccccctgggacccataaaccaggcctctagacgtgttcagcctggcaaggccaacccggagaggagggcaaatgatagcgactcccagggaaaggcatgaagtggggctgggaaactggtatacttgcactgaaatgaagatcaccaggatgatttgtgagttgtctgtaaactttgtccccatatctattcattgagaattcattgatttctttgggctaaagaccatagatggagactggaatacttactcgagaatctccaaggttctgttcacagccaaggcttcccctagcacctgggcgcctgaagcaccaattgaggccacctggagactggggcggagagggtgccgtcagtgtgagccggctgggcccacctccctccgcatactccgttccctttcaccaccccttgactcaggatggaaagtggagaaacagcactgagaatggttggccagcgctgtgtctaggcactccatctcctacctacactgtctgttgcctaagacagagatctggatgctaaggagatgagaaatagaggctgtccctggaagggctcggggagaatgctccctgtacctcctcattactactctctaggtgtttgagcccccaactgctaatatcatatttcctatattaggaaaatcaaacacaccttccttgacttgtaaacaaaaataacgtccaggccaggtgtggtggctcacacctgtaatcccagcactttgggaggctgaggtgggcagatcacctgaagtcaggagtttgagaccagcctggccaatatggtgaaaccccgtctctactaaaaatacaaaaattaggctgggtgtggtggtgcacgcctgttatcccaactactgtatgggaggctgaggcttgagaatcacttgaacccaggaggtggaggttacagttagctgagattatgtcactgcactccagcctgggtggcagagcaagactcttgtctcgaggaaaaaaaaaaaaaaaaagacctctaacgtgaaaggatggcgaagggaccggtttcctgactgctgcgcacatctaggacttactagagagcagtgagggctgtgttgaccttcagtgcacgggccaccgcacacgctccgtcatccccgatggcgttctcctgtaaactagacacagagtatgacccctttgggtgcacggggcacagggagcattctagcaaggccctgccgcacttggacctgccaggtttaaccgactacacacaccatagacactcccagggtttcctggggataactgcccttcctccacaggccctgcagcccgccgcctcatactaagcacacagaggcgtctggggcctgcatgagtctgaaccgccagaggcaagcaggaaatgggacatatagagtgactgtcagcaggggcttgggacccaaaaggggatgcttttcacagccaaccagaaaatgaacttaaagccctcaatccctgagccattcttgtttgtcttgttttctcttgagacagggtctcactctgccacccaggctggaatgcagtggtgagatcacggctcactgcagcctcaacctcccaggctcaagcgatcctcccacctcagcctcccgaggagactaaagtacttaactagagacggggactacaggcacatgcccccatgcccggctaatgtttttattcttttatagagatggggtctcactatgttgctcaggctggtcctgaactcctgggctcaagcagtcctcccaccttggcatcccaaattgctggcattacaggcaggagccaccacgcccaacctccttggccattcttgctaattagggctttgtgtcattttttccccttctaagttggagggaactagcaggccctggtgcagtgagtgactgagtttagctcaagcgcacactggtatgttcaaggccaagagctgtttgcattcattattttaacagacatttgagtgtggccgggcgcagtggctcacacctttaatcccagcactttgggaggctgaggtgggtggatcacttgaggtcaggagttcgagaccagcctggccaacatggtgaaaccccgtctccactaaaaatacgaaaattaggctgggtgggtgtatttttagtagagacagggttctctgtctctactaaattagctgggagtggtggagggcacctgtagtcccagctactggggaggctgatgcaggagaatcacttgaacccaggaggtggaggttgcagtaagccgagatcccgccactgcactccagcctgggcgacagagttagactccgtctcaaaaaattaaaatgaaaaaaaaaataagaaagacaacatttgagtgtgtctcatgtgctaggtgttgtataaggcagcaggcctgagtccccctctcgaagctcaggtgggaagacatgattaaatgagcaggtacaacaggccaagtgcaggctgcagggaaaagcaagcagcatctcccaccccagggtgtcaacagaaggctcccagaagaaataggtcaaaacccgaacccaaagtggggagtgtgcctggctcagctaaggaacccaaacgaattgaattcctggggaagtgagaaatgagtccagggagggacaaaggaagcagattttaggggtcccagaagccaccctgaggggctgtgtgtactttactctgcaggccctgggcaaccattcaaggatggcacccaagatgggacagagctgctctggaaaggtctctggccagcagtgtgagaggatggactgaggtggaggctaccacagggatggaggtgagtggtgccgatggcctgggcaggggcagtggacgcagagggaatcgagtggatggcagggacacagaggggaccgacccaacaggacttgacaatgaataggaagcaggaggtgggtaggcacagtgcctcacacctgtaatcctaggactttgggaggccaaggtgggaggatcgcttgagcccaggagttcaagactagcctgggcaacatggtgaggccccatctctttaaaaaaaattgtaaatattactttaaaaaataagttatatgctggatgtggtggtttgcacctgtaatcccagcactttgggaggccaaggtggaaggatcacttaaaggtcaggagttcgagaccagcctgaccaacatagtgaaaccccgtctctattaaaaaaaaaaaaaaaagctgggcgtggtgttgggcacctgtaatcccagctactcgggaggctaaggcaggagaatcgcttggacctgggaggcagaggttgcagtgagccgagatcacgcctctgcactccagcctgggcaacagagcgagactccatctcaaaaataaaataaaagttatagaaaaggaagtgggaggtgagagtgaaggtcttgtttctagcttgcacagttggttccattcacaagatggggagccaagaagcaggttttcaggagagagaatgcagggaccctgcacccgagcaagatcccgaagggaggtacagagggggtgtggacgcgcaggtctagggttgaggagagagggctgggacacggacgtgggagtcgttgggactttgaagatcactggagcccagggaaaggaaaagagctccaggaaaagagacgccaggcaagcgaagatgacataggacgatccctgaggagccctgcgcagaagagccaaacagaagaaaagaggacgaggcccagacagaggggacatcctggaagctgaaggagaagaaatggtcagggagaaaggccgatgaggctccaagggttaaacctagagttccctcacgccccagcgactccactcccaggtatatccagccaggagaaggaaagctcacgtccacacagaaactggtgcacaaaggtccacagcagcaccgttcctaacagccaagtaggaacaacccaacgtccgtcagctgatgaatggagaaatgaaacctgtgtacccatacaatggatatcattcagccttacaaaggaactaagtattgagacaggctacaatgtggatgaaccttgaaaatctgacaccaaatgaaagacaccagccacaaaaggccacgtgtcgtatgattctatttttggccacgtatcgcacaattccatttatatgcggtgtccagggtaggaagatcatggagatggtagattagtggttgccagggttgggggaaagggagaatgggtagtgagtgctaacggggtgatggaaatgttgtaaaattgattgtgatgattgcatcaccgaatacactagaaaccagtgaattgtatactaagtgggtggatcttctggcgtgaagattatatctcaatcaagctgtcatatatctatgtatatatgtgtatgtacatatatgtatgtgtatatatgtatatgtgtatatatgtgtgtgtatatgtgtgtgtgtgtatgtatatatatgtgtgtatatatatatattttttaacagggtctcactctgtcgcccaggctggagtgcagtgacgcgatctctgctcactgcaacctgtgcctcctgagtttaagcgattctcctgcctcagcctcccgagtagctgggattacaggcatgtgccaccatgcccggctaatttttgtatttatagtagagatgggatttcgccatgttggccaggctcatcttgaactcctgacacctcagatgatccacatgcctcagcctcccaaagtgctgggattacaggcgtgagccaacgcacccggccaatatatttaaaaggcagacaaggactgaaacatgccagctggccttagggaagaggagtgccaggggtcactggattgagcctctgcctgatgggtaccaggttttcagattcccctgtcctcaacagcccccgccctgcagcccctgggcaggccaacttactctaagctggtgaggctcctgttgagctgtagtgcttgtcccagggcctgggcagcgccggcctggatgaagttccactgcaggctgggcagacacagacacatgtgactatgtgactatgtgactatgtggccctggggcagagccaaggaggctctgatggcaggaggtggaatccctgcaggatgtggcaggagaattcctgcaacccctgcccagacttagttctcagagggtcacatgtactccctggttagccgtggccagagggccggggaataagccagaaaagacacctccaaatggcctctgcctggaggcccagctgtgaccacctcttaacacatgtctgtctgtgggtcaggagagcacaggatggggcacagtctgctggcagcaggctagcccgggcagcccctgagacctttgcagggggtgtccccaaaccaggtgtggcctgtgcatcgttggtttgggtggagcccggcagctctgcagaaggggaacagagcagggtggagagctgcagactcactgaagggaggtgagggtgcggttttctctcactgccactgcgatggcccgggcaccctggtcgtggaggaggttggctgtcaggctaggaggaagggaacaggagcaagtgagccgggggccggctgtgaagcctccggtccttggtcaccagggattccagggcttgataccagatcacccagccagcacgagggggtgcttcctggggatacgttgcccaatggcatggtaacatcctcatccatccccaccaggtgaagcagacggcgtcacactagcctcaccctcgtgcagtttacactatgagagtgggggacttgccacccgatgtcaggtctcctggctgcaccctccccagccagctccttctccaaccctgtgacgtggcgagggtgcccgtcagcccaggctcggtgtgggtgtggtcatggcatgaacagcctgtggagtcacaggcccccaccacgtactccaggttcttcagggtgctgttggcgcagagggcatgagcgatggcctgggctccctcgggactgatggagttttctcgaaggctgaaaaaaaaggaaagacctgagcttctgaccgggcagatgaggtgtctggcaaagccaagcccaggtgtttaggcttcttgaagcccaagaaactgcaggcgggggacctagagttctgcatagtctgggctgaggtgtgaaggagccagtgctagtgagccagtgctgggccagccaggtgcccccactttaggaccatccgcagtacagggagaggacaggatgacagggccccagaggtgcgaggggacaggtggctcagcgtgcatctgggaagggagcggcagaatgggccactgcgggcagcagctatcccctgcaccccaagagagcaggaaaagggccaggctgccaggaaggcttccccagccatagatttccctgagacaggcttcccagtgccaagtccctgcagacaggtgcctcgtcaaagaaacgccctgtttggagagggtggccaggacttacctgaggctgaggagggtctggttggtgcagagggcccccatcagtgctgccactcctgcgtcactgatggaattgctctgcaggctgcggaaagaggaggcgccctgggtgtggctgtcccaggacccagagggagctgccctgtcccagtctgggacagcaggcactgggctcaacagggagttgggggctccagggacagtggtggccacactgcttctcttctcatctctctttcctctcccagccccccaccttctagcctctgccaggtcagggcaggtgggttcagcacaacaaacccccaaatgtagaccctgccttgatgtgggtggccccagacagcctcagagcagggtgtgttgggtctgcagcccccagagggagtggcgcagcaggctccccaagtgtgggtgtagcgctgagctctcctttcccctaccaaagctgctgcagctgactccctctccagccacccatgctggcttctcaaggacacttggagctcatcattccaaacactccagaccctaccccagcccccactgtctagggaaatggagctggtggggcaggggctactgaggacagtgtgtgcccagggttagtgttggcagggaaatggccctgggggacagccatttttcaggactgccggcccactatctactggaaagagaacccagggggaatcgtcaccctggcaggtggactcactccaggctctccaggccctggttcaccttcagggcctcagccagggccttggcacctccatcaccaatactattactggagaacctgcaagagaagggatatggatgagccagcctctgggagctgccaggcagggctgggcagagggatcagagtcagggaagccctcctgggagggctggctctgttgtctcaagggtggccagtgcacagtttgttctgcctgaggcctgttggctgtagtctctgcaagtgaccacctgttgtctgtaagaaatcaggatagcaaagtccctcttgactccctggcaagaagggtcaacccttcagtgataagtattttggggggtttttgtgaagatggtcaggaaatgttttcttctgccagctgggaagacagtaaatgtgagcccgagaaggttggggttcacccagtcctgggaatctgagtctccattctcctcggttagtgcttttggagtccaaagtcagctaaccagcactcacacttccatccatctatccatccactcacttattgatttatctacttacccacccactcattcataaatccatccattcgtccatccatccacctactcacctacccacttacccattcatccatccactcatccatccacctacccatcagtccacttagctatcatttcgtctgtccatccactcatccacccatccatccatttgtccatccatccatccactcacctattctccactaattcattcagccatgcctccatccactcatctacccacccatccattcatctatccattcatccatccatccacccacccacccactcactcattcattcactcattcattctaccatccatctatccactcacccatccatccatccatccactcatccatttatccatccactcatccattcaaccatccatccattcacgtacccatccacctatccacccatccctctctacccacccatccacccatctattcacccattcaaccatccatttatctactctactcattcattcattcatccacatacccacccatccatccatccctccatctacccactcacccattcatccactcatttattcaaccatccatccatccatccacccatccaccaatccacccatcaatgcatccattcatccactcatccacccatccatccatccatccatccatccattcattcaaccatccatccatccattcaaccgtccatctatccatccatccttccattcactcattcatccactcagtcattcatctactcgttcattcaaccatccatccatccatccattcaccagtcctctcacccatccatccatccatccatccactcattcatttatccattcattcacccatccatccatccatccatccacctgcctacccatccaccactacccacccaaccatccatccacccacccatatactcatttaaccatccatccatctatccactcattcatccatcagtccactcatccatccatccgtccactcatcagtgtatcccttcattcatccatccatccatccatccatccatccatccatccatccatttacctagccacccatccacctagtcacccatccatccatccacccacccatccatccattcacctatccatcaatccatccatccatcctcaggctcacaaatatttgtgctgggttgggcattgtgctgggcactgaggatactagtgtgggcctttcatatgtctcacatgagctctttcagactcctgttctgcttcaagggcatctgccatccgctgggctcccatgggcccgatgctgttcttctgcaggctgtgggagaaaagagaggggtcctttagaaaggctggtcacagccattcccaggccaaggacggttcaggttcaaggtcagggacaactagtgtgccctctacatttattggagcaggtggggagggcgttctccagatgggtctttggattgttgcctaagtgataatggaccaacattatgatgagggatagtaaggggtcagggcagctgagcctcccttgcaaggagctagaaagcagagatcagtaggtgctgataatgcccagcaacctcccgaatggggacctccatggacaagtctctctggtgccttacctgcagtctgcctcccatctagaccagcaggctgcctccaaccctaagaaacctccctaggggccaggtacggtggctcatgcctgtgatcccagcaccttgggaggccaaggtgggcggatcacgatgttaacagatcgagactatcctggccaacatggtgaaactccgtctctactaaaaataaaaaaattagcggggcgtggtggcatacacctgtaatcccagcaacttgggaggctgaggcagaagaatcacttgaaccagggaggcggaggttgcagtgagccgagattacgccactgcactccaggcgggcaatagagcgagactccgtctcaaataaaaaagaaaaaagaaacctccctaggaagaccctggcttaggttcctcttctgaaaaagctgcttcctcttgtcctaaatctggtggagggagacagcacgggagaaaccctgtcctcatcctacaaggacaggcaggcaggacgtctcctgtgtgaggctaaatacaaatcctaaaaaatgtaattttccctggttccaaaaaggaaagagactccttaccaccctcattttctcagagcacttcctgagaaaacttgaggttgcaaatgctgcctctgtccctttaagatgtatgtaaatctttttaaaagcaaaatcagcctctggccactttcacagcctgggaatgtctttcataagggtttggagccatctctttgaaatgtaaacattaaggaacaaagagtccctccttccctgccttcgggaattaggctaggtatctggcttgaagctctaaagtacctgcgtgtcatagagataaaagctttacttttcctttggataaaagcaattagggaccacaaatggccactccaattatctgctgtatttaggataaacggcaaatggtgctgcctggccctcttgcctgaggacgagggtcctgtctgcttggctctagaaaagtgagctttctgtctttacagtctcattggtgggttgccccgatgcaccgtgcagtcagtttaatgtttatccaataattgttgtattctttcctacatctgtgggttggtagaaggtattttattttatattttattattttattttatattttaattttattttatattttaattttatttttttttgacagagtctcgctgtcgcccaggctggagtgcaatggcacgatctcagctcactgcaccctccgcctcccaggttcaagcgattctctcaacttagcctcccaagtagctgggactacaggcttgcaccaccatgcctggttaattttttttttttttttttagtagagacggtgttttactattttggcccggctggtctcaaactcctgacttcaagtgatccgcctgccttggcctcccaaagtgctgggattacaggcatgagtccctgcgcccagccaggaggttttatttttaattatttccccaacagctgctctctcgaaaagtaatgggcatcaggggccatccagatgggtcagaaggcctcaggtcctagccccatccattcttcctagcaggtaataggcagagaggcccttggaggaggagggagaagggagagaagggggagagaggagatgtgttcactcactgcagcatggagagggtccggttggaggccaaggcctcagccatggacctggcaccatcatccctaacggtgttgccctggaggctgcagagacaagaagaggctcatcactgatggagcagaagctggaacccaggggtctgaactctctctgcagtgggggcacctctgtggagcaaggggttctgaccactacgtgccctcaccgcccaccatgcagggagagcagtggaccctttgcaccactgcctggggcttaggtttttctttgagttgctaagcatttgcctgctggctgggaacaaggtgcttctgctctctgaataaccacaacaaagtcatcaattgccctcattacagctgaaagacacaggatccaagtgttggtgagaatacagagaaactgcaaccctcacgctgctggtgggaatgcaaaatggtccgctgtctgtggaatatggtctggcaggtccttaaaaggttaaacatgggttgaccatgtgacccagcaattccattcctaggtatatcctcaaaagaattgaaaacaggcactggaagtcgtattcaccaatgttcacagcaacgatattcatataaccaaaaggtggaaacaacccaaatggctgtcattaggtgaatggatcaacatatcatggtctgtccatcccgtggaatatgattcagccttaaaacagagggaagaggctgggtacagtggctcacacctgtaatcccagcactttgggaggccgaggtgggtggatcacttgaggtcagcaatttgagaccagcctggccaacatggtgaaaccccatctctactaaaaatacaaaaattagctgggtgtggtggcacatgcctgtaatcccagctactcgggaggctgagacaggagaagtgcttgaacctggaaggcagaggttgcagtgagctaagatcacgccactgcactccagtctgggtgacagagtcagactccgtctcaaaaaaaaaaaaaaaaaaagttaaaataaaatggaaggaagcattgacacatggtaccacacggatgaagcttaaaaacatcatgctcaatgaggaaagccgcacaccaaaggcgagcctatataaatctatttacatgaaatgtccagaataggtaaatccttagagatgggaagcagattggtgattgtgaggggctggggaaaggggagaatgggaagtgactgtttatgggtatgaggtctccttcaggggtgatgaaaatattctggaactggacagatgtgatggtggcacaacattgtgaatttgctcaatgccactgaactgtacactttaaaacagtcagggttttttttagacagagtctcgctctgtcgcccaggctggagtgcagtggcgcgatcttggctcactgcaacctccgcctcccgggctcaactcaacctcagcctcctgagtagctaggaccacaggcacctgtcaccatgcctggctaactttttgtacttttcttttcttttttttttttagtagatatgaggttttaccatgttggccaggctggtctcgaactcccgacctcaagtgatccacctgccttggcctcccaaagtgctgggattacaggcatcagcctctgggacccgcctaaaacagtcaattttatggtacatgaatttcaccctaataaaaataaataaataaataaataaataaataaataaataaataaataaatgaaaacagaacagaaaagtggtacccactcagctaagtatagatataaccacaggcttttaaaagagacataactggctgggctcggtgactcacacttgtaatcccagcactttgggaggccaaggcaggcagatggcttgagtgcaggagctcgagaccagcctggtcaaaatggtgaaagctcgtctctactaaaaatacaaaaaaattagccaggcgtggtggcaggagcctgtaatcccagctacttggaaggctgaggcaggagaatcgcttaaacccaggaggcagaggttgcagtgagacaagatctccagcctgggtgacaaagaaagaatccgtctcaaaaaaaaaaaaaaaaaaaaaaaaaaaaaaaaaaaagagacgtaacaaaccacatcacaactctgtcccctgctcaggccacacacacaggctcaagtctagggaagagctggaccctggaaacttgcgtagggcataagatccccagtacccaatgggatgggagccagtatcccatgcctgccatctttgtttgcttgcttgttgagagagtttcactctgtcacccaggctggagtgtagtggcgcgatctcaacttactgcaacctctgcttcccagactcaagcgattctcctaccttagcctcccgagttgctgggattacaggcacctgccaccacgccagctaatttttgttttttagtagagatgccatttcgccatgttggccaggctgctctcgagctcctgacctcaagcgatccacctgtctcagcctcccaaagggttgggattacagatgtgagccactgtgcccggccccatgcctgccattgtgaatcacctcccattctcataggtggtgcctgaggagagggttttctgggccctctcttggggtcacaacacagggagcaggtgacacacacctcagggaggtcagggtgcggttgatcttcaaagcgtctgccagcgccttggccccttgtggtccaatggagttaccgcggaggctgaaggaagagagaaagagacacctccttcatctgtctcccagagagggaaggggaaacagaaactgcattgaccttgaaattcgtgatcctctaagggaatgtgtaagggcttaggatctcatgtttggtggaaccagggcagagatccttatataaacaaggaaggagtttccccacgactgtctcaggtgttgggggaaagaaagcagcacctgatggactagtgggcttgggccaaatgtggagatgagaatgatggccccagatgcagggcaaacatctggtgtgtccctggctgtagcccggcaactgaggagccatggttcagcccggctgtccttctgccccaccaggaaggcatgtgcgctaaggtgtggcctccctgtgtcttattcccacaggagtcttagaacctgctccaaatgaagtatggatattatgtccagatgctacccaggggctgaatcatgggaatcagggaagaacagacaggtaagacccaagtcatttcctaggagggaggggacttcacaagatgcctcacaactcttctggttccaatggcaaaagttcggccttggttgtccttacttactccagagaggtcagacttctgttgaccaagagggatctggccagagctttggcccctttgttactgatctggttctccgccaagctgcccaaggaaagggagaggagtggttattttaggcatgcacatctcatggcctcttcctcaacgctgtgcccgtgattaatcctctaggctcccccacatcatcagggtctggacataggtggagatgaggtgacccctggagcagaatgccaggcacagcagagcccctgagcctgggcagcgtagggccagagtgggaggacagaccctcatcatggcaaagggtctcaggaaaaagtttaaccagaatccagcacaacagcttctacacaaacagcacagcaaagaaaatggaaatctcggaagcctaacatgcagatggcagccagtggtgtactggtaaactggctcccaggaaaaacaaaatttcaaaaactgggctgtgcgtggtggctcatgcctatacaatcccagcactttgggaggccaaggcgggagcatcacttgaaaccaggcgtttgagactagcctgggaaacatagggagatcttgtctccacgaaaaacataaaaattagtcaggtggcgcacctgtagtccaagctacttgggaggctgaggagggaggatttagcctagaaggttgaggctgcaatgagccatgatgacatcactgcgctccagcctgagcgacagagtgagaccatgtctcaaaacaacaacaaaacaaaaaacaaatgctagcaaactgatttgtagtatctgccactttccatggtataaatactcccagcaacaccaagttcaagcacctccaccttgcaaaattcctgaaaatttaacaatcagctttcgtgaactggtacaaacaaatttaggcacactactgatcctagcctcttttctagtgcaaaatggcaaatggtagagttatttaaaattaactttaaaattaaaaaaaaaccacacacacacacacacacacacacatcttgatttgcctcaaaagcatggttctgggaatatggtggtggatcaactcaatgttacttcatgtatccagctgcagaaatagtagctgtccaggctctttgccgtttgtaggcattcagccccatgggatatagtagttcaattagaatccccaggctggtgctcttctttttcttttttcagacaggatctcattctgtcacccaggctggagtgcagtggcatgatcatggctcactgtaactcgaactctcgagctcaagaatcctcccacttcagcctcccaagtaactgggaccagaggtgcacgccaccacacctggctagttttttaattttttgcagagacagggttttactttgttgccgaggctggtctcaaactcctgggctcaaacgatcctcctgccttggcctcccaaagtgctggaattacaggcatgagccaccgtgcccagcctggtacttttcaagctatattgaagcaaactgttcactggaataaagtctcttttctctaaattccttttcagagaacttcaattcacagcattcgtccaggccacctctgtataaatgttctcaaattctagagtgcttccatccctctgggacttttatggcattttataagttgtatttaacttctaggtgaaatagggatgtggcactgaggatcaactacagagagaggtaaagaagagcatgtggccagagaagagatttttggcttcattcagaataatttacttttatttttatttttagtaaagatggcatcttgccatatgtttgccaggttggtcttgaactcctggccttaaagaatctccccaccttccagattgctaggattataggaaggagccactgtgcctggcccccgaataatttctgagcactacctagtctgctttaagcaaaactaaaagttggctattttgtcatgtgctaaaaatgcaggaggcgctcacagaggaaaaaatattaataatgagaattgtcattcttttacttttctttttttttttctttttttttttttgagacggggtcttgctctgtcacctcggctggagtgcagtggcgcaatcttggctcactgcaacttctgcctcccagactcaagcagttctcctgcttcagcctcctgagtagcagggattacacacacccaccaccaccacgactggctaatttttgtattttttagtagagacagggttttgccagtttgaccaggctggtctcgaactcctgacctcaagtgattcacgggcctcagtctcccaaagtgctgggattaaaggcatgagccaccgcccctggcctagatatccttttaagcccatttttaccctcttaaggcacagaaatgacttcttcaaactcacacagagcctacacctctaaacatactccccagtgccttatttttgttactgaattagtgtaaattgccattaactcagataaagattacttcagaacccagaggcttgtatgagaatgaagaattacccctggccacagtggctcacacctgtaatcccagcactttgggaggctgaggcggatggatcacctgaggtcaggagtttgagaccagcctggccaataaagtaatatagtgaaaccctgtatcgactaaaaatacaaaaattagctgggtgtggtggcatgcgcctgtagtcccagctactcaggaggctgaggcaggagaattgcttgaacccgggaggcggagtctgcagtgagccaagatcgtgccactgcactccagcctgcccaacacagggagactccgtctcaaaacaaaaaaaaaaacaaaattagcccttgggttctcttctccaaactcacctccctaggtctgcaacagccaccctcagaggatcagtcacatcgattcaaccacaaaccccgagtgtgtgtagtttctcagatccaggaatgttattccaggagacgtttcataagcacacattcaccatgtgaacttttgtctaattacaagatgaaggtttttttgtttgttttgttcttttttgagacggagtctcactctgtcacccagactggagtgcagtggcgctggagtgcagtggtgcgatctcggctcactgcaacctctgcctcctgggttcacgccattctcctgcctcagcctcctgagtagctgggactacaggcgcccaccaccacgcccggctaattttttgtatttttagtagagacagggtttcaccgtgttagtcaggatggtctcgatttcctgacctcgtgatccacctgcttcggcctcccaaagtgctgggattacaggggtgagccaccacacccggccacaagatgcaattttaattaaaaattgtttaaattgatttaaaattaaatttgaaattaaattttaattaaattaaatttgaaatttaaaattttaattaaaaatgcaattggctgggtgcagtagctcacgccagtaatcccagcactttgggaggccaaggctggcggatcacaaggtcaggagttcgaggccagcctggttaacatggtgaaaccctgtctctactaaaaatacaaaaattagccaggtgtggtgggcccctctaatcccagctactcaggaggctggggttagagaactgcttgagcctgggaggcagagattacaatgagccgagatcatgccactacactccagctggggtgacaaagcaagactgtctgggggggataattataatcctgtgcctagaatgctgttggacagcaaacttggagaggtgcttagagaacattgtgcctggcattatgtcagcacacgtagtgctgtggaaacacctgcctgtgcacagcggtgtctagtcccgccaggtcacctccctcttcctactgatgaggcacctgagcctctagcactttctggaattgggcagaaacaagcaggctgcatctggagccacatgctccaaagacacttctccgtggcagcgccgctggccagctgagcagaggatgatgggaagagggttccataccccacaagaccataggcaccctggaggtcccctgggtctgtgttacctgatcttctgaatgcgacagtccttcccactcagcacgctgcccagcagctccatcacggggtcctggaactggttggtgtccagcctggccaaggggagcagtgacagtgagtgtcccacccgcccacgggcagggtgggggccctggcccggggcctctgcctctctccatcccatgcagcgctatcaccgcagctctgagatctgcgctcagccccagtgctcagacctttcccgtgagagtgaacaggaggctgggtgcccacgagacctgcggttcctgtgcagaacggcatcttccacgggctgtcgtcctcaccaccccacataccgcctgcctctgcgggacacctggatgaccctcagcctgtgtcctttcctccctactcactaaggtccagagtggcgggcaggggacaggctgaaagcattcagcgggtgtgcagcttctatcagactggatggttctgagggggttatgaattgaattgtgtccccacaaaagatatgaagtcctaaccccctgtgccccaagtatgtggctttattgagaaatggggtcactgtggatgtactttgttaaggtggggccatgctgaagtggggtgagcctgtaatccagtgtgacagtgtctttttaagacaagaaagcactggccaggtgcagtggctcaggcctgtaatcccagcaatttgggaggctggggtgggcgggtcacctgaggtcaggagtttgagagcagcctggccaacatggtgaaaccccgtctctactaaaaacacaaaaattagccaggcatgatggcgggcacctgtaatcccagctactagggaggctgaggcaggagaatcgcttgaacccaggaggcagcgtttgcagtgagctgagatcgcgccactgtattccagcctgggcgacagagcaagactccatctcaaaaaaaaagagaggacagcaccatgtggagacagacacagggagaagatgaccaggcgacgggagagactgaagtaacgcagccttaagccaagggttcccatcaaacactggaagctagagaggaaggaaagaacctctcctatatgtttcagagagcgcatggccctcctggcaccttgatttgagacttctggcctccagaactgcgagaaaacacactttagttgttttaagccaccaagttcatggtcctctgttacggcagccctaggagactgacagagaagcttggtggtggggaggggacggcttctgctctctcctctgccccttccccagcccctgccccctgccctggtatccacctgagcttccggcagtagagcagctggggcagcaggctctgaaggacgccctggctgaggctcagggacaggttggcctcctgggcacaggcgtcggacacctgcaggaggtaggccagggcagcgcggtgcgcgggaccagtcagcctggccagggccccgctctccatggcctcctccacgctgcgggccagctcggtgtgctgcagctcatgcaggcagtgcaacacgttgatggcccgtgcacagactgcggcatcggggcgcaggcagccctgcaggagctcagccacctgggtccggtaggcctggtgctcgccttgggccagcagggagccggccaggagggcattgaccctcggagacaagaggccggagaggaagcgcaggaacacgtccagcctcccgtcctctgcctgcatggcccgctgggctgcgctcctgaaatgcgtgaggaagcccagcctgggccaggatacgccgctctcagtgaagaggtcgaagatggccctcctggatgcgccatagtaatacgcggctgccacaaactcctgcagggacaggtgggtgaagcagtaggccactgacgatgccaacgtctcctctctctgcaggaagcagctgcacggggcgccctgcagcagagcgaggtctacaccaaacgccttcatgtcttgctcgtaaaacacgtatttcttcttgagcagcccatggaaggccagacggcccaatgtccccaccatcttgcggccaccatgggccacctgctcgatgcgagggcttgccttgcccttctcctgcccctccccgctgagggccatcctaaagtaccatgagtagagctcgcacagggtcctcgggggccacagctctgcatcctggggccccgtcctgctgcgccacaggtggcctagcgccatccccgtgagcctgcagaaggctgggacggtgcacatcaggtacagggccctgtcagcctgcacttggctcagcatccagcccagaagggcctggtcctcggggaacatctgctccaaacacaccttgatctcctcctcgttaaagccccggatctccgtcatccggtccaccaggccccctgggatctggccagatgcactgggacgggaggtgatccagatggaaacttccggaaagaggttgccacggatgatgttggtgatcaggtggtccaccgggatctccttctttgggtccgtgcaggccacggtgttggagaagtccagaggcgtcctgcactcatccaagccgtccaggatcaggagggccctggctgggactgccaccgccaggctgggctccccgacgtgcgggaagaccgagcagatgagtcggtcggcacacagcttctcgtgggtgttgagatcccggaaggtcagaggcagcaccagcgagaagtccttgccgacctgcccatgggcccagaggcggacgaagtgcctcaccagggtggtcttgcccatgccggccaccccgatagtgatggagacccggggtgggacagacacccgggagagaggcaggaagagccggtccagggcgacggtcctggcggggtgcccgcccccgcgggtggcctccacctgtgtgaagtcgtgttccctcagctgcaggtccgtcaggccctccaccagcaggagggaggccagcctgtgccagggtccgcccagctccgggccacctcccaccttgctcagcagggccttgcggtgcctctgtatccttgagtctgcgggacagaggccagtggggaggtctggtaagggaagagtgggcacaatcagcccaggtgttccccaccccgcgtctgcctcccaagccggtcctaccattgctgcagggccccagcggggcatccggtgtcctatccagggcctgcggggcctgggagccttgactgcccttcccagccagcagatccatgagggctttcacctgctcggctggggagcccgtaccgtggccctggccggcctccctgcccgtccgcacctcttgcttcctcatggagtcggggatcacctccaggagctgtgaagagagggcctgaacctgctgcctgccgtgccccccatccagcagcctgggacaggtgagcaagtccccaggaacggggtcagggatcccctcttcctctttcctcagcctttgggtggcccactggcctggcctctgagaatggactggaagggccatttgttcctgggtggtagcaatgatcacacgaatgcaggggcccagtggatgataactggggccctgagcttgtaccccggccctgccacttaccagataggtgactgagggcaggctgagtcacctctctgcgccttggtgtcttcatttgtgacctggaaatgatgatgaggttacaagtaagtttgctcaaaaggagggaggaatgaaagaaggtactctgttggaacatgtgggaaaaagcaaaaaaaaaaaaaaaaaaaaaaaaaaaaggcagcagcagccactctggggacgctacactgtgtgattctgactaacattctggaaaaggcaaaagtatggagacaggaagacagtgaaagaaagggtcagtgggggccaagggttggggaggaggggtgaatcggtggaacacagacaattcctagggcagtaacatgactctgtagggtactacagtggtgggtccatgtcattatcattatacatttgtccagacccacagaacgtacaactccaagagtgagcccatggctgggcacagtgactcacacctttaatcccaacactttgggagcctgaggtgatggatcgcttgagcccaggagtttgagaccagcttgggcaacatagtgagaacccatctctaaaattttttaaaaattagcctggtatggggtgtgtgccagtagtcccagctacttgggaggccaaggcagcaggatcgcttgagcccaggaggtcaaagctgcagtgagccatgatcacaccacggcactccagcctgggtgacagagcaagaccccatctctaagaaaaacaaaataaaacaaaaaacttaactcttcttgctcctgagttagagcaaaaagcaaaaaaaaaaaaaaaaaaaaaaaaaaagaatgagccagagtatacactatggacattgggtgatggcgacatgtccgtgtaggtttactgattataatcaatggaccactgtggcaggggacggtgatagtgacagagtctgggtgggggcaggcatggggtgtatgggaagtctctgtactttcccatcaatttttctgtaaacctggccagacgcggtggctcatgtctgtaagcccagcactttgggaggtcgaggcgggcagatcacttgaggtcaggaatttgagaccagcctggccgatatggtgagaccctgtctctactgaaaatacaaaaattagccggggagggtggctcgcgcctgtaatcccagcactttgggaggacgaagtgggcagatcacctgaggtcaggagttcaagaccagcctgaccaacatggagaaaccccatctctattaaatatacaaaattagccaagtgtggcagcacatgcctgtaatcccagctactcaggaggctgaggcaggagaatcacttgaacccgggaggcagaggttgcagtaagctgagatcatgccattgcactgtagcctgggcaacaagaacgaaactccgtataaaaaaaaaaaaaaaaattagccaggcgtggtggctggtgcctgtaatcccagctactcaggaggctgaggcaggacaatcacttgaacctggaaggtagaggctgcaatgagctgagattgcgccactgcactccagtcggaggggaagagcgagactccgtaagcctaaaattgctttacaaggaaaagcttattaattaaaaaaaggaaataaaagatagaagaaggaggagtcaaaaaggagaaaacgctggttctcagagcggctgtttttcttactatgttcctggggtctcctgggagtgcaggagctcctgggctcccagcagtgctgtttgccctctgctcgtggggattgtgatgcagagatgctgagaggcaaagccaaggccccccactcccatttgcctccttgttgccaaggctggttgtccccccgcccccacagccctcccacacccaagctgtacactaaggccgggaactcgcccccacccaccctgctcgcctcctcaccgtgcaccctggccacagcagcccctccagtggggccccaggaactcaatggatggggctcagccttccgttgtccacagttctaggagaaaaaacacaatgtggccagcagaggtgatggctcactgctgctgatggcagccctgcattcaaaaataacaccaggtgttgtcactgcatagagaagcaggttggaccccacctgtccacagggcatttccctggttctcaatgtttagcttgctgttaggctgggcggtgtggctcacgcctgtaatcccagcattttgggaggctgaggcaggcggatcacctgaggttaggagttcaagaccagcctggccaacatggtgcaaccccatctctactaataatacaaatgagctgggcatggtggtgggcgcctgtaatcccaggtactcgagaggctgaggcaggagaattgcttgaccctggaaggcagaggttgcagtgagctgagatcacgccactgcactccagcctgggcaacagagcgagactccatctcaaaaaaaaaaaaaaaaaaaaaagcttgctgtctgcagccctgggattcagcaggctccctggccttggattagcagtggggagcctagctttttctttctttcttttttttttgagacggagtctgctgtgttgcccaggctggagtgcaatggcgtgatctcagctcactgaaacttctgcctcccaggttcaagcaattctcctgcctcagcctcccaagtatctgggattacaggcacatgccaccacacctggctaatttttgtaattttagtagaagcagggtttcaccttgctcaccgggctggtcttgaactcttgaccttgtgatctgcccacctcagccgagcctagcattttaacacaggtgatgctttttatctggaaaatgataaaagaagcttagcaataagtaaatagtaaagtaaaaataagtaaaacagtaaagtaaaaataagtaaaataccatttttcaggcattcaggtcatggtgttgaagaagtaaggagtgcgatcaatttgaggttgctggcacccaggccagctgaactaacctggaacattaggaacaggccagggcaaggccagtctccttatgctgccccaaagcctgttcttttattcttctaaatgtcaaaaccaagagggataaaaaatatgggattttgggctaggcacagtggctcatgcttgtcattccagcactttgggaggctgaggtaggaggatcacttgagcccaggagtttgagaccagcctgggcaaagtagtgagaccgtagctctacaaaataaaaattaaaaattagccaggcatggtggttcacgcctgtagtcccagctactcagtaggctgaggtgagaggactgcttgagcctgggaggttgaggctgcaatgagcagagattgcaccattgcactccagcctgggcaacagagtgagaccctgtcttaggagaaaaaaaaagatgggatttgaattgacattgcctcatgtgtatgggtccatgtgggtaatttgaggtccttctttagatccttctgtaaaactttatattttttctcatctcggtcttgccagttccttatttgtatctaggtatttttaaaaacagtttttgtcgtatgatgaatattgttggtataaaagatgattgatttttattttattgcatgtctcatcaacatattaaatattcacattggttttcatcattttccagttaattttcttcaggttttcaaattacttcagcaaggctgggcgtggtggctcacacctataatcccagcactttgggaggccaaggtgggcagatcacttgaggtcaggagttcgagaccagcctggccaacatggcggaaccccatctctactaaaaatacaaaagttagctgggtgtgatggcgtgtgcctgtaatcccagctattggggacactgaggttggagaatcgcttgaacccgagaggaggaggttgcagtgaggcgaaaacgcaccactgcactccagccggggtgacagagagagacaccatctcaaaaaaaaaaaaaaattcttcagcaagaagaatttttatctctttatttctgaaaaccatatatatatatatatatatatattattttttttttttttttttttttttgaggtggagtctcgcactgtcacccaggctggagtgcagtggcacgatctcactgtagcctctacctcccatgttcaagtgattctcctgccttagcctccccagtagctgggattacaggcacgcaccaccatgcctggctaatttttgtattttagtagagatggggtttcaccatgttgaccagactggtcttgaactcctgacctcaagtgatccacccgttttggcctcccaaagtgctcggattgtaggtgtgagccaccgtgcccagcccaaaaactataactcttattttgaacaattttaccacattggccaggcctaccccttccttggagcaataaggttgttgcaggccttcttgttttactctagactagaccaggagtggttcttgcccaaactgttaggtgtgatgtttgtgacagatttctagttttcttctccgatagagaaagatttattttgttctattaccattcaaatactattatgtaatatttactgaaggcatactgtgttctgcatattctgttaagcactgtatttccataatttatttctcataactctcaataccattatttctcccattttacagatgaagacactgaggctcagagaggttaagtgacttgtccaaggatacacagctgggaagtgggagttgggatagaaatcaattcctcactgacaccagtgcgtgtgctgtataatctactgcctcttaaggtagtttacactttttttttttgagacagagtctcaactcctgacctcaagtgatccacccacctcagcctcccaaagtgctgagattacaggtgtgagctgccgtgcctgggcaaaattttttaagataaggaatatctgttaaattagcaaattactttttagcatatattgatataaacatatgatttatttctcttcatttattcaaccagcaaatatttatggagagcctgttgtatgttctaggccctggggatgtgaaggtgaccaagttagatcaagtccttgacctgcggtttgacgggtaagggataatggcaatggaaaggaaaacaagtcaataagcaaggcagtttctgctggtggttagtgctgtgagtggaataaactgtgagtgacaaagaagcctggaattctagggggaggaggagcagaggtggtaattggcggctggggaaggctgctgtgagaggcctctgagaaaaagctacctaggagtagagagggtgagaaagagtcatgcagagagctaggggagggacatttcaggccaaggaaacagcaagtgcttagaggaaatgttgctggaacatggtaagtgagcaagtggcaccaccccctcagggctggaaaagccagtcaccgttgttgtaaggagtttggatttgttctaagtatggaggggagccactggggggagtgacatgagcaatggatatcagatctctcctggaatccatgagctacactaaatgattttctgatattgaaccaaccttgcattctagaatacagtcttccatttgtattattaaatagaagatgtatatattccatatatgtaaaaaatgtgtgggctagcacaagaatagatacataagtcaacagaataggatatagaggccaggaacaaatatatatttataatatctacacattaaggagtttggtaacatgacaaaaatagcatttcaaatcagtgaaaatggcattggggcaattgaccagcctatgaaaaatattttccagctgtaattcacattaaacacaaaatttattttcaggtcaattaaggagttaaaagttgtaaacacaaaaccataaaagcacaataagaaaatatgagataatattttaaaatattatttaggtaaaggttttttacagtgagacgtaaaactcagaagtgtcagcctgggcaacatagtgacacaccatctctacaaaaaaaaaaaaatagatggggctggtggtgggcacctgtggaactagctatggggaggctgaggtaggaggaccccttgagctcaggaggctgaggctgcagtgagctatgattgtgccactgcaatccagcttgggtgacagagcaagaccctggctttaaaaaaaaaaaaaaaaagcagaattcatgaagagggagactagtaaatttgtcttaattgaattaaaatattaaataattaaatatttagtttgatattaaataattaaaatatttgccaggcgtggtggctcacgcctgtaatcccagcactttgggaggctgaggcgggtggatcacaaggtcaagagatcaagaccagcctggccaacatggtgaaaccccatctctactaaaaatacaaaaattagctgggcgtggtggcacgtgcctgtagtcccggctactcgggaggctgaggcaggagaatcgcttgaacccgggaggcagaggttgcagtgagccaagatggcgccactgcactccagcctgggtgacagagcgagactccatctcaaaaaataataataataattaaaatatttataagtaataatagatgccataaagttgaaagaaaaactataagccaggagtcaacatttgcaacatacatggaaaaatatgaatatccttaatatataaagaacttataaatcaataataagtaaccaaacagaattatgaaccccaaatgaaatagaaaaaaggacacagataattcatagaagtataaatgaccaagatattgaaaagatgctcagtgtcactaaggatcaagaaaaaagcaaaagaataaactatcatttttcatacgtctcattggtgaatattataacataacagactgcattggtgagaacatggaggtagtgggaaattttttttttttttgagacaggatctcactgtgtcacccaggctggagtgcagtggcatgatcagggttcactgcagcctcaacttccctgggctcaagtgatcctccaaagtagctgggactacaggcgcatgctaccacatccagctaatttttgtattttttgtagagacagggtcttgccatgttgcctaggctggtctccaacttctggggtcaagcaatcttcccaccttggcctcccaaagtgctggaattattggcatgagccactgtgccaggcctgtagtgggaatcttaattcatagtgggtggaagtataaattagtataacaattctggattataataaccattatctgttgtcattaaatatcttttgtcctagaaattccacttctgggaatttatcctaaagaaatatgtgggccaggcgcggtgactcacacctgtaatcctagcactttgggaggccaaggcaggcagatcatctgaggtcaggggttcgagaccagtctggccaacatggtgaaaccccgtctctactaaaaatacaaaaattagctgggcatggtggtgggtgaccgtaatcccagctactcaggaggctgaggcagggaattgcttgaacccaggaggtggaggttgcagtgagccgagatggtgccactgcactctagcctgggcgatagagcaagactctatctcaaaaaaaaaaaaaaaaaaaaatcaaatatctaggaataaatctagcaaaatttgcaagacctctatactgaaaactataaaacattactgagagaaattaaaaaacatcaaaaggagggatggaggctgggcaccatggctcacccctgtaatcccagcactttaggaggccaaggtgggtggattgcttgagcccgggagtttgagaccagcctgagcaacatgggcaaaaccctgtctctataaaaagtacaaaaaaaaaaaaattagctgagcacggtggcgcatgcctgtaatcccagctactcaaggaagctgaggtgggaggatcgcttaactcccgccgtcaaggctgcagttagctgagatctcactactccactccagcctgagtgatagagcaagaccctgtctcacacacacacacaaaagctagcaattatctaaacattcaaaggtatgtcagcccaaatgaagcagtgctactgtctgcctgatatgccagaggccaggatacggggtcctctgtccttcactgtgtgacattagggtgtggcccaggtggacacagcctcctgttgttggatgtccatgtgcacccaccaggtgaccagccctgctgctgggggcgggagtggccaggaggatgagaggactgcgtggaagaagtctcagctctggtagggcatcatttggggtcttattgattgattgatttaaaattttggtaaaatacacataacacaaaatttaccattttaaccattttaaaaataattttccttaaaaaatagaggcagggtcttgctttgtcgctaaaaaataaagacagggtcctgctttgttgcccaggctggagtgcagtggtacgatcttggctcactgcagcctcgacctcctgggctcaagtgattctcccacctcagcctcccaagtagctgggattacaggtacaggtgaggaccaccatgcttggcccattgtaaccattttatctttttttttttttttttttttttttttttttttgagatagagtctcactctgttgcctaggctggagtgtcgtggcactatctcgtctcactgcaacctctgcctcctgggttcaagtgattctcccgcctcagggtcctcagtaactgggattataggcacccaccatcaataccatttgtatttttgtagagacagggtttcaccatgttggccaggctggtcttgaactcctgacctccaaaagtgctgggattacaggtgtgaaccactgcgcccggccttgtggagcacggcttttaaataaccaacgctcggcctgaccacccagagatttgattggtctggcaagggcccccacgtggatctagtttaagctcctccggtggttctaaccagagttgagaaccacgggacccgagcggggctgggagaggaatgagggagggacagtgctggcaggagtgaggggttggggcgaggcaggactcacaagcgcctgggaaggcggggacggggtgtagggggctggcaagcacccctgcctctgtggcctcattagtctctcagtattgggagtcagcactccctcctgatcagacacccatctttgtggccccatgaccttgggtccagggttgccagattcagcaaattaaaatacaagacaaacctgggcacagtggctcatgcctgtaatcctagcactttgggaggctgaggtgggcagatcaccttgaggtcaggagttcaagaccagcctgaccaacatggcgaaaccccatctctacgaaaaatacaaacattagctgggcgtggtggtggatgtctgtagtcccagctactctggaggctgaggcaggagaatcgcctgaactcaggaggtggaggctgcagtgagccaagatcacgccactgcactccagcctgggtgacagagcgagactgtctcaaaaaataatgataaaatatgagatatccacagataattaaatttcagataaacgacatataatttttagtataagcatagcttatgtcatactggagacataccaaagaaatggattatttgaaattcacatttgaccaagtgtcctgtatctgatctggcatccctgctcaggccccattcagacgaaacgtggctttcatcctggacactgtccctaagaaggacagaggagggggtgcaggtgaaccaacccccctgccattgccagcacctcccaggaccagccccaaaggctgatgggggctggttacctggctgccaccgctgccaggccctgcacgcagccctaacatccccctggcaggctggagccttccacagacctctcagccgagtgaggtcgcgaggccgcagacgccactatggatggtcaggcggcccctgtgagcgcagctgaaagacagagagactgaggacaggtgggactcgggttgctttgggggatctgaaggccagaggtcgctccacagctggtttgagctgctgcgagcagggcgaggccagagggacgagtaggtgccactgctgcctcctccccgggagcctcccaggtagcaccaggtttcacccctagagctttgtctgtgagcgaaggtgaacctgaggccttcctggtgtggtgtgggctcaagcccagttcctcaggctcagcaagtggcctgctgcctcattcctgagaagcctcagtcccgacggactagccgcctctgcccatcacccgcccacctgatctgtgcctcagtccttgccgggacctgctgggtccttccctgccacttggcgcccgggtgggacttcccagtgctggctgcctacctgggctgccagtatctcccaccacggctgcttggatgctcctctcttcccacatcctgcccctgccccctcccagggccttggaattcaggactcggttctctcgaggtggccccagcatcatcacttgagctcaaaagccttcccgaaggaagaaggaagtggcacctgcacctcagggccctaccctgctcactgcatggacccctggagtccaaggggtggagaggcccagccctggggagcccagcaccctgggacagaagaagaggggtgcagcctgcagcctgtgatggccaacagtgagccccaggctcagggtcacctccagggaggggtccagaaaaacaccagggcctctggagcctggccataggggaagaccctgcagccaacacccaggctggcccagggcagtggcacttcttccgagaaggcctctgcggttgccgtctctctcgacccttgtctcacccaaggctgtgggcaggagaggccctggggctgcccactcgcctgggggcggcgcctgcaccctccctgcccctcatgacctcgcccctcctgtgctgtcacctccatctacaggtggggtgctgaggcccagagaagtagcctcccatggggggtcccagtgccaggaagggtgcccaggtctgccgattccccaggccgtggctcagcatcaccactgcctgcccgcagcaccttcaagatgcttcctgcttctcctgggccatcactggtacctgggggagctgggttttgtccctgggacctgtcctgggccattcttagttacctgttttttcttttcttttttgttttgttttgttttgttttggagacagtctcgctttgtcacccaggattgagtgcagtggctcgatctcggctcactgcaacctacgcctcccgggttcaagcggttctcctgcctcagcctcccgactagctgggtgggattacaggcgtctgccaacatgcctggctaatttattttttatttttagtagagatggggtttcaccatgttggccaggctagtctcaaagtcctgacctcaagtgatccgcccaccttggcctcccaaagtgttgggattacaggcgtgagccaccgtgcctggccacatctcttttttctacagcatgagccagtcctgccccaggagacagcttcttggagtctcgtggagtctccccagtccccctccccagagtagctcaggccttaaggccactgtccttcctgccagcatcccttctccctcccctgccctgcactgaggtcacctggacccaacttacctcccgggcctcgatgctgctccagggacagcaagactggggggcctgggggcgtccatctccatgctcctgggctcagccctgctccagctgcgtggtggtagatgccctgggaatccctgtgccagcctgagttctcaggaccagggatcagggcacttaccacgccaaccaaccaaccgtgtgggggccgagagcagtgcagccccgaccttctgcagccccaccgagcccaccggctgtccctgtggctccgggtcctcacctcttcctgtgctgggctccacctcattcttccttcctgtctgatttcaacagccaacagcctcgcagacacatcgaggagccggggcaccctggcttggtcaccgcccccgtgcaagttaagtgcgggggcgatgctgggggtcttgactctgggattaagtgtccctgcaggtggcatgctcaggataaagtggctggtgccaaggctgttgacacatcacctccatcccgccacaaaggaagctgccccgccatcaacaaatgcttgttttcaggcgggtggtcaggaaatcaagtgagcagcctgaggtcacgcaactagagggtgaccccagcaggactggactgtgccctgccacctccaggccacccctgtggctctccttatttatttatttaatttatttatttgagacagagtctcgctctgttgcccaggctggagtgcaatggcacgatctcggctcactgcaacctccccctcccaggttcaagagattctcctgcctcagcctcctgagtagctgggattacgggcatgcgccaccatgccccgctaatttttgtatttttagcagaggaggggctttgccatgttggccaggctggtcttgaacgcctgacctcaggtgatccacccaccttggcttcccaaaggggtgggattacaggcgtgagccactgcgcccagcctatttattttttgagacaggatcttgctctgtcacccagactggagtgcagtggtgtgatctcggctcactgtagcctctacctcctggggctcaagtgatcctcctgccttggcctcccaaaacacggagataacaggtgtgagccactgtgctccctcttttaacacctcttgctttcttttctctctgtcacccagtaggcacctctgactcagctgtgccccataacatcttcctgtgagcaaagggctccccagaggcaggtcacctgtaccctaagaggaaacagcagaatgttgccgtccgcggcaggagatcgcactcggcccctggaagtggacctcagtgggtggcctgccctgacagggaagggcgtgagggggaaggacatggcccagagcaagccacatgagaaaaattacaataaagtatgggacatccgctggggacagggagcaagcaacatggggccactgagggaaggaggtgacaaggtgggagccaagggacaggggtcctggggtctgaattttcctcagcaagcaagtgggagccagcaatggttgtagagcaggagagtagtgggtctggactcatagagcagcttgtggctcaggggaggtaggagggttagctggttccccagagcctgtgtgggtgatgggggggagggaactgaggcagcagaccagaagtgctcctgcacattcccctgcctgcctaccttcttttgtccctccttcctctccctccctcccaacaatgctttctgagcacccaggaacctgctgggtgctgggaggacacgatggaccctcgagaaggctgcccgaggctccaggcaggcagagtgcagacccagcagctgcagcctcggctgtggggagcaacaaaggcgcctgaaaccaggccgcccacaggatgttggaaaccacagggcccggtgggtatccgtcacataaaaggggccagaggctcacactgcctccctttgtggctcagggggatggatgcggagcctgagaggacacagcctcatccacgggatcttggggagcagcccaacccagcccagcccagccccgccccgccccgccccgcccgttcctccccctcgcaggaatgtccatcagtccacacagggctggtcccattccccactctgcccgctctgctgagaaccaggtgggccgtcctcctggctcctggtggaggtgggggtgctgggctgggggctccctaactgttctcactctggggctttctgtccacccagagctggggtcagccagacaggaagcgacctcagcccttcctaactcagcaacagcgcaaggcccctgcctgcaggctctttctttgtaagtgcccttgcctgggcccaggctggggtgtggctcccctgtgactgccttgaggggctgtgcccaagccatgccaggttggggccaccaaaagtgggacaggcctggaggcctgttcatattacagtgaggcatagacagacccgttttctgatttagttgttaccagtgaaagttctgctgccagtcttttattctccccctttagaaatgtttttaatattgttttcaaaatagagacttggccttactatgttgcccaggctggtctcaaactcctgggctcaagtgatcctcctgccttggcctcccaaagcactgggattacatgtgggagccaccgcacccggcatgccagcttccttctcagtcactcctggaaggtaactctctctcgccttgtccatgaagaggccccattgcctgccagtcttgctgcaggcgctgtgagaaggcattttccatctgtcaactggacctagttttatgttgcccgggtcagcgtcatccctgtagcaggggccaggtctactcctggatgccaccacgcctctgtgggttcctgcagtgactccttcaaccctttccctctggaggaatcagctgcttcacagcttgtttcaggacaaggaaatgctgctttgtacaggttcagggccagcatccagtcccctggctgggtggcagtgcataaaccaagcctctgcccagcgctgtcagcccagggagcgtccagcagccccaactgaatccaaggtcaccacaaggctcgaatccagtccccaggccatgcctcccctggccttgggctcacactgcactcaaggctcctaacccagcttgttaactacttggaacccctcccccaacccatctttaccagccttgaagttctgaactttcaagtcatggcacataacacatacttccccaaaccacaaaccctgcgaggccggacaggggccccgagtcccccacctgcaccactccctctcgcttccctaacaccagggagggggatcagcccatcaaggaagcagtgcgtgatgccttccgaaacaggccagaggccagcctcagattgatcacagctgatctcagcctctcaaattgttcgccccgggcaccgtaagctgggaggcctgggcctctccgctggttcacgtgccaggacatagtatgtgcgccagaaatcacatttcaccccctaaatgctgctgagccctaagatgcagctcacaaacccctcttctgggaggctgtccctgacacggcccttcaagccactggagcccgactccccaccaggctgggataggccagcgtctgtctcctccactggaccggacgcaatggtaaaggcatgtgctgtcttggtgagttgtggggtggggcctgaatctgcttttgtagcaactcccggctgaggcagcagctgggggtgcttgggccccactttgaggtgcgggggctggagcttggcacccagccagggctctgttggatacgggtgtgtggattaatggatgaacatctgcatctctggtctgggaactgaaatgaggagacagcaggcccaggttactccaaagtaaagggcaggtgcaaggtggggacttctgcaggcgtggggcacgggctgaggggccacggtgcctccaggtcccccgtttcgctcgtggtctccctggagtgtggcagccagattttaataaagcctttttggtttattgcacatcatataaaactgactgcactgtatttgaaacagacgaggacattcacaaggatggagaaaccaaggtttccttctttcctggccctcatcttcctccacactgctcctgaggctggaggcagctttaacccaaagaatggaatccgctagtgaacatgtttgttttgtggtggcatcagagttgttctgggcccttgtgcactgtccagtttggagactgctggtaacaatgacaagtgtccgggtagcacggctgggtcaggagaactgcatctgggctgtggcagtgcagggagcctcaggacacctggtctcaggctggcggtggctggggttggcctgagtgctgaggaggacgggcccgggctgccggggcaggctggacctgacgtccatctcaggacagacatgtagggcagctgtgcccaggactggtgggctcagagggtggcaaatgtggcagaataggccatgccctggccagctggtgatggcccactgccccctgggacagctgagggccctcttgggttaagggagacacactgggccgggcgcagtggctggcgcctgtgatcccagcactttgggaggccgcagcaggcggattgcctgagctctggagtttgtgaccagcctgagcaacatggtgaaaccccgtttctactaaaatataaaaaatcagctgggcgtggcagcgtgtgcctgtagtcccagctatctgggaggctgaggcaggagaattgcttgaacccgggaggcggaggttgcagtgagccgagattgtgccactgcactccagcctaggtgacacagcacgactgtctcaaaaagaaaaaaaaaaagaaaaccaaaaagggagacacactgtgagcacggacagaggaaggggctggagtctgtaaatccagtgggtgacatgctccaaatgccaccctagaaagcagagcccagaggaggaagccctggattgggctgtggtcatcatcacagcgcagagctgatgtggtccccaggcccagaaatgcctgtggaggcctgacccacgctgggtgtcccaggtcctccctgcaaatggcgggggtgggggctgctgatggcaggttggggtggggtcgggatggccccatcagttccgctccaccttcttcttgccccgaggctgccgcctcctgccctggagcttctccctgcgggtggcggcagtggtgaaggtgatacagtgggtgtccaggaagtccaacagcctgcgcgaggacacacggaggccgttctgcctcagctctgcctgcagctcccgcagctcaaagggctggtacagcagcaccttctggtacagggccggcttggagcggatgtagcacctcagcgcctcgtctgtgtccgccgcctgcacggctgcctgcgaggcactgacctccccctcgccctcctcttcacctgcagactcaaatgccgctccaaactcacaggaggaagaactgaaaagagccagaccaggacgttgtgcaacccctttctctccagcccctgagaccatgagcctctttaaaggaaggaaggtgtctacgggtcccatggagcctggcctgtggcacgatccccagcaaggcaggacgggcctgagagatccctgcaggctacgccagcgggatcctgccccagccagaaatgtctagcatgtggggcaggaaccaggaggcctgcgcagggctggggtcagggaaccagccccctaaacccacctggttttcccacaggtcaaacccagaaggtgacgggggtttttgaagattggccattaggtctcactcgtgccaaccctcacgcccacgggccagaggatacatgaggccactgaccccatcgcatccatccggttacctctgtgagctcaaggagctgtcactgccatccacagaggtggccacggattcttgagaggctgggatctgggcgtcatcattgaggcctggaggtgcctccttggtgggcgacctgcttgggggtgtgatgctttcatgatgcttcctttgatgtcgggggcccttggtcttagcaggtcccttgggcctatgggccccaggtcctgtggtggcctcctgctgggcatggacccctgcccttgaaggcttgtaggtctgggaggcgagggtctggcagtgaggcgcctgcaacagcggctgtgaggactggctctcgtcctcggagtctgagtccagggtctggtgagtgtactggaatatctccttcagcttcagaaccatctggcgtttaggcagagggcggactccaaacctgacggaggaacaggtggatctcaggacccacccacacagctggtccacactccacgttccctatcttagcaaagagtgatacccaatgcattcagcgaatggcttgtgtgacaaaccatagatgcctgacttctgtgagcatcagaggttagtgtctattctaggcgccaactaagcttactctgaatattccaaaagaaacattgccagccaggcacaatggctcacgcctacaatcccagcactttgggaggctgaggcaggaggacagtttgagctcaggagttcaaggccagcctgggcaacatagcaagaccccgcctctacaaaaaatacaaaaattagccaggcgtggtggtgtcacctgtagtcccagctactagggaggatgaggtaggatcgcttaagcccgggaggctgaggctacagtgagccaagatcacatcactctactccagcctgggcaacagagtgagatcctgtctccaaaaataaaaaataaacaaaagatatgctgctcccagttctgagggatggtggcagcagcagcttccccgggtgcccgagtggaagagcagtgtcatgtggatgtgagagttaaatgttcttttaaaaaaaatcaggcctccgccgggcacagtggctcacgcctgtaatcccagcattttgggaagccgaggcgggtggatcacgtggtcaggagttcgagaccagcctggccaacatggtgaaaccccgtctctactaaaaatacaacaattagcctggtgtggtggcgtgtgcctgtagtcccagctactcgggaggctgagtcaggagaatcgcttgaacccgggaggtggaggttgcagtgagccgggactgcgccactgcactccagcctgggcgacagagcaagactctgtctttcaaaaaaaaaatcagacctcctcactcagactgctctggctagggggccatttccatctacatggaatatggggacctgctgcccaggggtgacatgcacgaatcctgtgtgttgcctccctggggaatggtacgcagagagaactgggaggctcaccccggcacccagcagtcacacatgctccctaaggagctgactgcagacctttcttcccaagcccaggccagctgcatccaccagacccagagaccacacggggggcccttccgcccccaggtgtgtgaaacccagttacttatgggagggaaaagaccactgtgggcaacaagctttgaagaccgccaacctatccagttccttcttcagcaccggcgtctccataatggaatactgtggcatcggcgttatgggcactttggggggcaagttcttcttccgattagcaccttctgggtaaaacaaaagaagcacacgttttagcatgagggacacggatttcccacatctgatcccagtagcgtgaccaagaggaataatgcacttgaagataacccaagcatcgttttgctccatgaaagcaacagtggtcaccccttccctgtctggagcaggggcttcccaatgatagcatcggtgacacgcactgaggaccacaccttgtataacacgggtgccgggtgaacagagctcctggggccactgaacccaacagcccggcacgtgactaaaacttatgcatgtaaacttaaaaatatctgacccacagtgacaacttgagacaatgggccacactgatactcttcaaacaggcttagacatcagttttgctttttaaaaataattcatcaatttaaaaaaacccagttaaaaaatgggcaaaggggccgggcgcggtggctcacgcctgtaatcccagcactttgggaggccgaggtgggcggatcacgaggtcaggagatcgagaccatcctggctaacacggtgaaaccccgtctctattaaaaatacaaaaaattagctgggcgtggtggcgggcgcctgtagtcccagctgcttgggaggctgaggcaggagaatggcgtgaacctgggaggcggagcttgcagtgagccgagatcacaccactgcactccagcctgggcgacagagcaagactctgtctcaaaaaaaaaaaaaaaaaagggcaaaggatgtgaacagacatttctccagagaagatctacaaatggccaataagcacatgaaaaggtgcccgacatcattagtcatcagggaaatgcaagtcaaaaccacagtgagataccactgcacgcccactaggatggccataacaaaaaacacagagggtttgggcaaaatggcagaaccctatctctacaaaaaaaaaaaaaaaaaaatacaaaaaaagttagcagggtgtggtggcccaagtcaccaatgtgggcagctgtttgtggctggttccagctactcgggaggctgaggtgggaggatcacctgagccaggaaggttgaggctgcagcaagccatgaacacgccactgcactccagcctgggcgacagagcaagaccttgtctcaaaacaataacaacaacaacaaaaacagaataacaagtgttggtggagatttaaaatggtgcagtcactttggaaaacagtctcgcagttcctcacaatgctaaacacagttgccatatgacccagcaattccactcctaagtacagaaccaagaagaaggaaaacatgtctacacgaaaacttgcacatcaatattcctaagtggcattattaataaccacaaattaaaaacaacccgtgtgtccactagtagatgaatggataagcaaaatgtggcataccatcagtggggtattagacatacaaaggaatgtatgcccaaagccagggcaacatagcaagacccagtctctactaaaaaaaaaaaattagctgggcatggtggcagctgcctgtagtcccagctactcaggaggttgaggtgggaggatcacttgagcctgggaggtcgaggctacaatgagctgtaattgcgccactgcacttcagcctgggtgacagagcaagacccctgactcaaaaacaggccaggcacagtggctcaggcttgtaatcccagcactgtgggagaccaaagtgggtggatcacttgaggttaggagttcgagaccagcttggccaacatggtgaaaccccatctgtactaaaaatacaaaaaaattagccgggcatggcatggcgatgggcgcttgtaatcccagctactcgggaggctgaggcgggagaatcgcttggacccaggaggtggaggttgcagtgagccgagatcgtgccactgcactctagcctgggcaacagagagaggctccgtctcaaaaaaaaaaaaaaagaataaaaaggaataaaatactgatccatgctacaacatgtatgaatcttgaaaactgtatgctaactgaaagaagccagacacagacacaaaaggccacatattagttatatatggctctgtttatatgaaatgtccaggacaggcaaatccatagagacagaaaggttcttggttgccagggctgggggaaggggaaggtgagagactgctcatgggtacaggatttttgagatgatgaaaatgttctagaattagagagtggggacaattgtacaacactgtgaatgtactgagaagcactgaactgtccattttaaaagggtggatattatggtatgtgaattatatctaaataaagctgttactttaaaaaataataggctgggcgaggtggctcacgcctgtaatcccagcactttgggaggccgaggtgggcggatcacctgaggtcagcagctcaagaccagcctgatcaacatggtgaaacccgactctactaaaaatacaaaaattagctgggcgtggtgctgggtgcctgtaatcccagctactcgggaggctgaggcaggagaatcccttgaacccgagaggtggaggttgcagtgagccgagatagccccactgcactccagcctggtgacacattggaaacagtcagactttggttcttctgccttttatgaccatggagccctttgagcccccgatgaaagcggcaggctctgtctcctgagaaaagcacgattcttcctgtggccgcagcgtcgtcctgaagcccacctcagatctgctgtgcagcctcctgcagctgttctcacagcactgcctgggaactggttagaaatgcaaattcttagtcaccctcccgaagcaaggctctggggcaggctgggccacgggcgtgctataagaagctctccaggtgtttctgaagcccctgagggccgaggacactatcagtggcctcattcatctggattttgggaggaaatgggcccccaggccgcaggcaggtgctcactcacagcctggcctttctcccagtcatgctcagcccagcccggcctgtccttgccctccccggaggtgcctggatgggagcagcagcaccgagggggccgacacctggggctctgactctccccggggactgaaatgagcagggaggtggcatccctgcacctgggaggaccaggaagaacaggcctaacagcctctcacacttgtcccacctgattctttttttaattgaggtgaaattcacataaaaaaatcgtaaagggaataattcagtggcattaagtattcacaatgttgtacaaccatcacctctatctatttgcaaaacattttcaccaccccaaaaggacaccctgtatcccataagcagtcactccccattccccctccctccaacccaggccaaccactaacctgcattttctctggatttgcctattctagacatttcatatccatgagtgcagacagtacatgaccttctatgtctggcttctctcacccggcagcatgttttctgggtcgtccacgcggtagcgtgtggcagtgcctcactcctctttgtggctgaacactattccattttctagtggtctagatggaccacgtttggtttccctgttcatctcctgacgggcatttgggttgcttccagcttttggcgattgtgaacagcgcttctatgaacatgcatgtctgagtccctgtttttaattcttttggatatacaggtaaaagtggaattgctgggtcctgcagtcaatctacggttaacattctggagaaccaccctggtccaatcttaaggcatgccgatacttgctgaatgagttgtggcctttggaggtgccggctccgtgttctggagaagggtccacagatgtggatttttaacacatgcccaggtgagcactggagccaggcaagtttgggaaacactgacttactggctgagaagtgtagcatgagaaccagcccggctctcctccactgtggaggggagtctggaaggcagcggaagtgtcatgcctcaggtcagcaggcattcagagggcagcccctgggtctcatgactgatcttcccaccctcttagtgtaaaatagtaacaaagacagtccccttccccagctctcctggctactcactgggtgtctctaacccttcgggcttctgagctccaccagcgcttggcatctgggccggaggaggggtctctggaggcctctgctcttccccgtcccaaacgtcccacagagccgaattcagaaagctcggcctgctattccccagggagcccgcgcccgaggacttctcttgcaatttcctctgggtagtgcagcttcctcggatgggggtggtgtccaggagtcccggggagcgacagtcacggctgtcggcggcctcgttcatcctgcggctggggctgctggtgctcagggggccggtccgctccaggttccagtggtcaatgggaattggcgagaggggctccatgtgccagcagcagtcgtcaattggaattggggggtcactgtccagtggggggcttctgttggcctgatgggaggccacctcctgctcatcgtcactgtctccgacttccaccacttcacccgctggggtctggttcaggaagcttggcccaggcggcgagtgtttcaggaaccgcctgctgaagtgggcgcggtcccctgagatgggatgtggagccagcggagaggagtgcgggtggcccccggggtggggacgggaagggcttctgtggccttgccttctgccgtcagaagttcctggagagacgggagtgaggcatgaggacggtgtctggggcggtggtgtctggggcctgatgacagaaaacttctgtgcgacttcgttcccttccctgtttcctactgaggccctgggcgtgtgctgagtcaccgcctgcacggccagcccgctcctgaggctgctgatttgggtctgggaagaacagtcacggcttctgctggccagcggggtggcgggcaccagccacgaggtgtctgtggtgctggcctcgctggggctgctctcacggtcacagaacagccagggagcccctctcctgcccaaagagccccgattctccggcagcgccccctcatcctcctgctgcagcacagcttcgcttcttggtgggctctgggaaggttcctgatctgcatcaacatcaatgatggaaaacagctcacaggacctagggctaatttctagagctttcttttcttccagaggatcactagaaatggacttcattttggtttgttctagctccagctcctcatccgagtccagtaagaggatgacctcatcttcttcgttcagtttggatgaagatttctgagatctggagctcgaatggtcaggatttgactgggttaggtcaatagacggagatttttctgggaacatcaggacccccttatttctgcactccagcacggaccgacgctctttgcctttctggtgccctggctctttagacagcgtgaggatgctcctgtcccttttctgctttgatggcacagctggagacagcaaggttggggagcccacctgggaagttccgccacgggaccggggtgttgacagggacgacccacttgtgtgatgagacccgcggggactcccgccctggggaggccccaataggaagcggcacgggtgcggtggagatgcctgccagggagccaggcgatgagaaacctccagccccctttccctgacagcgccactttgttcctcgggctcacttgttatttgggacggctctgagatctctccctgagttgatgagaagagctgttcgtaatccccggcatcatctgagtgcggaagagagccttcttttctctctgcctggcagtccctggaagggctggagcagctggaatggccaagcgcctcctctggcgcctcctgctcaggggcctctgctccccgtgcccctgagtgctggccctggggtggcgggagagcgcactgtcccatcttctcccaggtggtggcggcctcatctcttcctggctccaacggctccatctcctccaccttgtcccactgtttctgcacctggacacctgctaggagttgcccagaaaccggactgccaccctccagccagtcagcgtcctcgccggcacccgctgccctttcttcctggagaagctttcgctgagtagctgcaaattcataaatttcttccatttctgcttcattcacgttttcttgatcttcttcgtggtccttggatttcaacaaagtctccgcttcctcctcttcatctgcccacattgacctcaagagttcctggaaattctcggccctgctttcgcaattctctgcttccttctcctcccatggtttgccctctgagtcagtggcaataggcacctgttcgcacaggtgaacgagctcactcacgccaaacctgcaacacgaaacatcgacagtcatcgcccctctgcgtggagatgggctctgggtgccccggtggggtggcggaccagagcagagtcttcaccaggaggaatgaccatgacccaggccctgcttccctttgaagacggtgtccacactccttgccagaaacacccaggccacttagttccagaaaccggggactgacaacacttaaagcagggcttcctaactatagctgcagacataaaggggtgtgtcggactgaatgtaaggtaacagggattggcagagctacaaaactggggagtctgtgctgcctcagaggctcttaagatatggtgtcagagccaggcattgtggctcatgcctgaaattccagcactttgggaagccgaggatcactcaaggccgggagtttgagatcagcctggacaacatagaaagtctccatctctacaaaaaaatgtaaaaattagcctaggagttcaaggctacagtgagctgtgatcatgccactgccatccagcctgggcaacagcaagagactctgtctctaaaaggataaaaaaggtcatgcatggtggctcatgcccataatcccagcactttgggaggcggaggcaggaggattgcttgaggtcaggagttcaagaacagcctgggcaacacagcgacactccgtctctccaaaaaataaaaaataaatgaaaagacatggcatcagacacaatccacagcacaccaagtccttgagtcagcccaggccaacgggcaagccagccagccacctgcttgaaggctctgtggcccgtcagtatatttccaactccagaggctgagctgttcctttcctaagaaagcagcggagggaggacgcaggctcggatcagcggcccaggccctgtccagaggcacaacacttgtccctctgagctgctgcctctctcctaagatgctggctggacaagccaggagagctgtggcatctgggatgcagcctaagcattctctccatgcctgttttatgggactctggaaaggactgctgttgttcaggtctagtggtggaacaatcactgagcagcagtgttggggggcgctgtagccaagggccattctcttatcacacctagggggttaaaaaccacgggactcaatagagtcctcctgatccagtgcttggcacccctgcaagggtctgttctggcctgactttcacctaacatgccctgttccacagggtcatcactggtcatggacttgggattaaaaggtataaacaggactgttagttctcttggcctcagccccgagccctctgcagcacaaccctccagagctgttaacctgccagtcctcgtcagttaatttcaaaagctggggagcaatccagacctgtgggccagggagctcagctcagagctaaggccaggaggaaggccagtgtccgcagtgtagagatagtgcaggaacgtgcgggcggcctcggtgctcacgtcacccagcaggacacgctgggtcagaaccccgtcctctacagcggagaagccttcattgttcacctgcaggtgaaatgcaacacagagggtttactgatcagagagttgtaacttggagcaaagcagacggtctggggtgtcctgcaagtcactagtctttttatttttctttttagagacagtgtctccccttgtcacccaggctagagtacagtggtgtgatcatggcttactgcagccttgaactcctaggctaattttaaattttaattaattttattattttgagttggaatctctctctgttgcccaggctggagtgcagtggtgagatctcggctcactgcaacctccacctcctcggttccagcgtattctcctgcctcagcctcccgagtagctgggattgcagccgcccaccaccatgcccggctaattttttatagtttcagtagagataaggtttcactatgttggccaggctggtcttggaactcctgacctcaggtgatccaccctcctcggcctcccaaagtgctgggattactggcgtgagccactgcgcccagcccctaggctaatttttaaatttttttgtagagatgggctctcactgtgttgttcaggctggtcttgaactcctggcctcaagcgatcctcccaccttagtctcccaaagtacggggatctcaggcatgagccgccgtgcctggtccctagtcttaaaagcagctccatgccccaggaaaagcattagccactgtttatgcagatttttggccaataattttacaggtgaggcctaacactcctcttttgtcaaatcgtattgggactagatattccaggaccccgttaagagtcctcctgatagacacatatgggatccagaactttgacaaagactgagaatagctccctgagttcctgcccacactcaagtcaaatgctttcaagtcagaaggcaggttcatcagcaactcatccctgaggagatcaattatgagcctttgtaattatgcaaatagagaaaagagaaaacaattctgggaaacaatggattttctttttgttttgttttgtttttgagacagagtcttgctctgtcgcccaggctggagtgcagtggtgcaatctcagctcattggaagctccgcctcccaggttcatgccattctcctgcctcagcctcccgagtagctgggactacaggcgcccgccaccatgcccggctaatttttttgtatttttagtagagactggtttcactgtgttaggatggtcttgatctcctgaccttgtgatctgcccgcctcggcctcccaaagtgctggaattacaggcgtgagccaccgcgcccggccaaacaatggattttcattcaacagaacgaaaacactgatgtttcccagttgtgaggccatcccctcacacccactcctaacctcaagcgtgggtctttatctcttctccacgtgttgcagaaacggatggttgggagggagaaggtgagaacatggtggggcaggaagtgagggagagtgggggggtggaaagggcacctgagacatgggaagacctggttggagaaaggcaggaggagagagggagagagaggaaaggagggcacacggcagcccacgtacttacatactggatgaggagcgggcatcgggcataaagcacgaacttgtgggcgtaaagcacctccccgctgtccgtctgaaactggacatcactcaggtgtgggttattgaccatggcgccaaagtcagcaaccagcagcccgagggagagctgaagcaggaggagaggaagagccgtcacctccccacctctgctctgctaactgggcagtgggaagctccccgcatggaggtggcgctagggtgggccgggagccaggacctgcattctcctttcctctccaaaacgcttcccacgatggcctcaacctctgagtgaccctaaggccctgagtagcacagaagagcaaagcactagcttgttcctctggctcttgccagtgggttccctggcccccgtggagatgccagacatggggctagatgtgaactcacagtgctggcagctcccgcactgagtgggacaggctgcgggatacctgggctttgaggaggtgcacccatcccctgtgacggacaagcaccctgagtccaagcagctcggggacctggccaagaggacagccgggtccagtctgtgatgatgtccctaggctggccttggcatgaagtgcttggttgacactgacatgcaaatgggaggaggtccactctagggaaaagccagttcccaccccggttcttccccagacagcgcactgacagggaggccaggccaggctgctcagctgtgctctggagcccaggacccgcacagaggggagggagagcaagcccttggtgagctcccaactactgaggaacgagcagagcgtgcctggatggggcaaccgcgctgagaaactgtggtccctctacactcctgggacccaggacagggcaggctctggggcctcaaccccaaggtgccccatggagtcacagacagaaaaggcagaagtctcgtggcagagcccccagaggggcgctgaggtggctgtgggtccgtggctctgctcacggatgtcaggatgtggcagccttctggaaagcagaggccttgagaggccactgcacttgcgttgggggccagaggccagcggtgagccaaccccaccacacacatggcaagtgggatggccgggaccagagagcgcgggccagagccagttcttaccaaggtgcggccgcccctgtccgggtgcttgtcctgcgatggcaccacaaacccagtcagaggaaggccgccgggcaccacgtccaaccctgagtggaggattcacaggttaaaggaacgtcacagcccagccacatccaccaccaagaagacagcgttgaccacaggctgagccagcccctgcggtgcctcggaaggtgcttgctatccgaggacaccttcatgcaaagcaaacccgcacaccctgtctcaccaccactccaccagggaggtaagagaagagcaaaacagacagttcacccagaggattcactcgctgtgggcagacagctctgtctttggttaaagtggaaggaaaatcatgacagagttgtctacaccacattgacctttgagaaaaaatgaaagcgcccagaggctgcgtgttctcccaccaggtcagagctgccgtcgcggcggcacaagagccagtccatggcagcctcagccgcggggaggggaggcccgggagggcagggctggccctagagtcccacccagcatctcacctgcagtcccttccgagccagccaggcccccactgccgggccacgggctggcgctcagtccctccctcgccaggtccacgaggtcctgcagggcctggtgctccctctggctggccgaaggcgacgggcccctggagccacagcctgcagtgggggtgccgtggagagcgggtgaccttcgctcgctcagctctgagtgctcaggtggcaccagaggcggcacgggctcctgcataaggccctgaaagaagccagtaaggagagtgaccacgtggtcactgtcattgacgcacacactgcagaagccatcacatgtggtatgcacggctggacctaaaactacagagcaggatgtgggctgtggggacagactgtccccggggctccagccacagcctggagcagtcctgggatgcttttccccagcactcatgtcaacatgctcctcctctgtcacggccaaggccaggcctgtggcatctgtttgcacaaaggcttgtcagaggccaggggggcccaggcctgccgccctcctgaagtcctccaagctgcctcaggcagctgcgtactgactgtagggctacctgccgcacgactgtctggagtgtgtgctccgaatgccagtttccgggctccatctgaggcattttgccagttgccctgggactctgttttttttttttttttcaagacagagtctcactttgttgcccaggctggagtgtaatggcacggtctcggctcactgcaacttccgcctccccggttcaagcgattcttctgcctcagtctcccaagtaactgggattacaggtgtgtgccaccatgcctggctaatttttgtattcttagtagagatggggtttcaccatattagccaggctggtctcgaactcctgacctcgtgatccgcccacctcagcctcccaaagtgcagggattacgggcgtgagccactgcgcccggccgggactctgcattttcaacaaactccaggaacacactctggtggacaccaagggtcctccctgatcctacccagagtaccatgtagttgctggacagagaagaaagctgcagccaccaagtgcccctctggcctcctcccgcctctgcctttccttcctggactttccatcacctggctgtgggtacccagtgttgcagttctgggattgccaacctcccccaaaagcctatccatgtgcctgaggggagggactcacctgggcaggccgctggggcacgagaggagggaccagcctggccgtgtagaagtcctccatggcccaggccccagtcagtgcgctgccctcccacagaaagctctgcttgcgttcaggtggaggaggacactggcccgctctttcccacccttcctttaaaatcctgctggcaggaagtggtggcgtgctagacaattccacttcctcagagaggagcagggccacacggtcctctatctgtcggcctgtggtttcagagtcctggactaacaacaatgggggggataccgggggtttcttcttgcgacttttattctctagagagaaacaaaagcgacaccatcaacggtggagtcggtccactcacccgggacctgctgatggcctctcccagggtcactcttctgatcacacaaacctgcttctggtcttatcctctcagaaaaggcactttccagcctgagcgctggtacagccgcacccggctccatctccgaccgggacagagccatggccaccagcaggtcctcggacggtgcctcgtccaccttccgcctcttccgtggctccttcttgctggtgggtcctctccgtttcagacctctactgtgatcactgaagctagaaaacagccaaagagaaaagttactggggctagaggagtgcacgcttctcaggttggtcacactggtctggagagggctgggcctgagagaaaagtgacggatgtggacctgccaggcagatgcgtcccccacttccactgccttgtgtgaactcattcaattccaggccagaagttcaacatggcccaggcacaggagggtctgggttccttcacgtgctgctgtccagcaggctcatggcagatgtacggagccatctgtggtacctgcacatcctcatgtggccaagcccatccaatggagtcaacaatcgatggctctgagcaggctccctggactcccaccaccttcacccatcaatacttccgatgctccttacacggtcctggccacaccggcagaaaaggatcccttccctcctgcaagggctccacggcagtgcctctgtccatggccagaaggaagggcttcccagcttaggctgccgatggtcaacattataccagccgccccgggactctgcactttcaacgggcagcagctcgtttggtttggaggaaatgaacaggagtttccggctggagagaacctaggctgcctgggtgactcccaataagctgggcaagaaggaggagggcagaggtgacaaaggaacttagcacaaaccgggcccaccttccctgcaatgcagtcatgcctctggcttttgcaaaagctcatgctctccagggtgccagggatggctcaagttcaccttcccaggaacgtggataatcacagcctcccagagggaaaggagctgcctgggcagcctgggaccctgcttctgtgaagggaacacagactgtgttccctcctcactccccagcaggccaggtttgggctgtggggaaagaatatgaggcactctggccggggcatgcgttctgatgaccacaggcttggcctttggggagggaggggttcaaagaccccatgagggcatccagctcctgtagttttctactctgacaaccttctaaacggatccacatacatctagtttcagtacttggaggtattctaaaggcagacatactttatctgagcaggtgcttttggcgtggtcctgccaagaaagaaacaatggcttagatgacgtctattctaaggcctcaaggcttgcacccctgccatgctaaatacagatgcgctcctccaccaagagaatcccctctgccctctgccatctcagccccgagccagctcagctgcccatgacctgtgtgcaaagcagggggcgggacaaacagctatcgcctttggccttccctttgctcctgacagcggtctcaaacctggaggagtcaaaggtccaagatgcctttgttcactatgaacctggtgtcagctctagcgtcctcagcagcagggcagcgtggagcagggccagccctctggcacttgtgtggctgtggtttgcatgctgaggacttgtttcctggctgtgagcaaggcaactcattttaacttttaagcattaattcatgcaagatttttaaaaaatagggtcctacacttctgttgcaccaactttgttgttgtttttgtttgttttatgaagacaggttcttgccctgtcgcccaggctggagtgcagtggtgcaatcacagctcattgcaaccttggcctcccaggctcaagtgatccttccgcctcagcctcccacgtagctgggactacaggtgtgcagcaccacagccagctaattttttaattttttgtagtgatgggtcttgctatgtagtccaggctggccttgaactcctgggctcaagtgatccttccgccctggcctcccaaagtattgagattacaggtgtaagctaccgtgcctggccaatcaccaaatctgtgaactgtgctgagtaatcttatgttaacagtgtgaaaactggactgtgctgaggtggaaaccatgctgtccaacaacgaaatggatggagtaaagtgactaccaaattcttagatgtggtaaagcagtagtccccaacctttttggtaccaggaactggtttcatggaagacaatttttccatgggacaggagtaggggaatggtttcagcatcaaagcattccacctcagatcatcaggctttagattttcataaggagagctcaacctagattccatgcatgtgcggctcacaacagggtttgtgttcctgtgagtctaatgccaccactgatctgacaggaggcggagctcaggcagtaaagcttgcctgcccgctgctcacctcctgctgtgtggccaggttcctaacaggccacagaccggtactggtccgaggctggggggttggggacccctgcactagagggtaccgactgtgggatcatgggattggaaactcaggaaggaccttgaggaaaacagtgcgaagatcatttctgcacccccctaaaggggcaggtccagagccttccagaatgcagattctgtcccctcctcactcccttctagactgtgcccgatttccgccctaagtgtttcatttccagaatcaaagagggctctttttccctccaacactataaaaagctttttttttttttttttttttttttttttggagacaggatctcactctgtccaggctggagtgcagtggtacgatcttggctcactgcaacctctaccttctgggttcaagtgattctcctgcctcagcctcccaagtagctgggactacaggcatgtgccaccatgctaatttttgtatttttagtagagacgagattgtaccatgtcggccaggctggtatcgaactcctgatctaaggtgatctgcccaccttggcctcccaaagtgctgcgattacaggtgtgaactactgcgtccagcccataaaaagcttttttaaatagaaaaagccctgagtgcacacagcattatttggcttggttttcttccttttcgtcgacttacctgaacatgggtgggctgctgctaccctcaggctgtgctgtctgcagccgcacagcctgaagcaggagctgggggccaacctccatcttcacagcacactgcttcaagtgactggttctgctctttaaggtaagaaacggtttcccacaaatcgggcactcagggatctgaggcacagaaggtcttagtgtcttttcagcttcatccaagcacctgaaggaaaacagtcaatacaggagaaccaccctccccaggaatgtggattggagcaaatgtgggtccaggtcaacacagacgtgctgtggtcaaagcaagttccccaaagccaatcccctctacacagcctggctccgtctcccggcagtcagcccctagacactacacttaggtatctgtcagcaaagttggctaaagaaagcaaggaaagattaaatgcagttacatgatgacttagaaattccactcctaagtagagaccccaaagaactgaaagcaggtacccaaacaaatacatgaaacccatgttcacggcagctctatccacaatcccaaagggtagaaatgctccaaatgtccgccaatggacgaaaggataaaccatggtcatattcctcatctaagaatgggaaaaacacagtctagccatacaatgagatactgctcagccataaaaaggaatgaagcctgctccatgctacaacatggatgaacctcaaaaacaacatattaagtcaaagaaggcagacacaaaaggacaactgtgcaatttcagaatcggcaaatccatccagacagaatgttgattagtggttgtcaggggagagaggggcaatagggagtggctgccaatgggtgtggggattcttttgggggtgatgaaaataatccagaagtgattgtggtgacagttgcccaactgtgtgaatatcccaaaagtagtgatttgttcagtttaaatgggtgaactatatgttctgtgaattgtatctcaacgaagttatttttaaaaaggggtaggttgacaacaaagctgaggtgctgttgtcatggtaaggtgtggagatccgcactccagccctggggtgcttggggattctggtcacatacacgggagaggcgacggcccaagctgcccccacctgttcacatgctgttcccttcgggtcacgttcatggctgagaggttcttttgacaaatctggcagaagaacaaacccttttcctccaggctatcatcatgtgccgatgctcctacccgtgcaaactcctgctgcagggtcaaggccaccgcagcgtcgctctctggggcagggggcccaagcccatacactgtggagaagcaccaaagatccgtgagaataaactccaaagacaagctcaccctcagacctctgctctgtcagctcctgcagaccatggggagcaggtggaacgcaaagaaaccagaacccagctccactctgcaggctggtgacttggacactgtccagtgagactgggcactaatcagcactccgggaacagccgtctccaactttaacatggatatgcattacctgggaagcttgtcgacactcagattcaaattcaaggggtccaggtgcagcctgagactctccgcatttctagcagcctccaggcttggcgatgctggcagcacaggaccactctgagtagcaaggacctaaactttcccacttctgctgaagttggctacctcgggcattgcaagttcacaaggctcatattccaacaaagctagatgttctcttcaaaactcaccctttcctgctgaccttttactgcccatgataaaaccagggcagagtgaaatgcctttggcgtttaaaaggcagcatctcttacttagcatcagactcaagaatggactgattctggtcttgagatggctcccagggtggcccatctgatattgctggagcagacccctgtcactcacaagggatatgccctgaacgcctcataaatccccaagttcttcatggctgtggcctaccagtgcctgccactgaggccagcaaaacagcacaccttcattttggtgccctgttttgtttgtttgtttgtttttgagatggagtctcacactctgtcgccaggctggagtgcaacgacgcgatctcagctcactgcaacctctgcctcccgggtccaagcgattctcctgcctcagcctcctgagtagctgggattacaggtgcccaccacacctggctaatttttagtagagacagggcttcaccatgttggccagggtggtcctgaattcctgacctcaggtgatctgcccgccttggcctccccaaagtgctgggattacaggcgtgagccaccgcgtccagcctggtttggtttcttaacaaacaaatggtttatctctttctgagcacttgctgggtgtgatgtgaagatacagagagaactgagtcaaatgctgggcaggggcggagctcacaccagctgggtgcctcctctgcaactcacatgtgcgtccaggactgatgcctcggcaggacatcaaatcactgcctgctgtggaccctggggtggcctgagactcctccgtgctactgcagtgaaatctgcaatgcaatgccaagatcctgcatacttattagctgtaggtctgccgataatggtttcttcctatttcttttccttttgtatattttcatcagagatgagaatccatattgttttggggatggagaacaggagcacctggcattattacgcttattgggccggtgccacaccaagtacacagcagctatggggcactgtcgccaccctgtctcacctgcagccaatgagcctctaatctactcagagtggggcaacccaatggttagaggaaggagttaacgatcccataaagaaataaatccagaaagtgggaaatcttataatacaattagcctagcctcttcaaaaactcagtgtcatagggctgggtgtggtggttcacacctgtaatcctagcactttgggaggctgaggagggcagatcccctgagctcaggagttcaagaccagcctgggcaacatggtgaaaccccatttctagtaaaaatacaaaaaaattagccgggtgtggtggtgggtgcttgtaatcccagctactcaggaggccgaggcacgagaatagcttgaacctgggaggcagaggttgcagtgaaccgagattgtgccactgcactctagccaagcctctgtcaaaaaaaaaaaaaaaaaaagtcagtgtcatggaaaacaaaaggaaatgggggactattctagaatctagaccttaggatactgctgagctacagcaatatgcagtgtgtgaacttactgaatccttgttcagaaaaaaaagaaaccagctacaaaaaataaccttgagacaaccagggaaatttgagtttgaactggacgccaggcactattatggaattaagcgtgctaatggtattgtggttatgcagcagaatctaggggtaaaggatcctaatgtctataatttaccttcagataatatggaagaaaaatatgtacgcttggctaggcacggtggctcacgtctgtaatcccagcactttgggagactgaggtggacagatcacaaggtcaggagttccagaacagcctggccggcatggtgaaaccccaactctactaaaaatacaaaaattagctggacgtggtggtgcatgcctgtagtcccagcttcctggaagctgaggcaggagaatggcttgaacccaggaggtggagtttgcagtgagccgagattgcgccactgcaccccaacctgggagacagaccaagactccatctcaaaaaaaaaaaaaaatgtatatttataaagacataaacaaatggccaaatgttaacatttgttaaatctagattgaggtataggggattaggggattcattgtaatttttttttttttttttttgagacagggtctcactctgttgccctggagtgcaatgatgcaatcacagctcactgcagctcaacgtcctgggctcaagcaatcctcccacctcagcctcccgagtagctgggactacagttgtgcaccatcatgcccagctaattaaaaaaaaatttttttttgagtcagagtcttgctctgttgcccaggctggagtgcagtggtgcaatctcggctcactgcaagctctgtctcccaggttcacgccattctcctgcctcagcctcccgagtagctgggactacaggcacccaccaccataccttgctaattttttgtatttttcatagagatggggtttcactgtgttagccaggatggtctcaatctcctgaccttgtgatctgcgcacctcggcctcccaaagtgctggcattacaggcgtgagccaccacgcctggcccctaaaatttttttgtagagatgggggtctcactatgttgtccaggctggtctcgaacttgtgacctcaagtagtcctcctgccttggcctcccaaagttttgggattataggcatgagccatcatgcctggcttcattgtaattaaaacaacaacaacaaaaaaaccttttctgaaaggaagagttctttgtgaatactgagggttatctttttaaaaggaaaaaactgaaagggaaagctttcataataaaaagtcataatttttaaaaaaaggaggccaggcacagtggctcacgcctgtaatcccagcactttgggaggccaaggcgggtggatcacgaggtcaggagatcgagaccatcctggctaacaaggtgaaaccttgtctctactaaaaatacaaaaaattagccaggcgtggtggtgggagcctgtagtcccagctactcgggaggctgaggcaggagaatggcgtgaacctgggaggtggagcttgcagtgagctaatatcgtgccactgcactccagcctgggtgacggagcgagactccatctcaaaaaaaaaaaaaaaaaaaaaaaaggaagagggccaggtgcaatggttcacgcctgtaatcccagcactttggggagctgaggtaggcagatcacttgaggtcaggagttcgagaccagcctggccaacttggcgaaaccctgtctctactaaaaatacaaaaattggccaggtgtggtggcacacgtctgtaatcccactggctggggcaagataattgcttgaacctgggaggcggaggttgcagtgagctgagatcatgtcactgcactccagcctgggtgacagagcaaggctctgtctcagaaaaaaaaacaaaacggtaccttatcaaggaagctaggtgggaaatgatcccagagactcttcattctctggctggatccagtgaagtggcaaaggtaaaacatcaagcagagagcctatccacagaagaaactcaacaaatgctgattccttcccgcctcccttcctcagagttgtattaacttatctctgtgtggaagacagaaacacactcatcataccattccccgccatcatctcctcttgaggatcctttgggacattttcttcccgcgcagcctcgagggagcactcttctgaagcgtgtctcaaacgctcggggtctgctctcttgaactgctgcattcgctgtaggaccaattgtgctgtgcggggtttggagggacttggcactgctgttgtcaaacaggaaggaggaggctgggagtcgctgttgggcacattctctggcaaggaggaaaatattcacaaccatctgttgtagctggagaaataaaagacttttctaccagatacaggttagacgcaagtttcaagagtcctttatcaactagtttaggtttgactcacaaatgtgaagaggactggttgcttgttggtaacctctttgtttatggcaatatagacataaatatcaataacaggaggggaatgggatgtgactgctaatgagcatggggtttatttttaggatgataaaactgttctaacgttaggtagtggtggtggttggacaagtctgtgaatatactaaaaaccactgaaccatacccttttaaatggtgaattttatggaatatcaattataccccaataaagctattattaaagaaatattaatgacaaaggtttatgtcctagatcagttcttctttaacttgggatccacggatgatcttcagtggggatccatgaaccccatgaagttgtgtgccagttttgcagatacgcgcatggatacgtgttttgggggaaccatgcatagatttcatccgactggcaaagagcacgagagaccagtaaagttggtgaggcaacactgctgatgccttccagtagtctatgcgacctgagactctaccaccactctactgagaggttattaagatcaggaagtgagggcaaaggaaatttagaaacagaactcaggagctcagagagcccatggtgtattatatatgcaagggtagttttcagttttgcatgaagaatgtgtagtaagcatatagctcagtataccaagggcagcagggcaagaaaactgctttaaacagttaaaaaattatccaggcacggtggtgggtgcctgtggtcccagctactcgggaggctgaggcagggaggactgcttgaacctgggaggtcaaggctgcagtaagctatgatagcaccactgcactccagcctgggtgagagaccaagatcctgtctctaaaaactaagtaagtaaataaatcaataacaataacaaaggaaaagattaaaaggtcttcagagagagaaagaaagaacctgaagattctcctgggacttgagcccacacagagtcctcatgcggccctctcagcagcctatccaaattggctggcccagtccaacttacccactttggaataaattcaagaaaacaagagaagcagcattattgtgttgtttgtgtaactcatgtcaatcatataacagaatttcataggaaattctgaaagagcagaggactccaaacacaatcatgtgaaaaattcacacgggttatgtttttcttgactgttgtttaaaccaggagtcagccgggcgcagtggcttacgcctgtaatcccagcactctgagaggctgaggcacgaggattgcttgagtccaggagttcaagaccagcctgggcaacatagtgagacctccagctctaaatttttttttaagcttaaaaattaaaaaataaaaacaaaccaaaagttagcaaactacggtcatgtggctggctgcctgtttttgtaaataaagttttactggcatatggccatgcctgttcatttacatattgtccacgcctgctttctcactatgacagcagagttgagtagttgtgacagagtctgtgtggcctacaaagccaaaatatttacgatctggccctttccaggaagttttccagcccctggtttaaaagagtacaaattacctctggttttctctctggaaaggtttggcgatggttcttgctggttacccgtctgggtgttttgtgctgtttcccggagcacaggtggatctggagcagaggcaagcacacccccctccccattcacagagtgggccggttcacttgcttgccatttggttaccctttgctttttagtcctaggggcctggctgccagacggaggtttcttctctgcagggccttgaagggttttggtcttggtagcagtttgtttggtccttttcaatttgcttcttatctgagtgccgtttgaggcagccttttgtgtcttcctttctcctgacacttccttgattccatgttttttcaccctttggaaaaagctagcgcagagttctttaaagtcctcatcagactcatccatcatctgaccagttttaaggctttcaggctggtcttcagaggagcgagggtcaatcccaggacaggcagacagatgagaaagtgaacccaagtagaagcctagctgagcctcattcacactcagtttcattagggttcttctctacttctccattagatacttggagagtttgcacaattgaacaaaaagtactgttttcctctctataatgattgaagtatctttgttcaaattgggcctgtggttaaacatgtttaaagcttccctctgttaaagtccacaactgggccgggcgcggtggctcacacttgtaatcccagctcttttggaggacgaggcggggggtggatcacctgaggtcagaagttcgagaccagcctggccaatatggtgaaacctcgtttcaactgaaaatacaaaaaattggccaggcgtggtagcagatgcctgtaatcccagctactcgggaggcagaggcaagagaatcgcttgaacctgggaggcggagattgcagtgagccgagatcgtgccactgcactctaacctgggcaacaagagcaaaactctgtctcaaaaaataataataataaataaataaagttcacaactgaaagagtgttttgttgtccaatagatgcctctgagatcgaatacatatgaacctggtgctcagataattctccaagatctccatgatgatgaaacatatatggttcacttaattacacatctgtggaaaaccaaaagcatgtaagtgtaatcagacattgtcattttatgccagttcttccagggagggacaagggcatgtggggtgagggaaaagtcttcggagtaacaatactgtcaaatactcagtccagcctggttaacatggtctaaccgtcctatcagacatcacaacaaaaggacctagaaacctgtcaaagcatgttgttcttccacaggtattaaaatatgtgcatcttgggagagtgttttcttaactgaaatttagggagcaaaccccataaaaggcagtcaccacagaaacaggatgatccccaaatctaggaaaactatctcctacactgatctaagacccctggctgttaaagaggctctttctgtaaatactgcaacataagagacagaaagagacattatattctcatgaacactcaggagagaaaaggtcacttttacttatcttctcaacccagcaaggctctccaaacctggatgactggaatgtcgcctgtgtgcaaaggctgggcctcgtgagcatggttgtttactttggcacacagctaagtggggttcaaaaatcaaaactgaatgacccaatggcagaaagttattcctttcaaatacaataatgcaatctccactgtccaaggaatctaattaatcattttgttttccagagctgaaaatactcctacctagaatctactttgtatggctggcgcattctcttctgtgtcttccccttagagaagtgtcctctaatcctttatggaccgtctccatccccgttaatccctatcatcgcccactgttttcacaatggcatctgtcataggttatcatcatatgaaacaggtaatatctatcgaatgcttactgtgtgccaagcactgttccaattgctttccaagtcaaactcgtttaatccttacaagaagcctatatggtggaatctcttgtcatcctgtctttacggcaaggaaacacgcgcaagcagaatgaggaactggcctaaagccagttcaggaacagctttcacagtggcagggctgggatcaaacccaggaagtgtggttcgaaactatccgctcttgtgtttttattcatcggcttattatctgtcccccattaagctcaacacttcaggagggtagagatccatctattactttgcaacctctttggctgatctggtgcctgacttgaaataagtgctccacaactacttgttgaattcatgaattgcaaagagttcggtataatgggagtagagagaaaggtgtaggagaaaacgctgcggggagaggaaaggattggctcacaagggcctggaaggtcaggctaggcaaagtgaattttatcctgttggatgcggggagcggctggaacaaattccacctccacaactgtgttgatctccgcatctctgttgatatgaacctcacaacagtctatctcctcctataggtgcccagtcaagatttactgaatgacataacggatcctgcaagcctgcaggtttccagagggaaggggacttgtgcctccttgcttcgtacctaccgcagcccacggctcacagcaggcgagggatgaatgaatggatcggtaaggggcggaccctcccgcttcccccaacccggcgacctacggaaaggggctgaggggttccccgtctgggaaaagggctgccaaagactctaacggctctaaagtcagacggagaaccccgatccccggactggcccggacggagaccaccgtggggatccggatccgccaccctcctccctccaggcgggccccggcccctctccacccgagtgcggctcctgcctctccgtcggggctgcgggcctgccgaggccacggagccagcgagggagacgggcgagaaaggctcttctcccttaggaaagagagaacggcccgaaatgacaggacctccgcctcccgggtgccgactcccagccccacagcccggctcctcctacctccggcgccgccgcggcaccttcttaacggagactcgcgcgcctgcgcatgcgccgcccgcgcccccgcggagcattgcctgcgcgcaggcgcagagcgggcgcgcgcggtggtgcggcagcctcgcttccggtcttcctctgcggcgccgggcgcgggcccgcggcggccagcgcttccggtcggcaggaggcggggcgaggcggaagcggcgcttgcttcaggtggagtctgttagtttttgagaaagagttagggcgagtttaaggcactgtggcagctgtgagataaagtctggttcctccccagctggctcaggaaatgttcgcggatacaacggcggccccctctgggcatacctgcctgtggagcggagagtggacggtgtgagggggaccgggagaggcaccaaatctggcctgggggcccgagaagcttcctctcaggtggggtggcgtgagagtcgaggcctggaggtcggggagggttagctacgtgaagaggggattctgccgcgcttcaggtgcctggaggggatgcccgagctcttccgcagggctagggtgaagccagccagggcctgggggaaaggtagcagaggtttgccatggcttggtatttgagggactttacacatcgtattaagggtttgagcttcaacttggggtcgtcgggagccattgaaggttttttgttgtttgttttttgagacggggttttgctcttgttgcccaggctggggtgcagtggcgcgatctcggctcactgcaacctctgtctcccgggttcgagcggttcttgtgcctcaccttcccaagtagctgggattacaggcgccagtcaccacgcccagctaatttttgtgtttttagtagagactaggtttcactctgttgcccaggctggtctccaactcctgacctcaggtgatccgcccgcctcggcctcccaaagtggtgggattacaggcgtgagccaccgctcacggctttttttttttttttttttaagtagagacgggcggtgggggcgggggggggagtctcactatgttgcccaggctggtctcgagccctggccgcaagagatcctcccgcctcggcctcccaaagcgctgagattacaggcgtgagccaccacgcccggcgtaagattttgtttttaaaggcctaattacagtgagaacagatgaggcaaggacacccattaggaggctattacataatctagatgaaaagtgagagcggcccgaattaggaggtggagcgaaaagaatggagaaatatggagcatagtcaagacgcagttgttaacgatttgccggtttctggccttaacatctgagagtagtgtgcctccagtcactgaaataatgaacacaggagaggtgtaaaggaatcagtttgcagggcagacaatatgttttttaaaagatacagtatcataaaatgcacactagaagtgtacattcagtggtttccagtacgttcacaggatttgcagccatcgtcgctaattccagaacgttttaaaaccccaaatcgaacctgccgtacccattcgtagtcactccgcaattcccccgaccccatcccctggcaatcacttatcggctttctgtctctgtggttttgcgtattcagtacattttatgtaaatgggatcatgtgatacttggctttttctgctgggcttttattaagcatgttttcaagatttcatccatgtagatgaatcagtactgcatgccttttcatggctgcataatcacgtgtttggatggaccatgttttgtttatccatgtatcaggtgatgggcatatggatgtttttactttttggctgttagaaataatgctgctatgaacattcgtgttcataacacaagtttttgtgttctaggagtggaattactgggtaagactacatttgattctgaatgttgagcttcaaaaccttccaagaggttttccttgatgaaggatttaggaggtgtttacttgctctctggcttggaaatctaagttagtttgtaatatggtttccaactggataaagaagacagaacaagaatgataagcagcccagaggcaagggtagggcagggtgtcttgggacttgaatttatagaggagactgagtgacgacatggagaggccagtgctgttgaaataatttctctttccttccttcccttccttgcttcgttttcgacggagtttggctcttgttgcccaggctggagcgcagtggtgtgtgcaacctccacttccctggttcaagcgattctcctgcctcagcctccggagtagctgggattacaggcgcccgcaaccgcgcctggctaatttttttttttttttttttttttggacaaaatctcgctctgttgcccaggctggaatgcagtggtgtgatctcggctcactgcaagctctgcttcccgggttcacgccattctcctgccgcagtctcccgaatacctgggactacaggcgcccgccaccacacctggctaattttttgtatttttagtagagacggggtttcaccatattagccaggatggtctcgatttcctgacctcgtgatctgcccgccttggcctcccagagtgctgggattacaggtgtgagccaccgcgcccggcgtaattttttgtatttctagtagagacggggtttcaccatgttggccaggctggtctcaaactcctgacatcaggcgggcgatcttcctgcctggacctcccaaagggctgggattactggtgtgagccaccgcgcctggcctgaaataatttacttacatttctcaagaaaaggaggcgtgccaccacgttcagagccacaagggagacatcagcttttggttaggaggaagaaataggaacaaggagaaagtctaggccagaacctttatggggttcctcagaaatagcaagtcagggcggagtaaacattttaggattggataatttaaataattccatcacgctttgcctttgggtggtctctagttgcttggtacctggccatggatgatttagggcaggagaaatactggcttggtgtgtgagagttagataaaggggggaggctgacttgcctgtgagaggcatgctcccaagtaagttgtttactgtcttgaggaattagacctgggagaggcagtctccctgccagcaagatttattaagatttcaaaatatcataggatacagaaaatttttttaaacatctaataaacatggacatggctgggttatgaaggataattgtaatggtagaaattactgttttccagtcagactgaaaatgaagtgcctgtttcctatttaggatttaaatctcttagagtcctggtgaagaaagtctttgctacctctctcccccaaccccaaatctggctatattatttatttacataaaataaattagttgaagtgtggtttagaaaagagagttttcttaaacctgagattctcaactgaatcacctgtggaattttttttttttaattggaaaggctgggacactactcttaggcctactgaataaatctttcaacctgtgtcttttgaaagtttcacagatgattctgatggtctcaagattgagaagcactgcatttaaccagcaccaactgaacaaacactgtaggctaagtataagagagatggcaagagctgggtcagggtggtgcatgggatttccaattatacataattcctcccttcaatgaacaaagccatccataactggggcacctgcttctttgggctaaaggtgaacaatggcagccaccttgtcctggaccctattgtgactgttactccagcagaagccctggggttcatgctgttagttagaagtcacccagtatgactaagttgaggggcagtgttcagaaacagtgttactagatggatgttatttcagtaggaacagtattgtgtgttccctgtcagcatttgaggcggaaacccactgcactgtcagaacaaccagggagatgaaagaagatgtcagatactaaaaggtgcagacagtccttgtgtttggtaaaccttacagggtttatctgaaagagaaaatggatgcagaagtacatgaaaaaactgtgttattccaaatagatgtgctgttttcccagttcataggagtcggtaatttttgggttcagggcaaaaaggcaaaggttgaagatgctgtgatgatcacgtccttaccctcctggaatatttcctttttgaaagcttctggcatcttccactgagttcatgttttaaacagttgggaggatgaattgaagggcccttatcccaggtctgtggtttgattataaatggtaaagccataacctgtccacctccctctcctttatcttgacaggggttggggagacagcagattgaacaaggaaagaattgtctcctgagttctttgatcatgttaacttttatttactgttgtatagtcacattttctagactgctaaaattggtgaaatcaggacaggaaataactgtttttacgtgtataagtatacaaaagttattcgagatgagttacactgcatttctttcagtgtgctgcctgccactgctgcctttgtgtgattttgctctatatgttctgctagacaaatttaagggaggtttcagacagcaaaactccccccaaagcatctaccagcataatccctatcaaaatcccaacaacgttttaatttttttgcagaagtggaaaaaccgatgttaaaattcatatggaattggccgggtgcggtggctcacgcctgtaatcccggcattttgggagtctgagtcaggcagatcacttgaggtcaggagttcgagaccagcctgaccaacatggtgaaaccccatgtctactaaaaatataaaaattagccggatgtggtggcaggtacctgtaatcccagctacttggaaggctgaggcgggagaatcccttgaacccaggagatggaggttgcagtgatccaagatcacaacactgcactccagcctgggtgatacagtgagactgtgtctcaaataaataaattaaataaataaataaataaattcatatgtaattgcaaggggctcttaatacccaaaacccaaatagccactttgttctttttcaagaacgtacttccttatatcaaaacttattacaagctatagtaatcaagactgtgtggtactgtaccagcataaggatagacatatgggtcagtggaagagaattgagagtctagaaataaacccttatatttatgagcaattgattttgtccgggatgccaagactagtcaatggtgaaagagtagtgtcttccacaaatggagctgggataacaggatatcacatgcaaaagaatgaagttagacccttacctcatatcatgtacaaatattaactcagaatggatcaaagacccaatggaagagtgaaaactataaaactcttagaagaatacaagggtaggctgggcgtggtggctcacccctgtaatcccagcacttttggcatcaccagaggtcaggagtttgagaccagcctgaccaacgtggagaaaccccgtctgtactaaaaatacaaaattagcagggcgtggtggtgtgcgcccgtaatcccagctactcgggaggctgaggcaggagaatcgcttgaacccgggagatggaggttgcggtgagccgagatcgcaccactacgctccagcctagtcaacaagagcgaaactccatctcaaaaaaaaaaaaaaaaaaaaaaaaaaagaatactacaagggtaaatctttatgaccttggagttggcagtagactctagatatgacactaaaagcagaaacaacaaaaaataatgaattggatttaatcaaaattaaaaacttttttgtgtaaaagtatactatcaagaaaatgagaagacaacccacagaatgggagatatttgttaatcatatacctgataagaatctatgctgctgtctaaatgtttatgtctccccccacccaattcatatgtgaaggcctcaaccgcaaggtgatgggattagtgcataaggataaggatggaggcccttgtggccatgtgtggtggctcatgccggtaatcccagcactttggaaggcggaggcgggaggattgcttgggcccaggagtttgagaccagcctgggcagcaaggtgagactccatttttacaaaaatttttttaaaaaaagaaaagaggcccaagagagaaaccccctaccctttctgccattagaggaagtgggccttcaccagacagagtctgccaacaccttgatcttggacttcccagcctccagaacagtgagaatttctgttgtttattagctacccagtctgtggtattttgtaagagcagcccaaatggactaagacattctagtagcacaatatagaaagaacttttacaactcaatgaaaagacaactcagaaaatgggcatggtagaacttgtcctgtgaagaagccaagaccaaaaaaaaaaaaaaaaaatggacataggacttgaatagacattccaaagagtggcaggtgccaacaagcacatgaaaagatgatcagcatcatgaatcgttagagaagtgcaaattgaaactgcagtgagataccacttcatggccagtaggacagccatttcctaaaaaaaaaaaaaaaaaagtattggtgaggatgtaaggaagttagaactctgatacattgctggagggaatgtaaaatggtacagctgctgtgggaaacagtttgaggttcctgaacaagttaaagataaaatcatcatatgattcagcaattccgcttctaaggatatgtcccaaaaaattgaaaaagtgtttaagggccaggcgcggtggctcacgcccgtaatcccagcactttgggaggccaaggcgggcggattacctctggtcaggagtttgagaccagcttggccaatatggtgaaaccccgtctctactaaaactataaaaattagccgggcttggtggtgggtgcctgaatcccaactactcgggaggctgaggcaggagaatcacttgaacctgggaggcagagtttatggtgagctgagatggtgccattgcactccagcctgggcaacaagaatgaaactccgtcaaaaagaagaaatgctcaaacaaaaacgtgtacacctcatattcagtctaaatgcccttcagtgcatgaatgaacaaaatgtagtatagaatggaatacatgttacactgaacatttgcttatttccgttttgtaatttttttttagtgacaaggtctcatttctgttgcccaggctcgagtacagtggcacaatcatgactcatggcagcctcagactgccagggatcaagtgatctttctgatcttcccaacttccttatcttcctgactcagcctacctgtagctagagctagaagggcccctgggtaatttttttttttttgagacggggttacactctatcatccagaatggagtgcagtggggcaatctcagctcactgcaacctccacatcccaggctcaagtgatcctcctgcctcagcctccctagtagctgggactgcaggcatgtaaaaccacacctggctaattttttgtatttttagtagagaaagggttttgccatgttgcccaggctgatctcaaactcctgcgctcaagtgatctgcccaccttggcctcccaaagtgctgggattacaggcatgagccacaatgcctggcctgtgggtaattttctttctttcttttattttttatttttttttggagacagagtctcgctctgtcgcccaggccgaagtgcagtggtgtgatctcagcttactgcaagctctgcctcccagttgcatgccattctcctgcctcagcctcccgagtagctggggctacaggctcccgccaccacgcctagctccatttttgtatttttagtagagacagggtttcaccgtgttagccaggatggtctctatctgcggaccttgtgatctgcccacctcggcctcccaaagtgctgggattacaggcatgagccactgtgcctggccgcctgtaggtaattaaaaaaaaaattttttttgtagacacaggtcttgctatgttgcccaggatgatctcaaattcctgggctcaagtggttctcctgccttggcctcccaaagtgctgggattataggtgtgagccaccacgcctggccctcagtatttttaaaaattctaatttccatttacagctctactaaatatttcatcgagtcagcagattggttataaatataacgaaaattcatatgtatggcttttcttttttttttttttttgagacagagtcttgctctgtcacctaggctggagtgcagtggcataatctcgcctcactgcaacccccgcctccggggttcaagtgattctcttgcctcagcctcctgagtagctgggactacgggcatgcgccatcacgcctggccaatttttgtatttttagtagagatgaggtttcaccatgttggccaggctggtgttgaactcctgacctcaagtgatccacccgcatcggcttcccaaagcgctgggattacaggcatgagccacctcgccaggcctgtgtatggcttttcttttaaaaagtttacatgtcatatttaccacattacattcattgagtcacatcattcatcacatcatttagtcacgtgactgggtaacaagcatttcagagatcaaaaggcttcgtataattagtaaagaaaccttttatttatttatttagagacagagtactcagtgtgtcacccaggctggagtgcagcgtggcctgatcatagctcactgtaacttcgaggctgcagtgagctgtgatcatgccactctactttagcctgggtgacagagtgagaccctgtctcaaaaaaaaaaaaaaagtaattatactatgcatattgcatcatgagcatttctctaagtcagtagataggaagccatattatattccatatttaatcaaacattcccctgttgataaagatatatttatagtttttatcattatagattatgcaataaatgtctttgtacttataacctgtatgtgtgtgtttttatttcttttggaaggagtcctaaatctaggatttctaggctaaagggtatgtgtgttttgtttggtttgcctgatttttttttttaaaaagtttattatttattttgagacagagtcttactctgtcacccaggctggagtgcagtggcgcaatgccggctcactgcaacctccgctccccaggttcaagcgattctcctgcctcagcctccggagtagctgggattacaggcgcctgcaccacacctggttaatttttgtatttttagtagagacggggtttcaccatattgaccaggctgatcttgaactcctgacctcgtgatccacccgcctcagcctcccaaagtgctgggattacaggtgtgagccactgtgcccggcctattttatattttttttagagacagggttttgctgtcatccatgctagaatgcagtggcacgagcatagactcgaactcttgggctcagacaatcctcctgcctcagtatcccgagtagccaagagtacaagcgtgtgccaccacacccaactgacttttaaaaatttttgtagatatggggtcttgctatcttgcccaggctgatcttaaactcttagcctctggtgatcctcctgcctccaaaagtgctgggtttacaggtatgagccattgctcttgcctggtttacctgttttagaaaagaatacctgtacattgttaattttttttgtccaggagcttcagaagggtacaaaaattccctcctacttctggccccctgacctccaaactccctcatcagaggcttcttgaaatattccagataattctgtgcacatacaaatataaatatatatccctgcttttccccaatgtaaataaacggtagcacattttacccattgttctgaacctcgtttttgcaacttaatgaactgtcttggagatttttccttattacatataaatctatcattttgtttagcagttgcattatatgtcatcatttggatacattcatacttcattgtatcacctatcaagggacattagatggctttcatttccttctacaatggctaatggtgcattgaacatacttgtatatacttttatgcagatttgcacatatatttgtaggatattcctgtaacataagtggaattgctgggtcaaaggatatgggtaaatcagagtgttttggggtgttacccagttaccttctaaagaagccaaattggccaggcgtggtggctcatgcctgtaatgccagtactttgggagaccgaggcaggtggatcacttgaggtcaggagtttaagaacagcgtggccaacatgttgaaaccccgtctttactaaaaatataacattagctgggcatggtggcgcacccctgtaattccagctactccagagactgaggcaggagaatcgcttgaacccggaaggtggaggttgcagtgagccaagatcacaccactgtactccagcctaggtgacagagcaagactgaaaaaaaaaaaaaaaaaaacggaggctgaatcagtttccattccgttaacaatgaatgtctttttactcatatccacacactcacagaatatatcatgaaacattttgtcttttactatttcagcggttaaaaattggtgtcttgtagctttactttacatttctttcattgaggaaacgagtattttcttcacgtgattaaaagctacttgtttacctatgaccttatgtttgtgggctttgcattcttttagattgtgtgattaatctttttcctattggtttgtaagattatgtgattaatctttttcctattgatttgtaagaactctatattgtggaaatggatatagtgttacaatgttacagatagtttttaccagtttttatcatttgacttaaaaaaattttttttcttttttgaggtggagtctcaccatgttgcccaggctagacttgaactcctgggctcaagtgatccccctacttcagcctcccacgtagctgggactacacctatgtgctactgtacctggcttggctttgacttttaataaaattttttccatgtagagctttacagttttttgtagtaaaataacttttcttgtatgcacataccttcttccagtgtttgactcacctttacgttctcttaatgatgccttgtaatgaacaaaggttcttcaaagctggaggcatcacattacctgacttgaaattatactacaaggcctcttttgggagagtgaggggaaaggatttcttgagagcttgagaccagcctcggcaacatagtaagactccatctctaatgtacctgccccccacgtccccccaaaaaaattagctgggcatggtggtgcacacctgtggtcctagctactcatgcagtaactaaaacagcatggtacttgtacatatttttgtaccatagatcagtgggacagaatagagaacccagaagtaatgccacttgcctgcaaccaactgatcttcaataaagttgacaaatatgcagtgggggaaggacacgctattcaataaatagcgctgggaaaattggctaaccatatatagaaaaatgaaaccgtacctctatctctcaccgcatacaaaaattaactcaaagacttaaacataagacctgaaactctaaagatcttagaagaaaccctaggaaaaactcttctggatattagcctaggcaaagaatatatgactaagacctcaaaagcaaatgcaacaagaagaaaaataggcaaatgggacttaattaaatgaaaacacttctacacagcaaaagaaataacagagtaaatagacaacctatagaatgggagaaaatatttgcaaattaagcctctggcaaaggactaatacgtagtatctccaaggatctcaacaagaaaaaaaaacccattagtaagtgagcaaaggctgggcgtggtggctaacacctgtaatcccaggactttgggatgctgaggcaggaggatcacttgaggccaggaattagagagaaagtaggcaaaggacaagaacacatacttctcaagtgaagacatacaagcggcaaagaaacatgaaaaagtgctcacatcagtaatcatcagagaaatgcaaatcaaaaccacagtgagatatcatcttacactggtcagaatggctattattaaaaagtcaaaaaacaacagatgttggcatggatgcacagaaaaggaaatgcttatatgctgttaatgggactgtaaattactataacctctatatagaaaacagtatggaggccaggtgcggtggctcactacctgtaatcccagcactttgggaggctaaggcaggcggatcacttgagtgcaagaccagcctggccaacatggtgaaaccccgtctctactaaaaatacaaaaatcagctgggcgcggtagtgcacgcctgtaatcccaggaagctgaggcaggagaatcgcttgaacccgggaggcagaggtttcagtgaccttagactgtgccactgcattccagcctgggcgacagagtgagactctgtctcaaaaaaaaaaaaaaaaggttagtggcttttgtgtccttggttagcaaggtcttctctactttgagattataaagtaattttctgcatgttttcttctagagtttttatttttacattaaaattgttattggccagctgcgtaaggcacctggtggtgctctaggcactgggttagcgtcccttatgccgagctctaaaccttcagaatgcccttgccgcccctggctgagttcacagtggctgaagctgttcccataagaccctgaatctagcagccactgtgtactatacctggagcagtccaactgggtggactgtgctcagcatccgaacatctagacaggcaaagccattcccagtggtggcccaaaccagcaaacattgtgtaacaatttttttgcaatcaatttttcttttcttgttttttgagatggagtcttactttgtcgtcacccaggctggagtgcagtagtgggaacttgggtcactgcatcctctgcctcccaggctcaaacagtcctcccacctcagcctgtattctatttctgtagctgagaatataggtttcttccagcacacctggctaattttttattttattttttatttttagtagagatagggttttgccatgttgcccaggctcgtctcgaactgggctcaagtgatttgcttgccccagcctctcacagtctgagattacaggtgtgagccatcatgcccagcctgcagtttttcttattaaaacttaatgggggccgggggcagtggctcactcctgtaatcccagcactttgggaggcctaggcgggcggatcacctgaggttgggagttcaagaccagcctggccaacatggtgaaaccccgtctctactaaaatacaaaagttagccaggtgtggtggtgcatgcctgtaatcccagctacttgggaggctgaggcaggagaattgcttgagccctggaggcaggggttacagtgagccgagatcgtaccactgcattccagcctgggcaacagagtgagactctgtctccaaaacaaaaaacaataaaacaaactaatggggctaggcatgatgttatattcttgtagtctctgaaacttgggagactgagaagggagaattgcctgagcccatggttcaaggccagcctgggctgtgtagtgagacccatcgctgcaaaaaaaaaattgtttaaataaaattagccagcatggtagcacatgcctctactcccagctattcagtaggctgaaatgggatcgcttgagcccaggaggtcgaggctgcagtgaatcataatcgcctttctgcactccagcctgggcaacagagcaagaccctgtgtcaaaaaataaataaataaatgaaacggccaatatagaataaaggtgctaaaaaaggcataggagggaatcttcatgactttggggtaggcaaaaaattcttaaacagggacacaaaccactaaccataaagaagtgacaaattatgtgacattaaaattaagaacctttataaggcaccattaagagggtgtaaagggctgtgcatggtggctcatgcctgtaatcccaacacttcaggaggccgaggcagaaggatcgctttagcccaggagtttgagatcagactgagcaaaatagtgggaccctgtctgaacaaacaatttaaaaattagccgggtgtcagggcatgcgcctgtagtcccagctactctggaagctgaggtgggaagatcacttgagcctgagaagccaaggctatagtgagccgtgattctgccactgtactccagcctgggcagcagagcaagactctatctcaaaaagggtgtaaagataccacagactagaagatgtgtgtgatgtgcacgggactagtatcatatgcacaatgacaaaggattaatatctaaagaaatcctaaaaaaaaaaaaatagaaaaacaggcaagagacttgagtggccaacaggtatatgaagaagtgttcaacttatttagtcaaagaaaatgcaaattaaaccacagtgagtgatcactaaactcagcagcatgaacaaaatgaagataactgctagacaatagctagtgtggtaaggacttcctgtttgagccatggttatttagaagtatgttgcttaatatcaagtgtttggagagttccctcatttttctgttactggtttctagtttaattccattatggtcagagatcatactttatatgatttcaatttttaaaaatttgttttgtgacttttatggcttagaatatagtccatcttgagtgctccaagcttgaacacttgaaaacactatatatttctctgttgttaggtggagtgtcctctagatgtcagttagatccagttggttgatgatggtgttcaggttgctgattttctgtctactggttctatgtattgagaagtgttgaagtctccagctctgatagtggatttgtctgttcttcatttgtcagtttttgtttcatttattttgaatctcttttgttagatgcgtatgcacttaggattatgctgtcttgatgaattgaccttttttatcattatgtaatagccctcttttatttattttattttatgttttttagagacagggtcttgctatgtcacccaggctggagcacggtgatgtgatcaaaactcactgcagctttgaactcctgagctccagtgattctcctgcctccgtcttctgaggagctgggaccacaggcacatgccaccatgcttatttaaattttttttttttttttggtagagacagggtctccctatgttgcccatgctggtctgaaactcctagcctcaagtgatcctcccatgttggccaagtgctgagactacaggcgtgagccactgcacccagccctctttatcactggtaattttctttgctatgaagtctactttgcttgtttgacattaatatagccagtccagctgtcttttgattagtgtttgcatgacatatccttttttttttttttttagacagggtggtcttgctctgtcaccctggctggagtgcagtggcatgatcacggctcactgcagcattgaactctagctcaagccatcctcccacctaagcctcccgagtatgggactatgggtgtgtgccaccatggctgggtaattttattttttatttttttatagagacaaggcctcactatgttgctcaggcccgtctggaactcctgggctcaagtgatccttccacctcagtctcccaaagtgttacatgagccagtgcacctggcttgtctgtgttttcttttgtttcctatgactttgatatgatatccatgttcttttgcatgtggatatccagttttctcagcaacatttattaaaaagactatcttttccccgttgaatggtcttggcatccttgtcaaaatcatttgaccatatatgccaggatttatttctgggctgtcaactctattccaatagtctgtatgtctgtcttcctgccagtaccacattgttgtgattactgcagtttgttagtaagttttgaaatcaggaagtgtgaatcctgaatctgtttttctttttcaacatggtgttggctatctggggtccgtggagattccatatgaatttcagcatgtattttctatttctgcaaaaaaaaaaaaaaaaaaaaaaaagtcattgggattttgcttcagtttacatatgaatcagtagctcacttttgggagtattgacatcttaacaatattaagatatcttgtcttaacaatatcgtccaacccatgaaagtgtgatgtttttccttacttatatcttcattaatttctttcagcgatgttttgtagttttcattgtatgaatcttttacctccttggttaaaagtcctaggtattttattctttttaatgctattgtaagtggaattgtttttataatttccttttcaaattgttcagtgttagtatatagaaatgcaaatgatttttgtgtgctgactttgtatcctgctgctttgctgattctgttattgtaattattttttgtgtgtaatgtttaggcctagttttttacatatcatattaaatctgtgaattaattttacttttttctttccaatttggatatatatttttttcttaattgctatggctagaacttccagtactaggttaaatagtagtggtaaaggtgaatgttctcatcttagaagaaaattttttagtcattcactattgagtatgatgttcattcaatgtgcatttctgtttttttctttcttttttttttgagatggaatctcgctgtgtcgcccaggctggagtgcagtggcgcaatctcggctcattgcaaacctccgcctcccgggttcacgccattcttctgcctcaggctcccgaatagctgggactataggcgcccgccaccacgcccggctaatttttttgtatttttagtagagacggggtttcaccgtgttagccaggatggtctcgatctcctgacctcgtgatccgcccgcctcagcttcccaaagtgctgggattacaggcgtgagccaccgtgcctggctctgtttttttttttttctttaaaaacttttaggctgggcgcagtggctcacgccggtaatcccagcactttgggaagccgaggcgggcggatcacttgaggtcaggagtttgagactagcctggccaacatagtgaaaccctgtctctactaaaaatacaaacatttgccgggtgtgatggtgggcgcctgtaatcccagctacttgggaagctgaggcagaagaattgcttaaaccctggaggcggaggttgcagtgagccgagattgcgccactgcactccagcctgggcgacagagcaagactaagtctcaaaaaaaaaaaaaaaaaaaaaaattgtaataagctttctcgggtttaacaatgtaggtttttcaaatatggctttatgttgagatatttcccttgtacgtttagtttgttgaatgttttcattttgagagggtgttacattttgtcacatgcctttgctgcagcaattgagatgatgtgatatgtttcccattattccattaatgtggtatgttacattgaattttgtaggttggaccatccatgcatttcaggagtaaatcccacttgtttgtggtgtataatccttctaaaatgctactgaattcagtttgctagtatttgtagaggatttttgcatcattgtgcataagggatattagtctgtggttttattttattgaatgcctggttctgatatgagggtaatactggcctgttagaatgatttaggaagtatttcttactctccacttttttggaaaagttttgagaagggttggtactactagttgttgtttaaatgtttggtagaattaatcagtgaagccttcaggtccaggacttttcttaggagatttttgattactgattaaatctgcttactagttacaggtctcttcagcttttctgtttgtgatttagtcttggtaggggttttttaatttgtttttttgtttttaaaacagagtcttgctctgttatccaggctggagtgtagtggcacaatcttggctcactgcaacctctgcttcctgggttcaagcgattctcctgcttcagcctcccaagtagctggggctacaggcacccgccaccatgcgcggctaatttttgtatttttattttagtggagatgagattttaccatgttggccagactggtctcaaaatcctaaccgcaggtgatctgcccacctcggcctcccaaagtgctggcttgcaggcgtgagccaccacgcccagcccttgtttgttttttgttgtgtgtgtgtgtgtgtgtgtttgttgttgttttgttttttgttgtttttgttgttgttgtttttgagacggggtctcactttgttacccagactggagtgcagttgcgtgatcacagctcgctgcagcctcgacctcccaggctcaaaacgatcttcccaccttggcgccccaagtagctgggaccacaggcacacgccaccacacctggctaatttttgtacttttttgtagagacaggttttctccatgttgcccaggttggccttgaactccaaagctcagacatctgcccacctcagtctcccaaagtctgggattacgggcatgagccactgtttctggctatttctcccttcaattctgtcagttttgctttatatattttgatggtctgttattagttgtaatctgtttataattttatcttcttgctgtattgaacctttatataatgtccttttttaatcttttttttaaatttaaagtctcttttgtcttatagtaatagagccctgctctcttttggttagtgtttgcatggaatatgtttttccatcctttgactttcaatctagttgtgtctttggatctaaagtgattcttttttgtagtcccagttacttgggaggatgaggcaggaggattgcttaagcccaggagttcaaatctagcctgagcaacatagagagaccctgtctctctaaaaataaaagtaaaaataaaaaagtaagtttcttatagatggcatataattgggtaatgtagtttttttccacgttgccaatctctgtcttctgattggagagtttaatcaatttacacttagttactgatcaggaaagacttatgtcattttgctgtttcttttctatataccttataggattttatttatttatttttttagagatggagttttgctgtcacccaggctggagtgcagtggtgcaatcttggctcactgcaacctccgcctcctgagttcaagcgattctcctgcctcagcttcccaagtagctgggactacaggcgcatgccatcacacccagctaattttttgggtttttttgttggttttgtttttgagacagagtcttggtctgttgcccagactggagtgcagtggcaatcttgactcactgcaaccaacctctgcctcccagattcaaggaattttcctgcctcagcctccctagtagctgggactacaagtgccccccaccacacccagctaatttttgtatttttagtagagaaagggtttcaccatattggtcaggctggtctcgaactactaacctcaggtgatccacctgcctcggcctcccaaagtgctgagattacaggtgtgagccactgtgcccagccaccttataggtttttttgttttgttttgtttttaaattgagacggagtctcgctctgttgcccaggctggagtgcagtggcatgatctcaggtcactgcaacctctacctcccaggttcaagggatcgtcctgcctcagccccctagtagtgggattataagcacgcactaccatgcccggctaatttttgtgtttttagtagagatggggttttgccgtgttgggcaggctggtcttgaactcctgacctcaggtgatccacccacctcggcctcccaaagtgctgagattacaggcatgagccactgtacccggccatggattttaaaatctctaattacctgcattattgtcttcttttgtgtttagctggagttttgtaggttttcttttttctttttgtagtaacatgtttaactattttctcattttattttgtgtaacattgtaatttgaatttatagcagcgtaatttcagtaacatgcaaaaattctgcttctttatagcttcatctccacccctttcagttgtcacaaaattacattattatatactgtgtgtcccaaaacataaactcataattgtttaaatgcattagtctgctaaggcgtgttttatggacccgaatgtgatctatcttggtgaatgttccatgtgagctttagaggaatgtgtatcctgctgctgttggatgaagtgctctatagatgtcaattctgtctggttgcttgatggtgctgttgagttcattatgtccttactgattttctgcctgctggatctgtccactttgatagattgatgttgaagtttccaactataatagtgaattcatctgcttttccttgcagttcttagtttttgctttgaggattttgatgctctgttgttaggcgtatacacataaggtttgttacctcatcttagagaaatactcctttataattttgtaatgtcctttttctatccctgataattttccttgctctgaagtctgctctgcctgaaattagtatagccactgggactttctttttgattcctgctatgtctttttccatctctttaattttttctctcttttttttttttttaaagacgagagtttcactcttgttgcccaggctggagtgcagtagcttgatctcagctccctgcaacctccaactcctgggttcaagcaattctcctgcctcagcctcctaagtagctgagattacaggcatctgccaccatgcctgggtaatttttgtatttttagtaaagacggggttttaccatgttgtccaggctggtcttgaaatcctgacctcaggtgatccgcccgcctcagactcccaaagtgctggtattacaggagtgagcaactgtgcccagcctcatctctttaattgtaatctacctatgtttttatatttaaagtgagtttcctgggtcttcttttaacattttttgcaaggtggatttactgatgacaaattcccttaatttttgttcttctgagaaagtctttatttctgttcatttttgacccaacacatgcttgggtcttatttttgaatatattctgacattctctattacttatttgatgtatttagaacattgacatttaaagtgattattggtacagttagattaatatctgccatatttattactgttttctgttgcttttattcttcccttttctttttattttggtcttccactctttttctgctttctctggctttaattgaacattttatatgattacattttttcctctcttagcatgccaattatgcttcttattatatacttttaaaaagtcttggctgggcgcagtggcccatgcctgtaatcccagcactttgggaggccaaggtgggtggatcacctgaggtcaggagtttgagaccagccttgctaacatggtgaaaccccatctctactaaaaatacaaaaaattagccgggcgtggtggtggacgcctgtaatcccagctactcgggaggctgaggcaggagaatggcttgaacccgagaggtggaggttgcagtgagccgagatggcgccattgcactctagcctggttgacaagagcgagactccatctcaagagaaaaaaaaaaaaaaaagtctttgcccttgagtttggtatttacagttacaactaatccaattccactttcacctgatgctataccacttcatgggttgtacaagttccctctaacagagtattctcagttcatccttactgtcccttatgatattgctgtcattaatttcacttattcaaaagcgaaattattatttttattattatttttttaagaccgagtctcgctctgtcgcccaggctgaagtgcggtggctcgatctcggctcactgcaagctctggattccggattcacaccattctcctacctcagcctcccaagtagctggggctacaggtgcccaccaccacgcctggctaagtttttttgtatttttagtagaggcggggtttcaccatgttggccaggatggtctcgatctcctgacctcgtgatccgcccgtctcggcctcccaaagtgctgggattacaggcgtgaaccaccgcacctggccataagtgaaattattgacagcaatatcataagggacagtaaggatgattattgacccaatcattgaatacattgttgcgggtttgtttttgtttttgttgtcgagacagggtttttttgtttgtttgtttgttttttgagacagagtttcgctctgtcacccaggctggagtgcagtggcgcaatctgggctcactggaagctccacctcccaggtttgcaccattctcctgcctcagcctcctgagtagctgggactacaggtgcccgccaccatgcccggctcattttttgtagttttagtagagatggggtttcactgtattagccaggctggtctcgaactcctgacctcgtgatctgcccacctcggcctcccaaagtgctgggattacaggcatgagccactgtgcctggccgagacagggtcttggtctgtcgtccaggctggaatatagtggtgcgatcatagcacaccacacccttgaactccagggctcaaatgatcctcctgcttcagcccctcaagtagctgagacgacaggtgtgcaccaccatgcctagataatttttttttttaatttctagtagagacagggtctcgctatgttgcccaggctgatcttgaactcctggtcttaagaagtcctcccgcctcagcctcccaaagtgttgggattaacaggtgtgagccattgtacccagcttttaaaaatattaataatagagtcagagtgttactatgtggcccaggctagagtgcagtggctattcacaagtgcaatcccatgactgatcagtacaggagttttgacctgcttcatttctgacctgggcttattcacccctccttaggcaacctggtggtccttaaggaggggaggtcaccattttgatgccaaacttagtgcagacactcagtccaaatagcccagaactcctggactaaagctatcctgcctcagcctcttgagtaactgggtctagaggcatgcaccaccatgcctagctgttgctgttattaccttgaacaaactgttaaaaataagttaaaaataagaaaagtagaccgggcgtggtggcttttgcctgtaatcccagcactttgggaggctgaggcagatggatcgcttgaggtcaggagttcaagaccagcctggccaacatggtgaaaccccatctctactaaaaataaaaaaattagctgtgcgtggtggcgtgtgcctataatcccagctactcaggaggctgaggcaggagaattgcttgaacctgggaggcagaggttgcagtgagccaagatcgcaccattgcaccccagcctgggtgacagagccagactctgtctcaaaaaaaaaaaaaaaaaaaaaaagtaagaaaagtaaaatattttgccttcacttatttattctctaatgctcttcctttataggtctttatttctgacctgtattattttccttctttctcaaacacttcttaatattttttgcaaggcaggtctactgatgacagattctgttaatttttattcttctgagaaagtctcttctcttttgaagggtaattttactggatacagatttttaggttaatagggttttttttttttccttacaacactataaatattccctctactgttttcccttgaataatttctcaaagaagtgtgatgtaattcttatccttactcctttataggaaaggaatttatttccctgtggcttctctcaagattttctctttgtctttgattttctgtagtttattgtatgcttacatgtagttttgttctgtttttgttttttgctatttatcctacctggtattctgtgagctccccagaactgtgtttggcatctgtcatcagttttggaaaattctcagttcattattgtttcagatactttttctgctcatttctgcctgtcatcatcttctggattcccattatgcatatttatgcctttctaattgtcccacagttcttggatattctgttccatcttgttcattcttttctctctgagtttcagtttgggaagttgctactgacattttttttcaagctcattgattctttcctttgactgtatctaatcgatgaatccatcaaaggcattcttcacttttcttagttttttttgtttctagcatttccttttgattctttgagtctttatctctgctgaaattacccatctgttttagcatatcatctactttttccattagagcccttagcatattaatcatagttgttttaaatcagagttgttagctgtgataattctaacatctctgctatttctgagtctgggtttgatgcttgctatatctcttcaaagtctgctttttaatcgtagtatgccttgtaatttttttgttgaaaaccggacttgatgtacttgttaaaaggaactgaggaggccgggcatggtggctcacgcctgtaatcccaacactttgggaggctgagcggggaggatcgcttgagcccaggagttcaagaccagcctgggcaacgtagagaccccgtctctactaaaaatagaaaaactaactgggcatggtggcacacgcccgtaatcccagctactcaggaggctgaggcacgagaattgcttgaacccgggaggtgcaggttgcagtgagccaagatcatgccacagtactccagcctgggcaacagagtgagactctgtctggggaaaaaaagaaaaaaaaacaggccaggcacagtggctcatgcctgtaatcccagcacttcgggaggccaacgcaggctgatcacttgaggtcaggagttcgagaccagcctgatcaacatggcgaaagcctgtctctactaaaaatacaaaagttagctgggcatggtggcaggcgcctgtaatcccagctacttgggaggctgaggcaggagaatcgcttgaacccaggaggcagaggttgcagtcagtagagattgagccagtgcactcctgcctgggtgacagaatgagactccatctcaaaaaaaaaagaaaagaaaaggaagtaactgaggaaaatcagcctttggtgtgagttttttagtttatctggctaggcgttaggctctgtctgctgtttgctgtaactataggtgtcagaactaaaatttcctcctgggtctgtttttccttccttgggtttccgtagagacttcttaaataaagtctgagatatgcaggtttttccgttctattctcttgttattatataggagccctatttatgtggtgggaaggaggggaagtgtcctaagtcctgtgactaggtctcagtctttttgtgagcctgtgcccctggcctgtgacttttaccagcacttctcagtttggggtttttgcctccttaggtgaaacaggaagggagagggggctggagttaggccctttctttcctgcctgtggaaggcttaggggtgcttaagttgggtcaacctttcccttaggctgatgaggatcttataaaacctaattaagttaggctcttgtaaaatagtttcctttgaggacaggccttgttaagaacaggaagctctagacatagtccacatggctgctttccccctcccccgccagaagtatgagaggatctttctctgatcttgactgtgagagtctggtagggctcatggaggtaaagtccacattgagtctccagcagttcatgaattgctgtgtaaattttcctaccctcgtttccactcctgggctcctgctcaggtaagctccagttcaccctgttgacatgtctcctgtgtcgggggcagtcatttgccctgtaacttcagttctctgatgcagctaaaaggggttgtttgccagttcagtgttgtttcttgtaaggatggtagtgacaacttctaagctcctgacatgcctcactgaagaatgaaagtcctttgccttcattttttaatgatatttttggtagataaaaataattccagttgaccagtttttgtgagtgtgtgtgtgtgtgtgtgtgtgtgtgtgtgtgtgtttttcccagtactttaaagatgttacttctttgtctttccgcttacagcagaagtatcatgtcattcttacctatatttatcagtacataatatgctttttagcttaactgcttttaagactttttaatttaacactggttttctacaacttgattatgatgtgtcttggtgcagtcttcttcaggtttattttgtttgggtttttcttttttttgaggcggagtctcgctccattgcccaggctggagtacagtggcgcaatcttggctcactgcaagctccgcctccagggttcacgccattctcctgcctcagcctcccgagtagctgggactacaggcgcccgccaccacactcagctaattttttgtattttttagtagagacggtgtttcaccgtgttagccaggatggtcttgttctcctgacctcgtgatccgcctgcctcggcctcccaaagtgctgggattacaggcgtgagccaccacgcccggcctctgtttgggttttattgactttcttggatgtgtgaattgacagttttcatcatatttgggaaattttgcttatttcttcaaatatttctgtctcctctttgtttttcttctaggacttccaattatgtgcacattagacagcttgatagtgtccaataattttttctctctgccttatttgagtagtttcaattgctatgtcttcaaattcatggatcttttctctttcagtgtttatttggtgttaatcccatccagtgcatcttttcatttcaggttttgtttttactgtctctggaagttccatttggatctttctatatcttccgtgttctcatcatgctcatgtttccctttaccttcttaaatatatgccgaactattgtccttgtctgctagttcctttatctctgtcgtttctaggtcagtttctattgactgtgtatggttataggtcatattttcctctctttcttgcatgtctgttatagcagttatcagtttattgcgtctcaactctaaatccacccttcattgccacttgtgatactggaacatttctcccttgccccatgctggtctttgtcagtggaaagcgttgagaggaaagggcatttcttggttctttgtgctttgcttacagctgtctgtgacatgagctggtatgtgggacatatagggtgctcaggcagctttcaggcaggtcccatagcaccccagctagccgcctggcagctttctggtgagttcaacagcacccccacaccaaccccccggctttccagcactcctcaagcagccttccagctcactgtgttagcgtcctcgcacgtggttcttggccctcagttctgtcctgggacagcccagtcgacgtcatcatctagtgcgtgcttttgatcacaccctctcctaggtctgaatccttcccttagttacctccctttactctaggatgttctgtggatttctcttttgttccctcttagtcaactccctgtaaatagttaataattcttatgctaaacttcccttgtttaagctaccatgtggtttctgtcccctggtgggaccctgactgataggcccggttattttttaaattggatgctgaatattgtgaatttcaaattgttggccaggcccggtgtggtggctcatgcctgtaatcccagcactttgggaggctgaggcaggtggatcatttgagctcaggagttcaagaccagcctgggcaacatagtgagaccctgtctctgcaaaaaatgaaataaattattggctggtgaattttgttgaattcctttgaataatgttgggtttgggtctggaatgcagttaagtcccttggaagcagcgatcctttagagacttctgaacttttcagtgggtccagtgctgctttagtctgcagttgacttagctctattactaagggtgatggccttctgcggagtctacccaataccccacgaattaggagatctctccacggtggcttgtgggaacacaaaatattccctgtgtgaactctggggattgttttgtttgctacttcctcaggagtctttcctgggccttctcatatagtttttctcacccaggcacagatctgttttcagctaaagactccaggagaccctctgcagatcctggctctgcctctgcagctgcctcctccccaggactctgccctgcaaatagcagcagccttggcctccctgagctctgaactctgtcttcccaactcagaaagactgcaggttccggctgagtttccctgcctgcgctgcagcctggaacccgcctcctggctgtaattggtgcagtcataggatgtgctctcttgtctcccttatcttggaatcactgtcctgcactgttttccaccaactgaaggcaaaagtatgttgtccagttttccaggtgttcagggttccctgttgctgcatcctacatgagtatataaacagagaacaaacaaaacagcctgtcaggagtttgctgaagtttcagaataggtggtgctgggtgagctgatgggcatgagtaacactccccttttccttcttttagtgaccacaatatgaatgggaacagcaagatggcaaaagcttgctgagtggtacagcgccagcctgggtagtggcctccccagcaagttgcatgtcactagcttcctgtggctgtcactcctgggcccaggcacctccgaagatcagcacctcctcatgggctcaagcgaggacaggagcccgtcacccatgagctctcaagggcagagccactgtcctgtctcgatggctccaccgtgactccagtggactttggacagtggggagcaggcccaacagggccactcggatgtggtcactctggatttgggtggatcagcaccaagctagactcatccccagcccccaggtgctgttgctgctcctgcgtgaggccccatccacagctgcagctgtggcagggtggctagtggtggccagcatggccctgctgcagctccacgctgtggggggcgtggccctgaccagcagccacccctccatgtgggccacaggggaggagcttaggaagccgccttggcaaggtgagtggacgcatttacgtagtgagaggtgagaaccagtgccgctccccagagccctgcgattcctggggaggctgaggcttgtagacgccttgcctgctctcctcctggggtgctttcctgttcacagggctgggaccttggagggagaatggaggcagagcctctgtctgcccccgctcaagggcccagcacaggcaggccctctggggagcccctcagtggctggtggggagtctggggcagggtgagggacagcatcttccaccgaccacaggcttgggcagcatctgtcctggaggccatccctgtgggaaggcctcttttgtatgactccttccctgtgaaatggcttctccatgtagttcagccccacaggtgccctcagaaaacacgaagtgctttctgcacgtgtcgcggcccccagagaagaatttggttacagagaaggtgacagctcatggcttcctgagggtggggcagtgggagaagtccccaggggagcttggggcccatggcctcccacaccctgggtggggctgcccactgggaggcccacattgcctcagtgtcctgcaccctacagttcagggtgcctgggggctggaaggagagcaggggccggggaccagtggctcacagggacctggggagaactgtggaaccagccttcccagccgtcccacccaggaaaggagtgggcagagttggaagaaatacagcactgccttggccttggcctcagacccgagggtctggctatagccatggtggtggctgtgtcgtgggggctgcatcatggcactggcagtggccccaggactgtggactagtgcagactagcacagagttcctgctgggctcggggtgggagcccctcctggccgtggagacaggcccacgtcagcccctcaggatctgttgcccaacagctctcagccttttgcttggggcctctttgcgtggaatggttctgagttctctgctatctggcagcatcatcttctgagcactgctctgacagatgccttagtccacagactgccatgccctcccattaggagccatccttgggcactcctgtgtcacccgtagttactccaccatcctgccaggccatgggatgtggaggctgaagagtccaaatgggacagaagcctgtcccctccctccttcctcagagaggccttggttgggctcacactgagtaggggcaaccagcagccggagagagtggagctcttaaactgtggctccagagcagaaggccccctctgacacacctttcatccagcatgttctccgtgagcacctgccacggcccaggccctgctctcggtgctgccggctgagcccagctctcgtggggctcgcatctaacaggagagggtaactacagtgtgagtgagatgtgattcgtggtgaggaatagaggaatagaggaatgaggatgcagaggtcttctgtcctagaggatgcttggctgggcagagggaaacggccttgtgtccctgggggactgtcattgtcgggcacatctctggatgggacatctgtggctggaagctgtccttgtggccgtgctagttggaccagcctggctggttatcagtccgtgtcctcagcccctccccttttcaatgactcattccaggttccgcaggctctgcgtctggtgtggaagagctcacggggaagcactcctgcccaggacccgaggagccggccaccgttcagaaggccccagcttgaaggcctggagagccgcccagcagcacaacacagggaagcttggggaggtgagccccacttcctgctcccgcacaggctcttctccctggggcactggctgggcgggatgctgagaagctgggcatgggcggctgctgagaggcagaggagccagagagctgcaggaaatatcctggggctgggagaccaagataggggctcagggctgccgaggcggctggacctgaggggccaagacccctgagcgaaggagccagagaagagagacggacattaggcactggtctctctagccatttgctgatgaagctgcttagggcagaggagcagaaagtggctgaaaagcagagtgggatttttggcagtttcgtggagttagggaataggttggggcctgtcaggtgcagggccctaagaaatatcccaggctctcatctgggaccaaccctgcctcgccgggacaagccacagctgggctgttctttccaaagactgcagaggagcttagtgtgggtggagttcctgattcactgtctcactgctgcccaccacggagcggagtgggtgagctgtccctgtcgggggacatgtccagaccctccgcccttctgtcacgcacagtccctgacactcagttgaaggcaaccaggtacactgggaaaggggaccaggggaagaaaggtgacagacccacaggagactgagatacggtttttggacatggactttagtatgttaatcacatctgttttatttttttattttattattttatttatttatttattttgagatggagtctcgctctgtggcccaggctggagtgcagtggcgcgatctcggctcactgcaagctctgccatccgggttcacgccattctcctgcctcagcctcccagtagctgggactacaggcgcccgccatcatgcccggctaatttttttgtatttttagtagagatggggtttcaccgtgttagccaggatgtgatttgcctgcctcggcctcccaaagtgctggcattataggcgtcagccaccgtgcccggccaagcacagctattttaaataatagagataagatgatggattgtttcatagaattggaattcataaaaaatataatggaagttctaaaacagaaaagcacaataactgaaatttaaaattcagccaggtgcagtagctcacacctgtaatcccagcactttgggaagctgaggtgaagagtttgagaccagcctgggcaacacagcaagaccttgtctctactaaaaattttttaaaattaggccgggtgcagtggctgacacctgtaatcgcagcaccttgggaggccaaggcaggcagaccacttgaggtcaggggtccaagaccagcctggccaacatggtaaaaccttctctctactaaaaatacaaaaattagccaggtgtggtggcgggtacctgtaatcccagctactcaggatgctgaggcaggataatcgcttgaatctgggaggcagaggttgcagtgagccaagattgcacccctgcactccagcctgggcaacagagtgacactgggtctcaaaaacataaagattttacaaaattagccggggatggtggcacatgcctgtggtcccagctacttgagagactgaggagggagtattgctagcacctaggaggtggaggctgcagtgagctatgaatgtgccactgcactccagcctgggcgacagagcgagactccatctcaaaaaaaaaaaaagaaataaaaaatccagtaggtgtatttaccagcagattggaatcagctgaaaaaaggattagtgctctagaagaaaggtcaatagaaaatacatagtggggcttggcatggtggctcacgcctgtaatcccagcactttgggaggccaaggcaggcggatcacttgggcttaggagttcgagaccagcctgggcaacatggcaaaactccatctctacaaaaaatacaaaaaattagccaggcctggtggcgcatgcctgtggtcggtcccagcttcttgggaggttgaggcaggaagatcacttgagcctgggaggctccagtgagccaagattgtgccactgcactccagcctgggtgacagagtgagagaccctgtctcatttctttaaaagaaaaaaaaaagtaaaaagaaaatcccttgcaactaccaccacaaccagcccactttacactgtgtgtccttttcctggaccctgagggcgccctcccttttcctttctgtggccccctagccttggacagggagggggccctgctgagaaggcctttgtacttgggagagaccgaggtggcttcggaattgggggattacttttcattgcgacccttgttggaaacatcagcacactggagtccagttgcagttcgccttgtggctttgtttaaatcctcattgggaatatgagttctcattgtcctcagggactcaggctgcgggtgtgctaacctccctggtgagaaagtggctttttagacaaacttcttttcatttgcatctctcctcaaagcagaatgcagaaagcggcagcactgggagcgtgtggggagggacggggcagccggcggaggctgagccaacatgccgtggttcaggcccacacctcgtggaaggcagaaggcgagtgctgacattccatagcaggccgggttggggaaggggcggtctgctgcctgctgcctgctgagcgtgactgtgcagctgttgtaagtctttgtgattctgatgtgtggtgatctgagaaatttcccatcctgggttaacactttctttattataaacagaaattaattcatgagggatggcgcaaccaggctggggcgcagaccaagggcagtgcactgggctgtgatgactgcatcctgctcaggttgtgggacatggggttaaaacactgtcacggcaaagacactggccttttacctgagtacaggatagtagccctttgtcctctaagatgctctgtccctggggccagcaaacacctcccaagggagaggagagaaagaaccccgagtagagccagccgagtagagccagccgagggcagataggtcttgtagggctgtgggagccactgcaaccctgggagcttcctgtcagctcaagcccagtgcccagagtgtccaagtgccacctggatgccctgcagtgtccactgtgctgggttctcaaggtttttctctggggggggtctgcggggaacctggagctgctgggtaggaggtgggcttgtggctcagctgtgtccagtggctggctgtggagcgcctcctctgctccagtaatattttcatgggcaagaaagaccactactttcttggccaccgcttcctggagcttgtgttcctggaagccagccataaataagccggccataaacgagggtaaacaggtgcctgagtaaacacaccagagcaaatgagtcatatgggccggcagagatgaacctggggccatggcgggtgtaggggttgggtggggagaggatgtcctctgaaaaggtgacatttaagctgaaactggaatgacaagaaggccccagctctgcaggcagagcggaaggctcagagcttagaatcacgtaggtcatggaaagcattggatttcgtgttagggacaatgagaaactggtgacagattttaagtaggggaataaagagatctaattacacatttgcgagatgttctgagagctgtggggacggctgggacatgtacctggaagcagggcagccaaagggagaggcagtgatgacgggtggtatggaggctgcagaatctggaggacgtgcaggctcagggtgcatggtgcgggcggggctgagggggagcggggcctaggatgatctcaggtattctagcacctggatggtggtggcactatagacatgagcagggaaggccaaggaaataatctggggccattgtggctgcagcaagtttatgatgcctgatgcccgatgcccatcagacctgtctgaggggagatgtcccagccacagctgaagtgtgagacaaagcccctgcttcagaggacagcaggggagtgtttcctaagcaggcgtgaccagacggtgtttctaagatggaaacctgggcatttaattttttgtgtgtggtttcatttttaacattaactaatggttaccttatttttggatgttggatcacatctggcagtattgctttaaaagcttttgatttgtagaattgtaagaactaatcatgggattttttttttttttttttttctttttgagacaaggtctagtagctctgtcacccaggctggagtgcagtggtgcagtcatggcccattacagcttttaccttccaggctcacacaatcctcctacctcagcctcctgagtagctgggactacagatgtgtgcctccatgcctggctaactttttaattttttgtagagacaggttcttgccatgttacctagactggttttgaacttctaagctctagcagtcctcccactgtggcctgccaaagtgctgggattacaggcatgaggcaccacacgcagccagaaaatttcagcatattcaaaactagtattacacatcttcgtgtactcattacccagcctcagggctggcattttgaagcaaatcccaggtactgtaccacttcatctttcaatattttattaatagtatgtgactgtaaaatataaggccaggtgttgtagctcacacctgtaatcccagcactttgggaagccaaggcaggagaatcacttgaacccaggagttggaaagcagcctgggcagcacagtgagatccccaccccatctctaccaaaaaagaacaatttttttttttaaattagccaggtgtggctgggtgcagtggctcacacctgtaatcctagcactttggaaggctgaggcgggcggatcacttgaggccaggagtttgggaccagcctggccaacatggcaaaaccccgtctttactgaaaatacaaaacttagccaggcatggtggcgcacatccgtaatcccatctactagggaggctgagggaggagaattgctcaaacttgggaggccggaggttgcagtgagccatgatggcaccactgtcctccagcatgggcaacagagcaagaacctgtctcaaaagaaaacaaaaccaggtgtgatggcacatggcaggaggctgaggcaggaggatcccttcagctcaggctgcagtgcactacaattgtgcctgtgaaaagccactgcagtggccggatgcggtggctcacgcctgtaatcccagcactttgggaggctgagatgggcggaacacaaggtcaggagatcgagaccatcctggctaacatggtgaaatcccgtctctactaaaaatacaaaaaattagctgggcgtggtggcgggcgcctgtagtcccagctactcaggaggctgaggcaggagaatggcatgaaccccagaggtgaagcttgcagagaatggtgtgaaccccagaggcgaagctcgcgtgaaccccagaggcaggctgcagtgcagagccaagatcgcgccactgcactccagcctagaaagaaaagccactgcactccagcctagacaacgtagtgagaccctgttcctaaaataatttctttaaaaacaaaacataaggaccaataagagccattacaaacttaagagtttactattaatacttcccagttatgggtcagtgttctgctttccctgattgcctcttacataatttgttacacaaatgtctgtttgcatgaataaaagattggatgttttataggatctaaggtccatacattttgtttatggatatatctcaagttttattatcatttaacatccatctcaaaatgtgaactttttttaacctatgagttctgcctctcttcttcttttcattttgaaatctattgatgagcctgtcctttgccatctacgatttcccagtctgggtcgtaccgtgtccccatggtgctgttgaacgtgagcctctgtccttgtatttgctttaagttgtcatttagatctagaggtttgatcagattcaagattgttttggcaagaactctcctaagtgctgctgtgtgtggtcttggattagaagggacagaggctgtcttttgtgatgttagcagccactacatcagggctgagattagggacggcaaaatggtgactttcaggtctagcattccttcctcgtgtattagctggagtccacctatctaaagagagccttctcgagctatgggttactgggcagtcctttttgcataggaaaggcagaataccgccttgatcctttgactttatttgcctttttgcagaagaacaagttgagttcctagcatccccctaaggtggctgataattattttatgtcaacatgaacttatgtattgaaacacagtgatatgtttaatctgttgcaattattcttttcagtagcaatttgtagaactgagaatttctttgtgacagaacgttgaagcagtggtgaatgatgaaggatagaaaagaagttatattcagtaaagtaggaaatctaactcaggcatatgcattatgtcagatcagaagcttcacactttctcagttgagagcactcttgattaaggttcaataattattttaatagtaagccaaaagaaatccctgatagtggtgccggaggagacaggttgtgtttttatcttgtggcctgggtagtgtcctgggaccctctgccccatctgagtcaagtgttgtgggataaaggaatctctcagggcgaggagcttcttaagttaaatcggtagaaatttaggcatgacatgggccttcaaatgtgtgaggagctgtatcattttatttctcggtgtgttttccccaacttctagttgataaaaaaaaaattcttaaagagttttcgtatgtgggagctaaggtggtcttgtaaaatttcaagtcatccttaaataaaatgacccgcctgagaacttgctcccgctaagtggcgaaatcaactggagttggttcctacaagttttgtttattctagttttgtttgtaagtaggttgtgtgagttaattcatggatatttactatatgtcttttaaattagaaaacatttgttattatgtatgtccttttagattttacctgcagctcatactttgaaatcatcacccagtagtgtcttactctagcatcgtctaaatctgagcatcatctggtggaatcttaaatttcagtagaaaccacgagttattaatacatcttccactcaagtatcaatttcagaaggaaacgtaaatgaatattctaaataaggctaatttgtattaatctgcctttatgtttgagggaaaaaaagctgagacattgcatgaaagatgatgcaggatatacgctgatcttttggccccaatgagctatttgaacattgtcctgtttattgttagttttcttcatcatttattatatggtcaatttttgaattcctgtaatatgaaaccttattctatcttttaacttactgttacctaaagttagtaagtccagattatatggtcattcaaaaaaaaaaaaaaaaagaaaagaaaaagaaatcccccacagttccatttattaaataagtaaaccccaataataagcatttgtgtcctggcaacttatagtggatgtctagaaaagtaatacataaagagaaatgttcatgttatttgtttagtcatgggatgtgtgtgcctgtcgagcacctcttcaacttggaatctggtagaacaccgccaccctcattgcctcatttttccacgtcgaccttcacagtaattgcttgttcagtgactgccacaacccagcctggcagagagagggaagataccctataaagcaaggtaacgttaatgttgagaccatgaatggccttgagcagagcagagtatcattgcttccttcaaaattcagaaggatctgatggtgctctgtgagttcatgggggtgcctccgtgcaggttggaaaccacagctgtgcgtccttcccgctttccctcttgatcagtagaagggtaccctccctggcctgcacgtcgctgggtcacacaacactggctgtcgttgcacaaagccacggccaccagcgttcctttgaggccatttgtttccagccatggtgcctataggatttttcctttatcctgtaatttcagccaaatcagagcatgtgacctggcttagatgtcaatataattgttgttatgtgctcttttcccttcctgtgtctgtgacaggtttaatttaacctgagaaggctgcagatcctcggggttggtgtaaaaacacctcatcctgatctgagaaggcggtcagcttttctcctcgttgccgttggctgccagcacccattctctgtggatgtgaaaatcccagaagggctgggcttccttcttgggcattccccaggcctatctccagagtggggcccagcatgggaggattgtaccccactcactcccctgatgtggggcttggacctacagctcgacagcacccatggaatgtgggcagaagcgacagcagccagctccgccttggccttagggcggcacgtgttctgcttgtgccctgggagcctccaccttccacactgtgggaagagggtgcccagggagctgcagtctctccagcccagccccaggacgaggcccaggcagcagagccaccccagcagacctggcagtgtgagagaaatgcatgtgtatacactgagtttgcaggtggctgttacatggcagcattgactgacacagacagaaaagagatccacgagggagaagtgagagtgctggagactccacaagccacaggctgcaggggcaggatggcttcttagaaggtgaaatgattgttctgggaatctatcagaggaagacatagaggctccagacggttgaaggcccaacagtgatcccagacgggccccatgtcagaccaggctcctccagggctgtgctgccctcaccaaagcccgtcctgagggcagccacacagcaggcagcactcgccatttgtacaagcgaggcccaagttccagccttccttctggcaggtagaggaagcaggggcactatgcctgggagttcctgaaagcagatggggcagcatttggtcaagagccaggaggggatgacagaccagaggggaaccctcgtcccacgtgctgagcacacgtagggggttgggcacttgctctgtgagctataattggtgtccctgtgccccgccggaagctgcaccaggcagtttcttggtggaggacagtggccgccctctagctttactcccttccccgtgatgggtcgctgtcagatgtgtgtccaggaaaggcaaacaccaaaggcagaggactagtccctacaccgaatactccggtggccttgcttgggggctgggttttgacgtgctggaggctgtcctagacttagagattaaaaacagggaagaaccattgctgaaacctttggaaaagcctgcaatggggcctctggcagcctgaggagtggtggtgtttccatctggtagacgccgtctcaataggagggacagatgagtgcaccagtgctgccagccagaggcgtctgttggcgtgtctttatggaatggggtgccagtcttgtggagggtggtttaccttcctgtttctagtccccactgggcctgccttctgcttcatggccagctggccagaccgagcactttcctgactttcgaccttggcccctgctgactcttgccgttgaggcctcctgcagaccccatttgtattcatttcctgcagttctcatacctgaatcccgcctggacttctgccaagccttccaggccctcctcccccagggggaccacagatgctacgtgcagggctgtccttggagggccagcacagccccttccaagtgggcaagacccaggggtggctcaaaagatagctgtgccctagccctggaacctctgaatgttgatttttgtagcaaaaaaggacttgcagatgtgagtaaaggctgttgagataaggacatcctccctgctctctgggaggaccccaaatgcaggtgcacagatcttaagaagaagaggcagagactggggtgatgcagccacaactaaggaaagccaaggattgctggcagcctgcagaaactggagggcaaggagcatcccccaaccgcccggagcctccaggaggcgcaaggtcctactgactccctgacttcagacgtccagtctccggaattttgagaggatccatttctgttattttaagcaaccaaacttgtggtagtttcaccagtctcaggaaatgaatacgaatggaaagtcaaagattccaagaaatgagtggcggggtgcggtggctcacacttgtaatcccagcatttgcgggaagattgcttgggctcaggacttggagaccttgtgtctgtgagaaacttaaaaaataggctgggtgcgatggctcacgcctgtaatcccagcactttgggaggccgaggcaggcggatcacaaggtcacgagtttgagaccagtgtgaccaacatggtgaaaccctgtctctactaaaaatacaaaaattagccgggtgtggtggtgcgtgcctgtaatcccagctactcgggaggctgaggcagaagaattgcttgaacccaggaagcagaggttgcagtgagccgagatagtattactgcactccaggctgggcagcagagcaagattccgcctcaaaaaaaaaaaaaaaaaaaaaaaaaaaaaaaaaaactgagcatggtagcatgcacctgtggtcctggctacgccggaggattgcctgaagccaggagttcaagaccagtctggacaaaagagcaagaccccatctctaccaaaaaaatttaaaaattagccaggcatggtgccgtacccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggtgagcaccaggtggagtgcctctgggtgactggccggtttggagcagggagggaggcttagagtctcatcctccagcagcgagtgaggcggaggctccagcgtccctcccgggcgggttttctggtggatggaggagtgactcggggtcctctacgtggtgccagctgtttggctttctggacgttgtaggaaagggtttcccccgcctgcgtccccctgaccttgagctccaccagcccctgccagctgggctccagaaggctggagtgctgtggcagggatgacgtctcacttctgttatgtctctgtgccctgtgctctcccaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcaggtgaggccagggcagcctccccccaaaagcagaggagctctggagtctagggctggtgggcagggccagccctatggagccacagggtgtcgggtgtggggtactgagcaccactgctcccagcacggtggaacaggctcttggctgtggaccaaggtcctcatccctgctgtgctgtccctggctggcagcaggagcccaggcagaaacatgaggctgcggttaaaccgagcaatgccacgagcatcagctgtggctccctttgtggcgctgtagggtccctgggtggcaccagccctgctcagcaccactgtggccctgcccccagatcctgagccgctatgacatcgccctggtccaggaggtcagagacagccacctgactgccgtggggaagctgctggacaacctcaatcagtgggtgacagtggcagggtcataggaaggtgacatctcgtccacggcacagcctcacttcacttgggccccaagggtggggacctgggcacagcctcgctatcggcagccagaggggtcccctatggcccccgccactgggaccttttgtttcttcaatccagggatgcaccagacacctatcactacgtggtcagtgagccactgggacggaacagctataaggagcgctacctgttcgtgtacaggtgggtggtctagaaagccaggaagcccctccctcacctgggagggccccaacagagcagggaagtagtttgtcctattagtttgtcctatggcaagaacctgaggcttcagagcagggtccagggtggagtgaaaacaccccaaggtcccggaccaatgggttgagcaggtgcctggctcccccgccctcctgtcgcctgggtcccggaccaatgggttgagcaggtgcctggctcccccgccctcctgtcgcctgggtcccggaccaatgggttgagcaggtgcctggctcccccgccctcctgtcgcctgggtcccggaccaatgggttgagcaggtgcctggctcccccgccctcctgtcgcctgggacgcgacgcctgcctcctgggaagcaggagtggggcagcttccagcctggggtcacctcctcctgcccggccttcccgcaggcctgaccaggtgtctgcggtggacagctactactacgatgatggctgcgagccctgcgggaacgacaccttcaaccgagagccagccattgtcaggttcttctcccggttcacaggtgggtgctgcctgggccagggtggggctcggcttggcgcttatggcctccaccccctcctagggaacctggaatgcctgtgtcacacactgccctcccagtccctggggcttgggttttccattcaagtcatttggaaaatatccaccccccggggggactgtcatgatacatagttccagctgacatggtgactgaacctgcccccagggagtgtgcctcacacgacgtggctgtctccacagaggtcagggagtttgccattgttcccctgcatgcggccccgggggacgcagtagccgagatcgacgctctctatgacgtctacctggatgtccaagagaaatggggcttggaggtgaggccctcccaggggcagtgggcaccagcggcctccgcatgtcccagggccacaggcagcgtttcctggtaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggtgagcagggcctcgcgcttagggcagactgagggcacctccaagggcagccgtgactcataggtcgggcttcagaagcctcaaagcctttgaacactcacccaactgagcttcagttgatccactacagggaacagaataacaagagccacgatttttaggttttttcggaaaagcacatctggggataagaggagaggcagacacctaggctgtcatgtggtttccacattgaggggcacagaccagggtgtgcagttttgggcacccacagacctgcactggcaggtcccagggctcttagtttagttcctgcgggtgctgagccaggcccatgtgtgaaaggggaacctactttctcttcccaacacccatcaggatcgtggttgcagggatgctgctccgaggcgccgttgttcccgactcggctcttccctttaacttccaggctgcctatggcctgagtgaccaactggtatgtgtcctcccttgcacagccacatgaggatgggacacaggagctcaggtaggctcagcccagaccctgtgcccacttgcctgcaggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagcagcaatcatggcgttctcgtatatctgaaaggcaagaggagaaacccattatgaggggcatggggcaccttttcatttttttttttttgagacagagtctcactgttgccgaggctggagtgcagaggcacgatctcggctcactgcaacctcaggtgatccccccgcctcccaaagtgctgggattacaggcgtgagccaccacgcctggccatttttccgtttttaaaacagaatttggctgggcacggtggctcacgaggtcaggagattgagaccatcctggccaagatggtgaaaaccccatctctactaaaatacaaaattagccaggcgcatgcctgtagtcccagctactcgggaggctgaggcaggggaattgcttgaacccgggaggcagaggttgtagtgagccaagatcgcgccactgcactccagcctggcaacagagcaacactccatctcaaaaaacaaacaaacaaacaaaaagacaggattttagaggaaaccgctgttccaccctgaaggcaggctggcagggctggtagcctgggtccctgcagtcatcctaagctgctgcactcacctgatccaccagcagctgagccaggccaggctcgcttgcgcgcagctgattcagcttcttgatgagcgcgtgcctgcaacacagaacccaccagaaaaagcagctcagtaccacgtgctgtgaccctcccttcatgttttgggattatcaggatatttaaagaagcacagtaagactgtctgtagttttttaaataaggtatgttaatgatcatttatagataatatcattatatacccagaaaacccaagagaatcaggagtgtcagtattagaaaatgctgtaaggtagccaaactccaagattaatatacactaaagggacaaaaggagcttagtacgtgaagacatgccttggttcctagataaataataaaagagaagggagtaagacccacatgttgaaacatattatagggctctagtaaataaaacagtttaggtctggaaagggggaaggcaaacaactccatgtaacgagggtggacactgagtgtctgatgaggacagtatttcacagaagagggaggagacagatcactccatccagcagcactgggatgactgggagccatgcagaaaaccatttagaccagagtaaattccagagggatcaaagatgacaagcacaattctagggaagaaatgtttcatcatctcagaaggggaaagcctttccaagcaaaaccacaaaccaaaaagtaaagaatgattgacatatttgacgtcagaacaatatttttttctgcataggaaaaagcatcatgtagtatttaaccttaacatgaatattataatttttcacttagaagtctgataaaaccgagggctctggggaactgtaaatttgtacaacctctccagaggacaactggagtcgggaaaaccacatgtggatgatatgctgagactcagccattccatttcctaactgcatccctttaaacacttttttttttagatagatagatagatagatagatagatagactctcactccttcacccaagctagagtgaaatggcatgatcttggctcaccgcagcctcctggtttcaagaggttctcttgcctcagcctcccaagtaactgggattacaggcacccaccaccacccccagctagtttttgtatttttagtagagatgaggtctcgaactcctgacctcaagtgatccacccgcctaggcctcccaaaatgttgggattacaggcgtgaggcaccgcacccaacctaacagaggaaacacttcaaatgcacatcctcacatttctagtctacgtagctggaaaaaaaggacattcttaatatgctaatgtggaggtcacctagttaccctaagggagaaaagcaaggcaaggacccactgcacagcaagttcccccttggaagcccacgggcgcagctgcccacaaatgcacataatctctgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcacaaaactagtttgccaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataaagggcatataaagaacaacaggaagaaacgagggaaatcttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcagcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatcccacaggctggaagagccaggagcgtggcctcacctggggttgatctccagcgtgggctgcaggagctgtgcgcgctcctcctgggtcttggccagctgctgcatgcgcaggaagtggcgggcagcccccatctccagcacggtgaccatggcagggtgggtgtccagtcggagggtcacctgtgagcaaagcccggggttgagggtgatagaggttcccaatgtgagagggctggcaggatcttaccaggggtgaaggtcacccagaccacgaggtagcaggcggggtctcaaggactcccctggaccagcgctgctccctccccattacccactaacttgtgggccctgagctgatgccccacgcaaagatactgtgcccgaggggctccaccaccctggtgccccgctgctgcctccaggagctgcccgaatccatcgtcctctgctccatgccagcccaccctgcatgaggccccttcctccaagtgaccatgcatgggacgctcatttctcactctgagctagacaggttggtggggggagtcttagctctctgaagcccacccaaaacccccgactaagcacccaagtgagcatgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccaagtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatacaacttggttagggctttaaaaaaatacacagcctctcaagaagctgggccagctccagaagccaccgtggcaggagcactggacagacccctgatatctaaaccaggaggcaccttcctccagtcaccagggtgctcccacaaggctcttctcgggggtggctgagcccaggtcaactgacgaaaacccaaaggaagccctcgctgcggggcaggagaggcgtgcggggagtggaaaccagccccacgcctagagagcaggggatgccgacctggggacctgtcctcaaacttctcctccttgtagtgatccacgactatgtccgtctccacagagatcagcttcttcttgtcaaactcacgaaggtgcagcagggtgagctcatcaaactgctcaaagcagaagagaacctgcaggtggccaagagcagctccatcagaccccgggggcctccagccaccacagaagaaaggatgagggcggcaggagggctgggggagccaagcgggccacactggggaacaccggggcagttggggttcctaggcctgcatgacagttactacgacacctgggtctaaggaaggctctgactgccttcaaggcagaagcactccacgcataaagaaatccacatgtggctgagtgcagtggctcacgcctgtaatcccagcactttgggaggccaaagcaggcagatcatgaggtcaggagttcgagaccaacatggtgaaatgccgtctctattaaaaatacaaaaatttgctgggtgtggtggtgtgcacctgtagtcccagctactcaggaggctgaggcaggagaatgacctgaacccaggaggcggaagttgcagtgagccgagatcgcaccactgcactctagcctgggcgagagagcaagactccatctcaaaaaaacaaaaaacaaacaaaaaaaaccacatgtgacctccaagtgggaaacagccgtcacagtcggtccggcctctgtgcccgtgaccctgacccactgtgcagccctgcccggagtcttgggcaggttcacccagcacagagctgagaaggtcaagaccctccccaggttgcagcccccggagcccgccccacccaccgctcacccacctctgtgtctttcttcttcatggcctcatagtagggtgagtgctctgccaggtgacggttgggggcgcacaggtagtagatgttgcgggtgccggcccgcatgcggctggcgtattctgagaggctggttagctgcccggagggcagcgccgaggactcgtagcgcagcagctttgctatgtcctcctagaagggacggggcaggtcaccacttattccaggcccatgggctcaatgttgcccaactaactgggcgcaaaccctccgatgcccatggcctcctggcactccaggctggccctgacccgagggacggtagtggactcgggggttgtccgagagcaggccttgctctgcccatcaggccccttttgggagctctgggggcttaggaagcacctcctgccccaggtggcccaggggctctccagggagctacgcgcaccacgccctgggaggggaccccacccaacagcagagcccggcctggacccagcgtcttccctctgccctcagtgacagagtcagtctctggtgggcacacggacacgggtgaagtccacggttcccggccctcctcacagctggctatggcagagactggctttgcccagtgggtttcagtgggatttggagaagggcccttaggggaggggtttgccctcctccccatcagctgaacgcagctgtgacctctagagctcatgggagctgcagctggaaggacgcagggggaaaacagaaagagggaaaagcaaggagctggacacccaaccagcagggcccaggccacccctgcacacatggtgggtctgcattgataagacatgtcacacgtgcacacctacaaagacctagaaatgtctctgactcttacctgtgtgctgttaactcaaatgaagataaaggagaatgaagaggcctgtgtcagaagctgccgaagtcggcaaacaaccagaacacggcctccttgggaccccacacacgtggtcaccctcctcctgctgctggggagaagggacaccagcacgggatgggctcctgggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaacaaatgtttcgtttttcagccatccactattggattaactgaacgactggcccctgtagcatagtatttggagactgatatccagtacatgatgaatagtccctcaacagacactgagaccacccacttccccacccacgggatcggagtccttggcttgtcccacctgtctgtggctccccagcccccaacatcctctgaggggagacagtgtgtgcacgccctcttcctgccactccctgggctgcaccttcacacagcagtgaggctgagcccttcagagcacagcacagcactggtgggagggtaaggatgtgcctggaaggtgccagaggcccagaagcctggccttccatttcctgaccctggtggcagcagcagcagcagccagggtacccagctgcaccgtcgccacatcaggggacacctccaccagcttcctcagcagccccagggacaaggtggcccagaaaaaggcctggaacacagctcctataccttgacctcctgctcggtggcggtcacaatgccctcccgcatgaacaggccgtaatcttcaaaaaactttgcatacttctcagcatcttttttactctggtcaatgaagaatttgatcagcctctgctgtaaaacgtcccggagtttcctacagaaaagaaatgcatttaatacatacaagcagcctctatgaaatacaaatggccagagggtacgaaaaaatgttcagccccgctaagaatcaaagaagtgaaaacaacaaggtaccgttattggccaaactgaaaaagactgagcagaaagacagaaaccctgggcagtggccggacaggaggcagcagggtggagggcagacaccccctggaggcagtaggagaaccgatgcccccagagacaagatacccacgcccggaaaacccttccaacctttgagccagttgttccaattataggaactgcaccttaggaaacatgtgagcacaccaagatttatgtaccaggattttcactgtggcacataaaatataacaattatgaacaacctcatgttcaagaatataggctaaaattatgtaatgctaaatggccataaaaaaaaaaaactgcatcttttaataatcctcaatgacatgagaaagttagctgtgttgaaagaaaacccagaaaaatcccaatgtgggtaaattacagtacgtctatagatacaggcaaagaatgcacattctacatgtacataacaattttccatcattaggagcagcactgtatatactatatatgtacactgtaatttgggatttatactgaatatatgtatactctaatttttcaaaattgggattttagggatcaggatatttactgcagcattacataatggcctaaaattaggaacaactttatcactgggactagggatatttttattttcttcttaatatttagtctttcctttaagcaggtaaattacaatgtatttcaataatccagagcatgggaacaacactctctcgagttcatttagagcctttcctcccacactccatccccagtgactcagtccttcagccacagggcagaatgggacaggacatgccttcgtgcctgggagcggggggacagtagcccaggatgcggtgcagagcccagggaaggtgtctatgcagggccatggttgggaagagcctggtatgggtgtcagagcccaagaaccccagagaagggtgtccaggctgggggcgtgaccagcccaccgtgaagagtcagagcccaagtaggtgacagggacacccgcagaagagggcagtggcaatggtagattggttacatggagggggattggtcaaatgggtaaccgtgctaagaataatcaacggggcatggtggctcctgcctgtaatcgcaccactttgggaggctgaggcgggcggatcaccagaggtcaggagtttgagaccagcctggtcaacatggtaagcccccgtctctactaaaaatacaaaaaattaccagggcatggtggtgggtgactgtagtcccagctacttgaaaggctgaggcaggagaatcgcttgaatccgggaggcagaggtttcggtgagccaatacctcgccactgcactccagcctgagcaacagagtaagactccatctcaaaaataaataaataaataaataaataaaaataaaaaaattttattaatgatagcaagattataaactcttgaataaaacaggaaatcagcccatataaataaattataaatagtataaatataacacatcaatttttttttttttttccatccgacgaatcttgctcttgtcccccaggctggagtgcagtggcgtgatctcggctcactgcaacctctgcctcccgggttcaagcaattctcctgcctcagcctcccaagtagctgggattacaggcacctgccaccatacccggctgattttttttttttttttttttttgagatgagtctcgctctgtcgcccaggctggagtgcagtggcgtgattttggcgcactgcaatctccacctcccaggttcaagcaattctctgcctcagcctcccgagtggctgggattacacctgcctgccaccacgactggctaaaattttgtgtttttagtagagatggggtttcaccatcttggcaggctggtaactcctgacctcgtgatccacccgcctcggcctcccaaagtgctgggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgaggccagacgtgtcctcagttcagtgggtgtcctttgccttatccagcccagggacattgtacctggaacctcccctcctgtggccactcctgggcagggtgatggggatggacaaggtggggacaactccagcaccagcaataataatccgggagtcagccccaagccctctcttcactgaagtgaactgaaacattgggcagatcaccagtaacccacaggcgcactcgaagtgcacagggtcagtacaccaaagagcacgactctaacgaccacagaacagtcgctgctgtggggcggggatgcatcctgttgaggtcagcacaactgctgccctgtggtcatgtcggcagcaagtcggggtcctgctgtcagaagccagcacggctgtgtggggaaacaagcactgaggcccccttttcattgattatataacatctctttagtcagcaaggaaaataccttttatatagttatatcttccgaccaagtaaccccacccctagtattctatcctaaggaaatacagctgcaggtaaagatttcagaacaggccaggcgcggtggctcacacctgtaatcccagaactttgggaggccgaggcaggcagatcacaaggtcaggagatcaagaccatcccggctaacacagtgaaaccctgtctctactaaatatacaaaaaattagctgggcgtggtggtgggtgcctgtatcccagctactcgggaggctgagacaggagaatggcatgaacccgggaggcggagcttgcagtgagccgagatcgtgccactgcactccagcctgggcaacagaccaagactccgtctcaaaaaaaaaaaaaaaaaaaaaaaaaaaagatttcagaacaaagataaacatgcactgcagtgtcataactgcagaaacactgagacagcccagctgtgcagccccgagggacgggatcagtaaactatggtacatccctgtgatgtcccatgatgtagcaattaaaagtgcttccaaaaaacaacatgggaagtggtgcaaataaactaggtagaaaaaaggaaacagtataagcaatatgaattcaattgcatgaaaaacaaaaacaggccgggcgcagtggctcaaacccgtaatcccagcactttgggaggccaaggcaggcggatcacgaagtcaggagatcgagaccatcctggctaacacggtgaaaccctgtctctactaaagatataaaaaatcagccgggcatggtggcaggcacctgtagtcccagctgagacgggaggctgagacaggagaatggcgtgaacctaggaggcgaaggttgcagtgagccgagactgcgccactgcactccagcctgggcgacagagcaagactccgtctcaaaaaaaaaaaaaaaaaaaaaaaaaaaaatctaagtggccaggtgcagtggctcatgcctggaatcccagcactttgggaggctgaggccaaaggatcgcttgagcccaggagttcaagatcagcctgggcaacatagtgagatcccaactctacaaaaaaatacaaaaaaattagccaggcatggtagctcacacttgtagtcccagctacttgggaggctgaggtggaaggattgcttgagcccaagaggttgaggctgcagtgagctgtgatcacaccactgcattccaacctggacaacaagaaagaccctatcagtcaaccaataaaacatcactgcggcttgcttggttgaaaaaagaaaaaaatctccatggctttctgcctctgaaggtgaggcaggaggatatcaccggcaggccatgtgacctcgcagggctgggcatggacccaccaggcaggaaaccacactgcccaccatctccccagacctgctcctgcccgcggcacaggacagaatctctgaggaccagtgcctctcggtgtgggcctctcgccatgcccacagcgcagccccaacacacaccaattacccagactcatcctttttccgaggatctgcttccatttcaacactggagagaaaccggtgggcagagaaacactgcaggcacgttgggggctccaacaaggcccgttccatggcatgctgcacgtggtgggctcttgagagacctccagggctccaaattccagctgaatcctcaccccacaggctccctctgaaacctgccctatgtggctgccaatctaccccaccctaaaccatcaacagcagtcatctctaggtgagagcacaggtcacttgaatgtgctctagtaaggaaatactacttgcattaggggaaaaaaagccagtaagcgaggttttgaataaagactatttggtgagcctggggccagagtggggaagtgatagctactgatggagaacctggagccagcacactggagtcccctccacacagggctggcctgctgcagggctgcagtcacaaccctggggcacaggtgggcaggtctggctctgcggcccctccccctatccagactccagcctcagccatgaccagccacccccaccttcttctggaccacaagcttcagaggccaggccagcacctggaaggctcctgagggcccccatgtgcaggccgggcttccccgaccacctctgctctcagctccatgggccacggctagggccctctgggggcaaaggagcaggtaggggccttgtccccagcagggtcctctccccgcggcccgaggctcacctgatgagtgcgctctcctgcagcagctcccggctgaggttcaggggaatgtcctcactgtccaccacacctgggagacacggcagtcagcttctcccggggctgcggccctccacaccacccaacattccccattaacctgccctttgtcttcaggcctggccttcaacccagcacgtgtgctaagagggaagcagggaggcggcactgccggagcttcctctacgtcctgccacctcccagaacagtgacctgggctgtgggtggccgggacagcctcggggtaacactcggaaaatgacagcctgggctttatgttaaaaatcacaactctggctgggcacagtgtctgacgcctgtaatcccagcgctttgggaggccgaggtgggcggatcatgaggtcaggagttcgagaccagcccggcaattatggtgaaaccccatctctactaaaaatacaaaaattagccgggtgtggtggcgggcgcctgtaatcccagctactcgggaggctaaggcaggagaatcacttaaggaggttgcagtgagccacgattgcaccaccgcactccagcctgggtgacagagcaagactcgtctcaaaaaacaaacaaacaaaactctatcagggatggttcgcacctctgtgtaccaaggcttaaatactgaagtctttcttaaactataatctcactcaaacgtaacacaactcacatatcaatctgaaactcagtatccctacatatggaaagacctcaatctgaacaccccagtgctccccccagatcagtcatgtgcgtagggaggtggggcagctcccggggtctgtaaacgcgactgacacacaggcagcgcaggccgacggcggtgctctcgctgcagagggctgctgagaatggaatcagcacggtccctcacagatgcagcgggcgacactgggccacgggggcactgctcacggactctgagcagcgtacctcggatgaagcgcagccacttgggcaggatgtccgtggccttggtctggatgaggactttgcggctgtacagtgcaacgctggagcccagctcccggctcacatcaaacatggacggtttctgggggtgaggagaacacgccatcatgcagcactgaccctccccaggcaggccctggctgggaggtgggggcggacacgatgaatccagagcccactcccgcctcgccctcccccagcgtctgctctgagttgaagcccagtgcaggggccccacgatgccccacactgtggctctgcaggggctgaaggccttctctggcagctgccgccctccccagcccaccccctaaggaggacacaagagagtgaaccttgcacgtacccctgaacacactgaacacagccaaaccttgctacaggtcagggatcagcaaagagccctccgaccagatccagctcactgcctacctctgtgtagcctaagagtggtttttacactttcaaacagttgaggaaagatttcaaaaaggatgatctcatgagacgtgaagatgaaactcaaatttcagtgtctacgcagctcatgggacccggccctgtgtgctcagagggcagcagggcagtgctgcttcctcacccggcagggttagtggctacgaaagacaccgggcccgaaacgctgggaccagctcctgtctggccctcgtggaacgtgcctgccaacacctgctccacactggtacttcccgaaccgggacccacacctcatcacgggatctggttaaaatgcggcgggtatctagttcaaatgttgggagacctggttaaaatgtggggcgacctggttaaaatgggggggatccggttaaaatgcggggagatcttattaaaatgtgggctcccacgcaggagccctgggtggggcctgagactctaacaagcccctggaggccacacctggctggctctttccaagatggatgccagctgtgcaggacattaggagagtttccaggcagccaaggacagaagagcctgggggcaggacgggctggctctcagccccgaataggtctccttacggcaggatttgcgggaacttcaatgtggtaaaggaaaccaggggaggtggagggtgtggaggaagcacacagagaggccaacggagaggcaagaccacaggcccttcccagagcgcctggcaggacagcatccactgatccacagcagatgatgtaggctctgagggccctccccaggcacaccccagtccacaagcctccaccccagcctgcactgagatgcccatcaatccttccctcgccatgtgtgacccctgagacagaggaaacctctgtggttacccacccagaggcatctgttctttttttcttttttttcagagatggggtctcactatgttggccagcctggtctgcaactcctgggctcaggtgatccaccctcctcagcctcccaaagtgctgggataacaggcgtgagccaccacacccagcactacctatgtttttcatgccctcacactgccatgttaatcatgtgacatctgcagagctgatgccacaggggacaacagagtcaccctgagggccgtgggactgccacagtgcctcaccatgtcgggcacgtagaagatgctgcggatgttgagcggtgcgtccgtcttatagtgcagggtgtagcggggcttgtcgtgagcctgcgcgacgtagcggtagaactcctcatgttgccactcacggacatccttggggtccatcatccagatggcctggaaacggagatcggcggggagggcgtcgtgttcaccacgcacgtcttctccaccaccgtgcaggcctgagccagtgcagcgcctggccctggacaggctcctgggacagacgggcggtggtctcaggcgtagacccctctccagccccaccgctgggctatgccgggtagtgcaggggagacacacaaggctctggggcaggagctcctcaggacaacatgtcaggaggaccagccgggacctgagggggcctgtgggagaggatgacgctgcccagcaggggcgagctgacgaatacagtgtgggccgtgagagcgatgacgacccacgctgcaccgcagctgagccgcgagggggaagtcagtcactgaggacagcatgccgtgtgactccatccaggagaaacgtctggaacaggcagcacaatggacagaaaggagaccgtggctgctgggactgggggaggggcagtggggaaagggctgctttttggggtgatgggatgttctggaattgatgcggggtggctgcacagctctgtggctgcactgaacaccatggctgcacactgatgtggtgagccagctgggatgggcgttacgcctcagtgaaccctgacccctgaccccggctgcccggtgcacaggggcagggctgtggtagagctgggcccctgtctcatccccacacccaggtctcatctccacagagcagctcgccctgtgactctgggccgcatcccctgggctcatctcttctccgctgccctgaaacgtacagatttgtctccatgtttgaccagtccctagaggaactcagggctcacctgcaaggtgttcatccgccttccattcaagtacaaggggaagctgacgaagttgctgtacttcgttaccacatctggaagggacaaaagaaaaaccacactgcatctacaatgcttgtggaaacgcaagctttgcagcagctccaggatgagcgccagcctgctgggaagggtcctccatgctgtgtacacttcacaggtacagaaacagggcacagtggggacacctgtcctccccccagtctcacgggggcagcagcggagcccacgtgagaaccagagctgtggaggccccggctgctgcgagactgcaatgtcagcttgtggctggaacatggctttctgggctgactcctgggggtactcagggcctccctgagtgtccagcaggacacaaagagggaaggccacgcccacatcctgggacaggactgcgccaaacccccaggtgcactaaaggccaagggccacgcagaggaaggaggaggaggtccgcctcagccaggccagcttcctcccagtcccagcaggagctcgatgctacgcagccctggcgggcagcccccctcccagtcccgcagcggctcggcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaaagaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggcctggggcactgtgggggactggcccagctccaaatcgggtgccagatgcccaggggcaaaaacaaaggccagggggacaggcgccccctaagaagagcagaaaaccatctccgaagcacaggaggggggaatcccccggcagggccatgttgatgccttggcctaagtttactctgagccccgctcccatggaattaaacaggaatgttagttttgggagagtggggagtcaagctgagcacagtgcacacactgtggagcagaaatggcatcacggagggaggacgcctcggctggctggaagcggctcacctgctaaaaagccctcggagccaggcgtggtggctcacgtctataatcccagcactttgggaggccaagacgggcagatcacctgaggtcggggttcgagaccagtctgaccaacatggagaaaccctgtctctactaaaaatacaaaattagctgggcgtggtggcatgcgcctgtagtcccagctactcaggaggctgaggcaggccaattgcttgaacctgggaggcggaggtggcagtgagccaagattgtgccattgcactccagcctaggcaacaagagtaaaactccgtcccaaaggaaaaaaaaaaaaaaaaagcccccagcaggctcctcaccctatagaggcagaagtgggctggggagacaaagccaggaaatgccagggctgggaggaagcagaatgagctcttgcagaaggtcggtcacaggaggctgcatagtgtccaccaggcgacaggccagtcctgcagctcagccactgagaaaggagctcagcgcgggccggacctgccttcccgagcgcagtggtggtgaccaaccacatgggaccagacaggtgccataggccacctggagccacaaaagtcactaactccccaaaatgggagagtcagatttcatataaaaagcccagaaaatgcctgtgtacgttttctgagtccatccctttccaaactccatgctaagggctccagctcagctttgagctgcctgtcaggcgacattcgtcactcacccatctgaaagccactggtaacccaggctccccggggctgccgagcgggaatagacctccactctgtcagccaccatgaaagctgagtagaaacccactccaaactggccgatgatcttgctgctggcctcagcctggttctgcagagcatccaggaaggcctgtggggcagaggccagttagtgaggcagcctcccctccagagagcagacactcccaacaccgtggctcttctgcgagcaccgctaagaccccttcatcctgaaaacagccacaccgagtacttttccaccccattctacacgtgaagagctaagtcacagagaggtgacacattagccctaggacaaccagctggcagcagtgggacaagtgtgttttccatttgattcccaaagctcacagtcctgcctgtcccagacaggtggaggcctgtgggtcacacctgggggtggggaaagagcagcttgaataagctctttcccttgaataagctccttccataggaaggccaggagtgaggagaggctccaaactggcttccatattcaagtctcctggactctacactttgtgggaaaaagagtagaaatcacgcgcatgcgtctgtaagcaccgcacagcacttcatttttctactataatactgccaaaggtcctaaggccaaagtcaagtaaaatacacacgcccactgccctggcccacgttgtccgatggaactttctccaacaacaggaacgttctgccaggtgcaatgcgacagcctgccgagcacctgcaatgtggcctgtgcagctgaggagcacaatgtccccttttatttaatttgaatgcatttacatttaaactgccacatgcagctggtggccgctacacaggacagcagaccaacctcgagagaaatacaacaaaagacgtaacgtgggggtcaagtcacagttagggtgggttttttgtttgttgttgttgttgttgttgtttttgagatggagtgtcgctctgtcgcgcaggctggagcgcggtggcgtgatctcagctcactgcaacctctgcctcccgggttcaagtgattctcccgcctcagcctcccgagtagctgggatgacaggtaccaccaccacgcccagctaatttttgtatttttagtagagacggggtttcaccgtgttagccaggatggtctccatctcctgacctcgtgatccacctgcctcggcctcccaaagtactggggttacaggcgtgagccaccgcacccgacctagtgttttcatcttacagatgaggagactgaagtaagtgctttgcccagagctggaaaagggcgaccgctggaggttcccaggctgttggtctgagtccaaatgtgttgctctgcctcacagcacttttctgcaaagtcgattccctgagccttgtgggcttgacgcagagagggtcagagggatcagtcccctctcacacagcgccgtgatgagaacgggcttgggatgcggcgtctgtgggtttgatggttctggtcagaactgctctgtgggtctgggcatagtgacgtgcacctgtagtcacgcctcaggaggctgaggctggaggatagcccggccaacatggtgaaaccccgtctctactaaagatacaaaaaattggccaggcgtggtggctcgtgcctgtaatcccagctacttgggaggctgaggcaggagagttgcttgaaccgggaggcagaggttgcagtgagccaatacagttggtcctcctatctacgggttccacatttgcagattcaaccagccaaggatcgaaaatactcagaaaaaaaataaaaaacaacacaatgataaaaagtagtataaaaaacataactatgttatatctatatctagcatttacattctatcaggtattataactaacctagagaccatctaaagcatacaagaagatgtgtctacaatatacggcaccaatttaatccgggactggagcatctgcagactttgctatccaaggggggtcctgaaaccaacccctagatactgagggaccaacccccagatactgagggatggctgtcatgtcatgaggtgttcccacagtacccactgcgtggcatgcaactgacaacgttcttacttaatctggcacccagggccacccctactggagggatccttgcaccctgaggggaagggggaggctgtgtgggggccccacgcttacctttgaccccgatctggcaatcgtccccaggttggacaccagctcttcctgtgtcatcccgataccagtatcctgaggagagagacgcactaagtgccaagcccccagcacctggggagccgggtgagtgcaccagcagtcccagggactcaagtggtgtcaatgacattggccagacagggcccagccaggtagcaccagatgctcatcagaaaagactaattctaggggccgggagtgatggttcatgcctgtaatcccagcactatgggaggccaaggcaggcggatcacttgaggccaggagttcaagaccagcctggccaacatggtaaaaccccatctctactaaaaaagaaattagccaggcatgatggcgagcacctgtggttccagctactcggaggctgaggcaggaaaattgcttgagcccagtgaacccaggaggcagagactgcagtgaactgagattgcgccactgcactccagcctgggtgacagagtgagactccatctcaaaaaaaaaaaaagaaaaaacgaaaagactaattctagtcatagcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggacaccaggaagcaggtgttgggaacgcagctctgcacgcggcacctactcccaccctaccaccatgggaacagcgggcacagacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgagggagcttgcctgccccttccaccttctgtatgaagatgcaagaggcactgcctgagtcaaagggccctcgccagatgcccaatctgctggccccttgctcttggacctcccagcctctagaactgtaagcaatagggttctgttgtttataaattgcccagtctaaggtattcggctatagcagcctgaatcacaatacagaccaacgcgctggtgaacacacaaggccttactgaccatgggctcctccttcctcaaagcccagtcagactcccatctgcagatcctcgctcaacatgcccataatgtagccacagccccagcttgctctgctatgatgtgcagaccaccttaaataaaagagctcactccaagcctccacatctatgaattgggacaaaggccctcagaaacagttttctgaacttccttctaggaagttcctttctaaagacttcctctccaggacagcctgcaggagccatgggagcccactagcaccaggcgccagtgctgtctccattggcaaagcaagggtggtcagtgccactcagcaaataatccacagcaagcagcaggccagggagactggccagctgtcagccttcccattgtaggcagcacaggcagaatgggtgccaaaaccacatcaccaccagttactgcagtgcacacatgtgtgcatgtttcacgggccccagcagccaacaagaaacatggcaccaagaggcttctgggcaattatttctgaggtgccggtttgaatagtccaaaatccagcctgattcatttattgtagatcatgtaataattatgaataaaaaactacttaaaattagtatctagttgatatcagtcattaaatataagtttcatttaagtgtttaatacatcagaaacttaaatagagtccttaagggaaaggttaatgttagaccaaggtaaaggaaaaaatgcaactaatagctcctattttcaatttatttttattttttcccaaactgatctgcactgcaatcccagtctaaatcctcacaggttttgtagaaaatgacaagccgattctaaaatgtatatggaaatacaaagaacttagaaaattttcaaaatattttgaagaacgaagttggagaatttaaaatacctaattttaagacttcctataaagctacaataattaagacagtgcgatgtgggcatttaaggatcgacacatggatgaaagaaccaaacagagcacaggaacagagatgcacagagagtgtattacttgatttttgacaaagattccaaggtaattcaatgggggatgataggtctattaacagatagtactgaaacaactgtacacccataaacaaaacataaacctcaagccctacctcacaccatacacaaaaattaacttgaaatggatcatagatctaaatataagagctaaagctataaaacctctagaagaaaacatagggctggacacaacagctcacatctgtaatcccagcactttggaaggtcaaggtgggaaaattgcttgagcccaggagtttgacaccagcctgggccacaaagcaagaccctgcctctacaaaaaaaaaaaaaaaaaaatttctcgctctgtcacgcaggctagagtgctggagtgcagtggtgtgatctccgctcactgcaccttccgcctcccgagttcaagcaattctcctgcctcagcctcccgagtagctgggactaccggcacacgctgccacacccagctaatttcttttgtattttcagcagagacagggtttcaccacgttgcccaggctggtcttgaactcctgagctcagacaatctgcccgccacggcctcccaaagtgctaggattacaggcgtgagccaccatgcctggcaaaaaaaataatttttttaaagttagccaggcatggtggcatgtgcctgtggccctagctacagggggctgatgtggtagatcacttgagcccaggaggtcaaggctgcagcgaaccctgatagcaccaatgcaccccaacctggagacggaagaagatcctgactctaaacaaacataaaaaccttccaggtcaggctgggtgcggtagctcatgcctataatcccagcactttgggaggccgaggcaggcagatcacacgaggccgggagtttaagatcagcctgaccgacatggagaaactctgtctctattaaaaatacaaaattagccaggcatggtggcacatacctgtaatcccagctactcgagagactgaaggcaagagaattgcttgaacccgggaggcggaggttgcagtgagctgaaatcacaccactgcactccagcgtgggcaacaagagcaaaaccccatttcaaaaaaaaaaatcttcccggtcatcaaaaacaaggaaagtctgagaaactgtcacagccaagaggagctaaggggccaggacaactaaatgtcatgtgggatgctgggagagaaaaaggacatgaggtaaaaactaaggaaacctgaatagacttgtgttaagaataatatatccataccggttgattaactgtaaccaatgtaatatactaacatttctttttttttttttttgagacgagtttcactcttgttgcccaagctagagtgcaatggcgcgatctcagctcaccacaacctccgcctcccgggttcaagcaattctcctgcctcagcctcctgagcagctgggattacaggtgcacaccaccacatctggctaatttttgtatttttattagagatggggtttcaccgtgctggccaggctggtcttgaactcctgacctcaggtgatccgcccaccttggcctctcaaagtgctgggattacaagcgtgagccactgcacccggccataaggtttcaatcataagggaagctgggtgttggagtagatggcaacgctgtactatctttaaaatttttctgaaaattgaaatctgttctaaaatatttactaaaaaaaaaaaaaaactatagatttttcagatgtagacagaaatcatctgttgccaggcgacccgcacaatgtgattttaaaaggaaatggtgagactaggcgcggtggctcccgcctgtaatcccagcactttgggaggccaaggcagtcagatcacttgaggtcaggagtttgagaccagcctgaccaacatggtgaaaccccatctctactaaaaatacaaaaattagccgggtgtggtggcatgtgcctgtaaacccagctacttggggggctgaggcaggagaatcacttaaatccggggggcagaggcctcactgcagtgaggtgagatcataccactgcactccagcctaggcaataaaatgagactctgtctcaaacaaaaataaaaaggaatttgtgagggtttacaacaggtatatacataaaatatttgacatcaaaagaaaaagatgattttgccaccggaatgatactgttgtaagattcttacaatgaagtgttaaatatcaattcaagctagacagtgataaattaaggctgcatattttattccctagaaaatcccctaaaaataacaaaaagcaatgtagctgagatatcagtagatgagatggaatggcataatacctctgagaccccacaagaaagcttccttttctaaaactttaggtaagaataatctatcaatattagttaattaattgtaataaatgggctgggtatggtggctcatgcctgtaatctaacacttgggaggccaaggcgggcagatcacttgagggcaggagttcaagcccagcctggccaacgtggtgaaaccccatctctactaaaaatacaaaaattagttgggcatcatggcacacatccgtaatcccagctactcaggaagctgaggcacgagagttgcttggacctgggaggcggaggctgcagtgagctgagatcacactactgcactccagcctgggcgacacagccacactctgtctccaaaaaaaaggaaaaaagatgaaacaaatggaccatgacgctcccatcggctattgagaatagaaaaactgggtcccaaaggatataatggagctctaaattacctgctcaaattttctgtaaatctagaactgttctttaagaaaaaagaagacaaaagacaaaaccaaaaatcattattgtaacataaatggtcttagtaccaggaagtactggcacatgaggactggcccctctgctaaagaccaagaatcatgtccccatgaccccttgccccagcacatccattttcaatcatctgcaaggaacctctgtgctgaaaacaggaggaaagcacagggcgctgcagccctgcccacagggcccattccacagccaggccagctcagcaaaggcagggagagaagaaacccactccccacccaatccttatgaccaagggctatgacaaacagctggcacgtaccacggggctcagtctggattctctaaacccaagagggagtgcgtaaagctgacacctcacaaaagcccctcctttaattaaaacagccatcccttcacaagtccattcattcacgcgtgcctgcattcatttatgtggcatgaccttcagagcaagccagcaccctaaaagggaatactcagatcccaccgaggccagtctgtccacctctccacagagacagacacccccgcaatgacgccgtgaccctgggatgacaggtcctgaggcagctgtctttggatgcaatgtctctcagggcccctacctgatcctctttggcctaacttttcagccttaaaatttccacaaggctacagcagcagccacagcactgcttcgtcggcattttgaggggaaaacgcagttaaaaatatgaaaagagtacattaaaaataagatatgtttagatatgttaatacctgcatataccaaaaccctgtgtggccatatgctaagatgttaccagtagttattgctggatgatggggtgatttcaaattttcttcttttctgcttacctgcttttccaaaattttctataatgaatgagtgctactgtaacactaaattatagccagagttatcctggtggtacggacggccagtacgtccctgggacccgagacatcactagaaggcggatcctgtccttgctgcatggccgggcctgccacacgcctggacactgagggaggtacctggatggtgatggtgcctttctcggcattggtctgcaagtgaatctccatttctggcagtgcttggccgtcagacaccagtttgtgacgcagtttttccaaggcatcgctggcattggagatcagctcccgtataaacacctacaggaatagaaatgggaggcacagacaatgaaggacactcatcctgcaggatctatctggtcagctgcacttccaataactgttaaaaggtagaggagaatagtcaattctcaaagcataaagagtttctgctttagtcaaaggcagttcctctgggccggtcacaaagtgactgaaggtgctgactttcctttcaggatttctttgagagtctcactctgtcactcaggctggaggctgcaatcacggcttattgcagctttaacctcctggacccaagcaatcctcccacctcagcctcctaagtagctgggcccacaggcatgcaccacacccagctaattgttttaaaatttttatagacacagggtctcgctatgttgcccaggctggtcttgatctcccaggctcaagtgatcgttgtgcctccgcctcccaaagtgttgggattacagacgtgagccacggtgcctggcccttttcaggatttttaatcaagcctgaagttacgtgtccatctgttaattataactttaagaagagccctctggctggggttgggggctcatgcttgtaatccaggcactttgggaggctgaagcaggtggatcacttgaggtcaggagctcaagaccagcatggccaacatggcaaaacccagtctctactaaaaatattaaaattagctgggcgtgatggaacacacctgtaatcccagctactcaggaggctgaggcaggagaatcgcttcaacccacaaggcggaggttgcagtgagccgagatggcaccactgcactccagccccgacagagagagactctgtctcaaaaaaacaaacaaaagaggcctgcgaggaacaatttctttcccaactcctgcacagggatgacggcatatcactcaaacatccatttctccttgatatggtttggctgtgtccccacgaaaatctcaccttgaattgtactcccataattcccacgtgttgtgggaaggacctggtgggagataagtgaatcatgggggccgtttccccagtactgttctcgtggtagtgagtaagtctcatgagatctgacagttttttggggtttctgcttttgtgtcttgctcattctctctttgcctgctgtcatccatgtaagacgggacttgttcctccttgccttccaccatgactgtgagacttccccagccacatggaggtgtaagtccaattaaagctccttctttggtaaattgcccagtctcaggtatgtctttatcagcaacgtgaaaatggactaatacactcctactccacaaaaacaggttccctagcttcatctcatctagtggggaccaccaaacaccaggtctaccacacccggagaaaaacaggcctcagggcccagctgtccctcaggagctgaaaagcacactgacctcaaacagaccttccatttaaaatcagtgagagaggccgggtgtggtggctcacacctgtgatctcagcactttgggaggctgaaacaggcagatcacctcagcccaggagttcaagaccagcctgggcaacacggcaaaactccgtctctacaaaaaaatacaaatatcagccagaggctgaggaggaaggatggcttgagctcaggaggcggaggttgcagcgagccgagatcataccactgcactccagcctgggcgtcagacccagaccctgttccaaaaaattaaaaaaccaaaaaaaaaaaaaacaaaaacccacacaattaaaaatagaaaaattaagtccgcaagagcacataggtgaagaggaagcggtggctgatctgggcggaagctggaggtcactgggagtcaggaatgcagcactcatcagtacgaaacccggaaacagctcctagaaggccctctgagctttgaaatctgctgctttacaaactttcttcaggactctcctttgccttccagcaataatcagcatgtcaacgatggtggccttcatctttctttttccttgtcctgtcaccccaaatgagttttgcggggttttttttaatagagatggggtctcttcacgttgcctaggctggtctcagactcctggactcacacaatcctcctaccttggcctcctaaagtgccgggattacaggtgtgggtcaccgcacctggccccaaatgcgttttaatttcctcagtaactcctccctgctccatacacacaggactggggaaccttcttcctccggcagccaaagccgccaagacctgcaggtagtcccaccaggcaaaggggcctcagagcgtatccaaagctccacagagacggaattcagcagagctgcacgctaggatttgggggactttttttttggagagagggtcttactctgttgtgcaggtcagtgtagtaacacaatcatggctcactgcagccccaaagtctgccaggctcaagtcatcctcccaccccagcctcctgagtagctgggaccacaggtcagtgcccccatagctggctaattttttaaattttttgtagagacggagtcttgctgtgttgaccaggctggtctcaaactcctgggctcaagtgatcctcctgcctcgacctcccaaagcactgagttcccaggcatgagccaccacaccaggcctgtatttcgggaacttttaaaattattggcaaaattcaattaattcccagagttgatccagcccaaagaaccatctggatacacttatccaggaaaccaaaacagattctggtaaaactcctctcactggtagcttaagatgaggacctgtccaaagtttaatgctttctcacagctaatatattatctggcaattctccagaatggcataaaaaccagctttgtgaaaagaaactttgctagcatcgggcatggttagcagggaacgcacctctttttctgagtacagggaccgggcaacaatgtccaaaagcttctttgtctcggcctggaactcatgtttggaagtggaacctagtaatgaaacacagacacaaccaacaaagtttaacttctatttttgtgcaagaatacgctacgtcacattccaaagaaagcttaagtttatgagttttaaacttttttttttttttttttttgagacggagtctcgctctgtcacccaggctggagtacagtggcacgatctcggctcactgcaagctctgcctcccgggttcacgccattctcttgcctcagcctcccgagtagctgggactacaggtgcctgccaccacgcccggctaattttttgtagttttagtagagacggggttttaccatgttagccaggatagcctcgatctcctgacctcatgattggcccgcctcggcctcccacacatttaagatcatgaacaaaaagaaagaagcagacagaaacaaagtctggctgggcaccatggctcatgcctgtaatcccagcactttgggaggccaaggcaggagaatcacttaagcccaggagctcaagaccagcctgggcaacacagagggatcccgccatctctacaaaaaatacacaaagtagctgacggtggtggcacacacttgtggtcccagtgactcagggggctgaggtgggaggatcacttgagccagggaggtcgaggcttcagtgagccatgattgcactacagcactcggcctgggtgacagagaaagaccctgtctcaaaacaaaacaaaacaaaaagtctctcagaaaggaggtctcagggcaggacaaatcctcccactgctgaggccagacatgcctcgggctatgtcgagggaatgctgagcctggtttcccaatgtgcatggttacgagaactggactgcctctaagaaccagattatatgttctttcttttttttttagaggcaggatctggctctgttgcccaggctgctatgcagtggcaggatcgtgctcactgcagcctcaacttcctgggctcaaccgattctcctgcctcagcctctcaagtacctggaaccactggtgtgtgctaccatgcctggctaactttttaatttttttctgtagagaaagggtctatcttgcccaggttggtctcgaccacttggcctcaagcaatcctcctgcctcggcctcccaaagtgctgggattacaagtgtgagccactgtgcctggactatattcttcaaaaaagcggtttccaaattaattagttagaaatcaaaataacaagaaaacctcacttctctttttaacttcaaagattctactcttgtcgacccacttaaaagccagaaatggagccacttcaggactggctccaaagactgcttttttatacttcagagggaatgaaaagacagctccagaattcggtcctgcgcagactgggccaatgctgagtttcccctcccgcttccatgattattagcagatgtgccatgaatcaccactcaggggaggtgccggacggcaaactcacgggtggccaccagagggggcaagacacacccgacactggcagaagtccctcgctgggacagaaatggagggcgcagcactccctacagccaagaccttctgatttcacacctaaggcggtggctctaccaatcactgcctccaccctgaaaatgcccctttacgcacagcagtgaaccaaaaagccctcccagaccaaagcacgagccaaggctaccctgcacgctctctgtgctgctgataatcgagtgcaggggttcctccttgtcctcggcggtctgcgtgctgaacagtcgtcctgcctgcaagctccaggctgggtttcgcctggggcccaactgggctgtggtcctccgaggacacagaattggttttcctgaaaagacaaatatgcagaaagaatgagaattaggaagacacgagaaacaatatggtaattcgtcccatcaagggtgtctagcagaagctagcgtggacatctctaagtcgggctgttgctgaaagagaaatccacaggaccaaatgccacagtgtcagggtgtggttttggcaaggagccctcacagatgtcatcagtgtaagatactgtgtcttctcagaaccgcagaagcgaaactggagggggtgggctgctgccttcttttcagagggggtctcgctctgtcactgcgatcacagctcactgcagccccaacctcctggactcaggcaatgctcctgcctccgcctcacgagtagctgggaccacaggcacagaccaccatgcccccataattttttaaaaaattttttgtagaaatggggttttgctatgttgccaagactggtctcgaactcctgggctgaaaccatcttcccgccttggccttacaaagagctgggatgacaggcgtgagccaccatgcccagctggcagatgcctgctgacagcacttcccacattcgcctcacgggtgacacctcgcatcaacctaccaaactgaaacctgtctcgaccctcgcagcccctgcagaagcccccgatgggccacacttctttgctcttgacagtcaagcaaaaaaaaaatcctcccaaaagggatccaaatatttaaatgttaatattctgaaactgtctcatcttctaaaagttgattctttcccattgctttttcatccaaaacagattttttaaaaaaaatttgtgtactttaaaaactgaaaaacagctgacgatgggttctaccttctaactaagaaggagacttgtcttctgtaacttcctgctcagtccagtgggctgagaaagttgccggcagagcccagcgagggaggaaagcagccaatgtgtccccagccgcacgcagttcaccgacgcaggcccagaaaccagacactttcactccaacacaggactggaccgacccaacaccaacacccactgaccccagggaccacataccaggaccctgccttggtcagtagatttgcaatacgtgatggtgtcaaggatatgtggccagccagccacgccgtgtcaaagtctaagcctaaatgaaccgcatctaactgggagcctctcctgttcttcacaaatttgtaacaagtagaaaggaaagacaacagaatatccaggaatcaaggttttaaaaatcagcatatcagccaggggtgcggtggctcacgcccgtaaacccagcactttgggaggctgaggtaggcggatcacatgaggtcaggagttcgagaccagcctggccaacatggagaaaccccatctgtactaaaaatacaaaagttagccgggcatggtggcaggcacctgtaatcccagctactcgggagactgaggcaggggaatggcttgaacttgggaagtggaggttgcagtgagccgagatcgtgccgctgcactacaggctgggtgacagagcaacattctgtctcaaaaaaaaaaaaaaattaacatatcaactttcatactcctaaaaggtacaaaaacttgccttttttttttttttttttttgagatgaagtctcactcttgttgcccaggctgcagtgcaatggtgcaatctcggctcattgcaacctccacctcccgggttcaagcgattctcctgcctcagcctcccgagtagctgggtttacaggcgcctgccaccacacccagctaatttttgtagttttagtagagacagggtttcaccatgttggccaggctggtctcgaactcttgacctcaggcgatctgcccacctcagcctcccaaagtgctaggattacaggcatgagccaccgtgcccagccaaaacttgcctattctttaggcttattcctggacttacaaacagcacaaacctggccttttgtttttgtttttttttgagatggagtctcgctctgtcgcccaggctggagtgcagtgatctcggctcactgcaacctccatcttctgggttcaagcgattctcctgtctcagcctccaaagtagctgggactacaggcaccagccaccatgcctaatttttgtatttttagtagagacgaggtttcaccttattggtcaggctgctctcgaactattgacctcaggtgatccacccacctaggcctcccaaagtgctgggattacaggcgtgagccaccatgcccggccaaccctagcctgtctttatctctatgcagataccttaaaaacatctaccacaattcagaaagtattcaaattccaaaccatgtaaacatccagttatttgggcccatgtaattgcattgttcactttattcgtacagttaaaaaaaaaaaaaaaatcccgggacatttcttctggaattaaatggtatttggcattagaggagttcgcgaacagtctacatcaaaccagggtgctgaagtctctgtgcctccttccaaagcacagccagccctgggggcacaggagggaagtgtccaagtgccaacacctgcccacagagcatatcagtgtttctcaccatttgtgtaaaagaaacacaaaaaggataaaccagaaactgatgtgactgtgtattttgtttcctaggactactgaaacacagcaccacaaactaggcagtttcaaaaaggtccacagttctgagccaggcacacaacctcacacctgtaatcccagcactttgggaggccaaggcaggagaatcgcttgagcccaggggtttaagaccagcctgggcaagaaagtgagactccatctctgcaaaaaacacaaaaactagccaggtgtagtggtgtgcacctgtagtcccagctacttgtgaggctgaggtgggaagatcacttgagcccaggatgttgaggctgtagtgagccaagatcacactaccgcacttctgcacttcaggctgggtgagacagcgagactctgtctcaaaaaaaaaaaaaaaaaggtcccaggttctgggcagcggtgcttcccactggaggtgccgagggagagtccatcccgcacctctccccagcttctggcagtagccggcatccttggtgtttcatgctttgcagaccctccaggctctgtctcttgtcacatggcaagctcttctctatgtgagtcctggctgtgtccagatttccctcttcttatacggataccaggaatactggagttaggccccacccccatgcagtgtgacctcatcacaacctgatacatctgaaatgacccaaataagctcacactcacaagtaccagggatgaggacgcgaacgtatctttctctttttttttttgagacagagtctcgctctgtcatccaggctggagtgcaggggcatgatctcagctcactgcaacctctgcctcctgggttcaggcgattctcctgcctcagcctccctagtagctgggattacaggcacgcaccaccatgcctggcttttatttttaaaagagacatggtttcaccatgttggccaggctggtctccaactcctgacctcaagtgatctgcccaccttggcctcccaaagtgctgggattacagacgtgagccaccatacctggcctctttttaaaaaagaataaaaatagagacaaggtttctctttgttgcccagcctggtcttgaactcctggactcaagtaatcctcccactttggcctcttaaagcactaggatgacaggtatgagccactgtacccggccttcaaaccccacagcttggttacctacaggaggtgtgtattaaactccccgtggcacaaacccggtagcttacagtaacagacacttattctctcacagtcctggaagcaagaagtccaagatcaaggtgccactagggctggttcctcctgaggctgggagggagggtctgtttgcgcctcttccagcctctgcagcctctggcgttgcttggcttgtgggtggtcatcttctccctgtgtcttcccttcaggacgtctgcccttctccctctacacatgtctgtctgttcaaatgtccccattttataaggacacagtcatactggattagggcccacccaagtgaactcatcttaacttgatcacctgcaaagaccctatttccaaatatggtcacattcacaggtactgagagctgggacttcaacatctttcgtggggagacacaattcaacccccaaccagcatatgtacagagaatgcaaagaaagcgggaaggggagagggctggcagagctgagggaacatgacacttccacatacatcttttcgtatgtctctcttagaaccatggtcaggtttctcatactcaaaaaacaaaccattacttagccagacgtggtggcgcacttctagttatcagctactcgggaggccgaggtggaaggactgctcgaacacaggaggtggaggttgcagtgagccgaggtcgcaccactgtactccagacttggcgacagagtgagactctgtctcgaaaaaaaaaaaaaaagaaaagaaaaagaaaaagaaaaagaaaccgtgaaaacaaaacagggcgcacatgaacacaaaatgaaatacaaacagcaaatatgcagagctgtgacgatgacatcaccactctgaaagaagaactaacctaagagacttcagaaaatagcactttgactgttactgtaaaactaacctcagaggacagcacaccatcaccaggctcgggcaggagatgtgtcccctgcggagtcagcaggtctgagcccgatttacgcatgtgccaagatcaagcggaaaagctgattgtggctactgagttggggtcctcacagttgaagaaaagtcactgataaggaaggggcaggaataaaccctgcggggcggcactggaggtacaggcatcagtacaggctcacaacctttgccatgtgtacagactggatgcagaaatcaataccggaacatttacacacacacatttcccagctctgtccactgacgcgtgacagggcccaggcgcgatgaccccccacttaggctacagagagcaaagtccaaaagctgttccagtttcagcactctaaagtcccacgtcccagggaaagcctttgtcctggcaaactaggacggctggtcaccctacctggcagccagatcttggtttgtgaatacctctctccaaaaacaggaaccagagatccctgcggagcacacagaggagcctaggacacccagtggtgtgcagaaggacgagaaaggacggggtgtgtcaggagaacacacagcccagccagaagggctcccagtggcagaatctaggacaatctgtgcggcaaaataacgaacgacaataatggattgtaagctgtgacccggcaaatcaagcaaacatcggtgcacacttaaacagaggaggagcagcagctcttcatcacagcagaattccaatgaataaacacaaggaatggcagaaaacagaaagcacaccatcaggaaacaccacagcaataactggctggtgtaagttactactattttgagacagggtctcactctgttgcccaggctggatcacaatggcacaatcacagctcactgcagcctcgaccttcccgggctcaggtgatcctcccacctcagcctcctgagtagctgggactataggccgtgtattaccactcctagctaattttttttttctttttttttttgactgggtctcactctgtcgcccaggctgaagtgcagtagagtgatcttggctcacagcagcctcaaccctccggattcaagtgatcctcccacctcaaccttccgagtagctgagactacaggctcatgccaccatacccggctaatttttgtgttttctgtagagacagggattcaccatgttgcccaggctggtctcaaactcctgagctcaagtgatcccccggcctctgcctcccaagcgctgggattagagccgtaagacaccacgcccagcctaaggttatgtatttgaagcagtggtagatactgccaagtcacactccacagagatcctatcagtttacgttcccacagcaatgtactaaagtgcatatcatcctacattcctgccaagtcagtgttgagatgaaactcttggatctttgcctattggtcagataaaattttcactgcagttttcacttacatttctcttattataagcaaaactgagcactgtcccgtatttttaaatatttcctatttccttttttgttaagggactgttggtatcctctgataatttttctactacattttaaatcttcttcttattgatttgtaagagctttttatatattaaggaaattagtcgccaggagcggtggctcacacctgtaatcccagcactttgggaggccgaggcgggaggatcacgaggtcaggagattgagaccatcctggctaacacggtgaaaccccgtctctactaaaaatacaaaaaattagccaggcgtagtggtgggcgcctgtagtcccagctacttgggaggctgaggcaggagaatggcatgaacccgggagacggagtttgcagcgagctgagatggcgccactgcactccaccctgggcaacagagcaagactctgtctcaaaaaaaaaaaaaaaaggaaattagtcttttggttgtaaaagccttcctcactctaagattaaacatgatttccccatgtttcatttttctagtctttttggtttttccccaattaatatgcagaattttttttttttttcctcgagaaggtcttgctctgttgcccagagctggagtgaaatggcgtgatctcggctcactgcaacctctgcctcccaggttcaagcaattctcctgcctcagcctcccaagtagctgggattgcaggtgtgcaccaccatgcccggctaacttttgtgtttttttgtttttttgtttttcttttttaagtagagacagggtttcaccatgttggccaggatggtctcgaactcctgacctcgtgatccgtctgcctcagtctcccaaagtgctgggattacaggcacaaaccactacacccagcctatatttttgaaaggatttaatataatattcattatgggaggagtatatagaagtcctcacaattgggaaaaagaaaaaaataagaaatctatatttccagccagaattgcaagacttagtatcataacgccaagattacattaattgaattgacagcattcttaaaagcagatttgatttcaggttatgtaaactttccacaacaacttttttttttttttttagagtctcactctgttgcccaggctgcagtgcagggcgccatctcggctcactgcaagctccgcctcccggattcatgccattctcctgcctcagcctcccaagactacaggcgcccgccaccatgcccggctaattttttgtatttttagtagagatggggtttcaccgtgttagccaggatggtcttgatctcctgacctcgtgatctgcccgcctcagcctcccaaagtgctgggattacaggcgtgagccaccgcgcccggcttctacaacaacttttaatcactaactcaggtgcagtggctcatgcctgtaatcccagcactttgggaggccaaggccggggggtcgcttcagctcaggagtttgaaattagcctgggtaacatggcaaaaccccatctctacaaaaaaacagccaggtgtggtggtgcatgcctgtagtctcagctacttgggaggatcacttgagcctgcaaggcagaggttgcagtgagccaagatcacgccactgcatttcagggtgggagatgcagccaggccctgtctcaaaaaaaaaattaaaaattaaaaaaaaaataaaccattagaggaataaatctgcctgaaccagataccaaacacgctagctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgggaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaaagatttattcatgtatttactatttctttctttcttagaaaagagattgctctgtcacccaggctggagtgcagtggtacagtcatggctcactgcagtcttgaactcctgggctcaagggaccttcctgctttactctcctgaacagctgggactgcaggtaagcaccatcacacaggactaaattcttttttttttttttttcctagagatagggtgtttccatgttgaccaggctggtcttaagctcctggtctcaagcaatcttcctaccttagcctcccaaagctgctgggattacaggtctgagccaccacgcccagcctgtgctgctcatttgaaactgctgctatatgccagcatatgacatttcccactgttaattttttggttaatgtataatttatctcaccaaattagggcaggaaaaagcttgtatttctcagtaacactctttgaagacaggaacatccatatttcttggtatgccaaagtatctatcacaaaagctactctttacaaacttttttttttgagatggagtttccctcttgttgcccaggctggagtgcaatggcgcgatctcagctcaccccatcctcctcctcccgggttcaagcgattctcctgcctcagcctcccgagtagctgagattacaggcatgtgccaccacgcctggctaattttgcattttttgtagagacggggtttctccatgttggtcaggctgctctctaactcctgacctcaggtgatccgcccacatcggcctcccaaagtgctaggattacaggtgtgagccaccacgcccagacttttttgtttgtttgtttgagatgcagtctcactctgttgcccaggctggagtgcactggcacaatctcggctcactgcaaactccgcctcccagttcaagccattctcgggcctcagccgcccgagtagctgggactacagatgcacatcaccacgccaggctaatttttatatttttagtagagatggggtttctccatgttgcccaggctggtctcaaactctggggctcaagggatcctcctgcctcagcctcccaaagtggtgggattacagaagtgagccaccgcacctggccaagggtgcatatttcaaacaccagagtaaccactaaaataataattcaaagaagaatagctttaaaaagcattagataaaccacaatggaaatctcaaatacatttcattgataaggaaaggaaaaacagggaaaaaatccaaaaggacaaataaaaggcaaataataaaatggtagcaataaatccagccacatcgatatttactcttacattaacagactgaactctaattataaggcaaggattgtcagaattggtaaaggaagacctaattacatgctatctacaagacactttaaacataaagaaaaagatacacttaagacaaatgaatggaaaaatacataccatccaaaaagtgtgtttaagaaagctggagtggctctattaatatcaagtaaaatacatttcaaaataaaaaatattattaggaaaaaagaaggatatttcagaatactacaacaaacaattcatcaggaaaatgtaatcacaagtgtgtatttgcctaataacagagcttcaacatatatgaagttaaaacggaaagaattaaagacaaaacaattccacaatcacagctggagatcttaacactcctctctcaataactgacagaatcaaaccaaaaaataaaacagaagccgggcacagtagctcacgcctgtaatcccagcactttgggaggctgaaacaggagaatcgcttgaacccgaggcagaggttgcagtgagctgagatcgcgcccctgcactccagtctgggtgacagagtaagaccctgtcccaaaaaaaaaaaaaaaaaatagccagacagtccagaagaaaaacctggggcaaaagatatgaacggcatttcacagtggctacagaaagcgaaggagcaccaaactatatatgaacacagcaagctctccacgagctatgtagtgagtaacagaacacagagaagggtgcgtccctgagggaatatgtacatctgcacttactacagtcatacaagtaagtagtggcaggacccacaggcaactaatagtggttatgaagacagcaggtgctctgaacagcagcaagacttctcaagctttacctgttcacatggttttggttaatcaaaccatatttatttattcaaaacagatattaaattattaaaaatatgaggctgcccggcacggtggctcacacctgttatcccagcactttgggaggccaaggcaggtggatcacaaagtcaggagttcgagaccagcgtggccaacatggtgaaccctgtctctactaaaaatacaaaaattagctgggtgtggtggcgtgcacctgtaatcccagcctgggcgacacagtgagactccatctcgggcgggggaaaatatgaggctgtcacaaaagtgctaatgttttccctgctgtcgatgttgaggtcacttgaaagctggtatggacacatcggatgaggaattcagtctaggggcctcttaggagccaaggcccaatgactagactaagtggacccagcaaacacagagggagggggcctgaggcacaaacacagacaaggtcctatgctcgaggcaaacaaggacgaggtacaaggtgagagccagaaggggccactgtgctgcttcacagacctgggaagaagttttttgagaaaagactttcatttttcaagaggcagatcattttaaagaataaggcctagggcagtggctcacacctgtaatcccagcactctaggaggctgaggcaggcagatcgcttgagcccaggagtttgagaccagcatgggcaaactggtgaaaccccgtccctaccaaaaatacaaaaacttaggtggacatggtgacacgcacctgtagttccagctacttggggtacttgaggcggaaggatcacttgagaccagagggtaaaggctgcagtgagccgagatcacaccactgcactctagcctgggtgacaaagtgagaccctgtctttaagagaaatttaaaaagctgggtgcggtggctcacacctgtaatcctggcactttgggaggctgtggtaggcggatcacctgaggttgggagtttgagaccagcctgaccaacatggagaaactccatctctactaaaaatacaaaattagccaggtgttgtcgtggatgcctgtaatcccagctacttgggaggccgaggtaggagaatcgcttgaacccaggaggtggaggttgtggtaagccaagatgctgccattgcactccagcctggagaacaagagtgaaactccgtcttgaaaaaaaaaaaaaaaaaaaaaaagcattcagtaagatggtagaatacaaaaatcaacacccggacgtcctatatacagaaaactagttagaaaatatgacataagagaccccaggaacaaaaactaaacaattaagaatgcatttaccaagaaagcaaaatctttccttttttttcttttttggcaagatcttttaagaaaactctgaaacactactagggccaaagactgtcattaaataacccacttaagactgttacatatgctacatactcacaagcggaggactaacaagtaaactacagacgtaaggtaacacttggaaagcatgggattatagagaaatgggacaatgctgtgtaatgtgtgctgatgctgaattacctctaacacaaagaaaaaacactagaggtagaacagcggtttgcacacactaccatggtgttcaaatgcatatacatgttatgtgatacatgcatgcatagctattctcatatgccacgcagatctctgcaaggacacccaaaaactggctaatggacttgccaccaggaggggtgttgtctgaggcatgtcagtgggagacgagtttttcatcagatatacctctgtatcgtttgcatattggactacatatatcaataatctacaaaataaataccctacttataaaactatttacaaaagttaggctgggcgcggtggcttacgcctgtaatcccagcactttgggaggccgaggcgggcagatcacgaggtcaggagatcaagatcatcctggctaacacggtgaaagccagtctctattgaaaatacaaaaaattagccgggcgtggtggcgggtgcctgtggtcccagctactcgggaggctgaggcaggagaatggagtgaacgcgggaggcggagcgtgcagtgagccgagatcgcgccactgcactccagcctgggcgacagagcgagaccccgtctcaaaaaaaaaaaatcaaaaaacaaaactatttacaaaagttacattacaggccaggtgaggtgcctcacgcctgtaatcccagcactttgagaagccaaggtaggcagatcagctgaggtcaggggtttgagaacagcctggccaaaatggtgaaaacccgtctctactaaaaatacaaaaattagctgggcatggggatgcacacctgtaatcttagctactcgcgagaccaacgcactagaatcgcttgaacctgggaggcagaggttcagtgagctgaaattgcatctctgcactcgagcctaggcgacagcacgactctgtctcaaaacaaacaaaacgttgcattataaaaaacacttaaaaacttacgagaaacataaacacatttacaaaatttcaaacacatttttaaactattctcattctaaaattcatgtggaaaagttagtgtacataaatagccaaagaaattttgaaaaaactgaggaaattcatcaaatattaaagaacattaatataaagctacaatattaaaataaatttccagaccaggcatggctgctcacacctgtaatcccagcactttgggagggagatccaggcaggaggaggctccctcgagctcaggagctcgaggccagcctaggtaacatagggagacccccccaactctcaaaaagtaaacacacacaaaaaaaggttaaattaatttccagcagggcacaggggctcatgtttgtaaccccagtgctttggaaggccaagttgggaggaacacttgaggccaggagttctagaccagcctgggcaacatagcaagaccaacctcttatttttttttttttaatttccgctgtcacttattaagtcaaaatgaattccagatggaccatagaagtaaaaataaaagctaaaagtactgaaagaaaacatgaaagatttagtaactttattgagatgtaacacatctgccatataattcacccaagtgcacaattcagtggttttagtatattcacaaagttgtacagccacgaccactaaccacagaacatttttttttttgagacggagtctcgctctgtcgcccaggctggagtgcagtggagccatctgggctcactgtaagctctgcgtcctgggttcatgccattctcctgcctcagcgtcccgagtagctgggactacaggcgcccgccaccacacccggctaattttttgtattttttttttagtagacacagggtttcaccatgttagccaggatggtctcgatctcctgacctcgtgatccgcccgcatcggcctcccaaagtgctgggattacaggcatgagccaccatgcccggacaactacagaacatttttatcaccccaaaagaagccctacagccactcatgttcactctcttttccctctcccaccagctcttggcaactactcatctatgtctgtctctatggatttgccttttctgggcacttcacagaaatgaaatcatacaatatatggttttttgtctggcttctttgacttagcataaagtctttggggttcatccacatatagcatgtatcagcacctcattcctttttataactgaagagcactccgctgtatagattatttttttccattcatcaaatgatgggcaactgggttgcttccaaattttttgtgagacagagtttcactctcgttgccaggctggagtgcaatgacatgatcttggctcactgcaacctctgcctcccgggttcaagtgattctcctgcctcagcctcccgagtagctgagattacaggcatgtgccaccacacccggctaattttatatatatatatatttttttttagtagagacggggtttctccatgttggtcaggctggtctcaaactcctgacctcaggtgatcggcccacctcggcctcccaaagtgctgggattacaggcgtgagccaccagtcccggccctttttttctttttttttttttgagacggagtctcactctgcagtggtgtaatctccgctcactgcaacctccaattcccagggtcaagtgattctcctgctgaggcacccgccaccacgcccagttaatttttgtatttttagtagagacgggttttgccatgttggccaggctagtctcaaactcctgacctcaagtaatccacccacgttagcctcccgaagtgctgagattgtagacatgagccactgcaccaggcccagcttccaactttttactgtaacttttgttttggggtggggtgggggtctcactatgttgcctggagtgcagtggctgtttacaggcactgtcatggtgcatggtagcctccaactggcaggcttaagcgatcctcccacctcagcctcccaagcaggtgggattagaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctcctgaagtgctgcaattacaggcatgaccaaccgcacccagcctcgtttccaccttctgatggaccttcagattgttttcattttcgggttattatgaataatgctgctatgaacattcatgtgtaggctgttctgtggacatgttttcatgtctacaaggtatgtgcctcagggtagaactgtggggtcatatggtaattcggtttgactgtgtgaggagctgcaagaatgttttcctgcagaggtcgcaccgttttacattctcaccagcagtgtgggagggttctgatttttccacatcctagttatccattttgtatcacctgtttttttgttgttgtttctttaatttttaattatagccaccctagtgagtaggaagtgctaactcactgtagttttgctttgcagttcctaaactgccaggcatcttgagtttttaaaaaaaatgatttaagaggaaatctttttttttttttttttttgaggcggagtctcgctctgtcgcccaggctggagtgcagtggcgggatctcggctcactgcaagctccgcctcccgggttcacaccattctcctgcctcagcctcccaagtagctgggactacaggcgcccaccaccacacccggctaatgttttgtatttttagtagagacggggtttcaccatgttggccaggatggtctcaaactcctgaactcgtgatccacctgcctcagcctcccaaagtgctaggattacaagcgtgagccaccgcgcccggccttaagaggaaatgtttctaaacaaaatatataacccaaaaggccataaatataaggaccacataaaaatttaagtcaaaagacaaacacccgggtgaggtggctcatgcctgtaatcccagcactttgggaggctgaggtgggtggatcgcctgaggtcaggagttcgagaccagcctggccaacatggtgaaaccccgtctctaccaaaaatacaaaaattagctgggagtcgcagcgggcatctgtaatcccagctactccagaggctgaggcaggagacttgcttgcactcgggaagcgaaggctgcagtgagccaagatcgtgccactgcactccagcctgggcaacagacagagcgagactctaactcaaaaaaaaaaaaaaaaaagacaaacacattaagaaaaaaactgggggccaggcacgacggctcctgcgtgtaatcccagtactttggcaggcagaagtaggaggatcacttgagaccaggagttcaagacaagccggggcaatatagtgggaccccatctctaaaaaaaatgttttttaattagccaggcatggtggcacatgctccttgggaggaagaggtcacagccacttgggaggatgaggcaggagtatcacttgagtccaggaggtcaggcctgcagcgagccaggatcgcacaactgcactccagcccggatgacaaagcaagaccctgcctctaaaataaaatttagtgccgtggctcacgcctgtaatcacagcactttgggaggtgggggcgggcagatcccgaggtcaagagtttgagactagcctggccaacatggcaaaaccctgtctctactaaaaatacaaaaaaaaacaaaaattagccagaaagccaggagcagtggctcacacctgtaatgccaacactttgggaggctgaggcggatggatcatgaggtcaggagttcaagaccagcctgatcaacatggtgaaattccatctctactaaaaatacaaaaattagccgggcgtggtgacgggtgcctgtagtcccagctactagggaggctgaggcaggagaaatgcttcaacctgggagacggaggttgcagtgagccaagattgtaccactgcactccagcctgggcgacggagcgagactccatctcaaaataaataaataaataaataaaaataaatgagccgggcatggtggcgcgtgcctgtaatcccggctacttgtgaggctgaggcgagaggactgcttaacctcgggaggcggaggttacagtaaggtgagatggcgccactgcactccagcctgggcaacagagtcagactctgtctcaattttttttttttttttgagatggagttttgctctgttgccgaggctggagtgcagtggtgcgatcgcggctcactgcaagctccgcttcctgggttcacggcattctcctgcctcagcttcccaagtagctgggactacaggcgcccgccaccatgcccagataattttttgtatttttagtagagatggggtttcaccgtgttagccaggatggtctcgatctcctgacctcatgatccgcccgcctcggcctcccacagtgctgggattacaggcgtgagccaccgtgcctggcccgacactgtctcaatttttaaaagttatttaaaagggctagcgcagaggttacggtgagccaagatcacgccactgcactccagcctgggcaccaagtgcaaaactccatctcaaaaaaaaaaaaaaaaaaaagaaaaaggccattggttcaagagaaaaatggccattcacaaaaacaagaaacatcaatggctttacgtcctagtaaaagatgttttaccacactcataactaaggaaatgcactttaaaacgagatagcattttcactaccagattgacagatgttttaaatactgtcattctagcactggtgaaggtgtgagaaactgttggcaatgccgtctgttatcttggggaaactcagcaacaacctaaatgtccgccatgagagggttacataaattacaaaacatcctcgctatggaataccagagctctgtggcgacaggaaacaaaccccagaatataagtggaaaatgcaaggtacggaagattacacacggttccttcccagtttacctttgtttcccttttttttgtgtgtgtgtgtgagacggagttttcgctcttgttgccaggctggagtgcagtggcgccatctcggcacaccacaacctccacctcccagattcaagcgattctcctgcctcagcctcctaagtagctgggattacaggcatgcgccaccacgcccggctagttttgtatttttcgtagagacagggtttctccatgttggtcaggctggtctcaaactcctaacctcaggtgatccacccgcctcagcctgccaaagtgctgggattacaggcgtgagccaccgcgcctggcgagaagattcttaagtacatgaacattctgaacagaaagacctgtattccctcacaaatgtctgagttcttagctctggcattctcaacactcactgtttcttgaggtttcctgtgttccagaacctggtctaatcgttctctactatgatatactgatacttcattcatcaggaaacataactccttgaacataaagaaaaagaacaaaaagcgaaagggcacctcggaatagtcaaaatatgggcctgaagccctcaccctgagctttgctcatggaagactactggccccatatgaaatccatctcattctaacaatttgatgctaacaagtttcccagccacatctgcaaactaggaaaggagagaacagggctccagacagacctgcaagttaaggccacagtaagagaggccaaaaatataaacactcacaatgcagttttgatgtggggacacttcatagacgaaggattcttcacatttcaatggccctacgggagcctacatattaaaacagaagaccaaacattaacacccgtaataatgaccctgaaaacatccaagagaggttcagtcatgggccatcaaatgatggagtgttctagaaagacttctcatcataatggttaaaatgaaatgttttaaagtcagcctcgtggaaaattcgcttgaacattccattgcctgacaaatgctgaaatactggcaagtgtgaactaacatggcaatgtgctgtcttaatttctccttcgaggtgcatatcactaacccgacacacatagttacattagaaggacccacgtccttctgtcttcttctcagcagcattgctgaatagcctcctgctcttaatatggcatttaatttagctatctcaaaattaatttcttttatatgtgtgtgtgtatatatatatatatatatatatttttttttttgagacactgtcactctgtcacccagactgtagtgcagtggcgtgatcacagctcactgcagcctcgacttctcaaggcttaagggagcctcccacttcagcctcttgggtagctgggaccacaggcacacccagctaattggaaaaaaaaaaaaaagggttttttggtagagatgggggtctctctaggttgcccaggctggtctcaaactcctaaactcacaggatcctcccgccgcagcccccaaagtgctgggattacaagcatgagctaccaggcctggccaattttttaccttctagccacatttcttaattatatggctatgaagtaactgagccattccttttaaaaccaatgattcagctacatgtcctttcaatctacccaatctacaggaattcacctggttaaaaagccaatggcagggctgggaacggtggcgcacacctgtaatcccagcactttgggaggccgaggcaggcagatcacaaggtcagaagttcaagaccagcctggccaacatggtgaaactctacctcaactaaaaatacaaaaattagccgggcacggtagtgcatgcctgtagccccagctacttgggaggctgaggcaggagaactgcttgaacccgggaggtggagattgcagtgagccgagttcgtgccactgcactccagcctgggaaacagagcaagactccatcttgaaaaaaacaaaaaaaaaacaaaaaccaaaacaaaaacaaaaaaaacacaggtggcagtaatactcccgcaagtagatactgtttctccaagctacagcttttatggtaattcctagtggttttagcagaaataaccagccacaccacaaataaactccctgaaatctattttgttaaatgctgtggaactacagggaagccactttgtggactaagagcagcttcctagtagaaggcaggtcttcagtaggactaagcaggacggtggtaagaaaagttctagctggctacacttgaggcaccaaaaacgccatccatgaacattctctggctttgaacccaaaagcactttttacttcatttgagtatgaatggatacattttcaatcgctatcaagattctttgtcaggcccgacgtggtagctcatgtctgtaatcccagcactttgggaggccaaagcaggcagatcaaaaggtcaaaagattgagaccatcttgcccaacacggtgaaacctcgtctctactaaaaatacaaaaattggctggccatggtggcatgcacctgtagtcccagctactcaggaggctgaggcaggagaactgcctgaattcaggaggcggaagttgcagtgagctgaggtcatgccactgcacttcagcctggcgacagaaagaatctgtctcaaaaaaaaaaaaaaaaaaaaaaaaaaaaaaaaaagatatgtcagcattttgagacaagcaagtatcacaggcctcagtaacagcctctttcatggaactcacctttgtcacatggtatttactgacatggggggcaggagtaaatgtttattttcccacagttttcttatcaacctgacacccccatccccaccccgcaagctgcattccctctcttcctgccaaggggtagcaaaatacttggagattcctcttttgtcttagcttaggccaactactcacccagtaaccaataaacgctttgctaatctcttacattcggattgatgtgtttgtttccaagacagagtcttgcactgtcgcccaggagggagtgcagtggcacaatcttggctcactgcaacctccaacctccacctcccaggttcaagcaattctcgtgcctcagcctcccaagtatctgggattacaggcgcctgccaccaccctggctaatttctttgtatttttagtagagacggggtttcgccatgttggccaggttggtctcaaattcctgaactcaagtgatccacccacctcggcctcccaaagtgctgggattacagacgagagccaccgcgcccggcctgatgtgttctttttcaggcactcagataactcagttcccttggtcctaactaagctgaaggtcctcctggtggccttggacagctgggccacaccttcctctgccgtctaagtgccagcaccacagcttaatcagacgacaaacatgtcatggacgctacacctctagcgtcatctcagcaacacaaagagctgtttcacagacagagtcgcaactgaccagcaagtactactcccctccactctgaaaagaacagccggagagcaccagaaattcacctgaattctcctgaagggtgcagcacacaagacacggaaatcaaacagcacaggctccaaacaaagggagagcagagggaggaggcaaaacccgtcaacaaaacgaagtactgaaggggagggcgcagcaggcaggcaccacctacaggagcggggtccaggtgaggctctttttggaagatgaaacaaactagctagtacttgagccctgagcaaagtgaggaaaccagctctcccgaccttcctggtgctggcaggggacctactctcacaactctgatttccaagacaggaagttccagcaaaggctccagcttacagagaacaaaaaggcccaagatcttaacgcctgcaccaaccagtcctatcgtggttgcctcagtcatgttctggcaatttcacgaaaacaagagcatctggcatgaccaggagactggactcggcacccttggtgattgtggcagtcacctcgtcatgcaaaatgaccaacccgtcaccgtacctgcctgaccacagaatcacgtttgctttgggagactgcgtctgctgttgatctttccaggtcttccctctcctttaggaggcggcctcatccttctactggcacatctgacacttctgacagttggagctctgacgaaaagctctcatggtgggccacgtggctgggctccccacacaccaggcccagggctggctctgtgactgtcctgaggaatgcaggatgaggctcctacgcacaagcttatatctgacagaaaagacacaactgctagcctcattcaccatcactcctgcacactcccgcaagtctttcatcaaaccaattattcagagctatctccttacccttgcacctgcagctttccagacatggaacgttcctccctcccctccagtgaaaacagccttggacactcggcccaaatcgctcctcatctgtgaaacttaccctggggcaagcagctcttgtttctctaatgtgctgtccaggccaccaagatggccctggtacactgctcagcagccacctatgactccagacagcagggtcacattttctttgacgactcgggggcattggaaatgtatttgctgaataaactgttatgggcaaaaatgacaaatataaagtccacaagcggatatcctagcccacccctcacagaaatattctgagggtaggccaggcgcagtggctcacgcctgtaatcccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaagtcaggagaatcactcgaacccaggaggcggagggtgtggtgagctgaggttgcaccactgcactccagcctgggcaacagagcaagactccggctcaaaaaaaatcaaataagatattctgagggcaagtgacagggctggcagtgtcaggggtcagtgaggtctgaaagggtaagagggctgagctcatgggtgactgaggcagcgtagcatgggcgagaggattccacagacataagacacgcacacctgaagccaggcacatgctacaacctggaaatactttcccaagaaaagaaaaaaatttcaagaggtctggattttctacataggtggatctgcctaaactattctttctcccctgttgcacaagacatgtattttcttagctaaattctctcatcgttcaatcaatccaaacaatttaccttcccattcatccacacaggtgacaatgacaagggcacctgccacgcagaaggctgccaagaacatgttccatttcttagactcaggcagaggaatgcttgaaccaccgcaccagaagatggaggacgagaggagagagacaatttttaagaaaaagagataaagggctgggcacagcggctcacgcttgtaatcccagcactttgggaggccgaagtgggcggatcacgaggtcaggagatcgagaccatcctggctaacagggtgaaaccccgtctctactaaaaatacaaaaaattagccaggcatggtggtgggcgcctaaagtcccagctactcgggaggctgaggcaggagaatggcctgaacccgggaggcggagcttgcagtgagccaagatcgcgccactgcactccagcctgggtgacagagcaagactccatctcaaaaaaaaagaaaaagaaaaagagataaagaaacagaattaaaatgtccctgggctgaaaactgacatattttccaaatggaagggacagtgcatgatacaaagcatgaatcacaaacacctgtggacgcgagaccacaaacgacaaagagaaaaaatcttaacctccaagggggaaaaaacccgagtcagctacaaaagaaacgagaaccaaattaacagaacagttggccaggcacggtgacacacgcctgcaatcccagcattttggagggcaaggcaggcagatcacttgaggtcaggcactggagaccagcctggccaacatagtgaaaccccacctcataaagacaaaaaaataaataaataattgatcagacactggtgctagaagagagcaacagcatcactttctgagggaaaattattattatttttgttgttgagatgaagtctcactctgtcgcccaggctggagtgcagtggtgcaatctcagctcactgcaatctctgcctcctgggttcaagcgattctcctgcctcagcctcccaagaagctgggattacaggcgcgcgccaccacacccagctaatttttgtatttttagtagagacagggtttcaccatgttggccaggctggtcttgaactcctgatctgcccacctcaggctcccaaagtgctaggattacaggcgtgagccaccgcgcccggccacaaggtatcttttatagaccactggttttgaaaagacataagattcagcgttgaagaaaatacctttggaataggcagtcttgatgcctgctaaaggggatataaattgataaggcctttttggacaatttggcagtatctgctaacatttcaaaaatgcataggctctgaaatatcaattctaaaattctaattatgtaaggctaaagaaataccgcacgtgaacaaatatttaagtactcacccattctatgcagcattgtaataaaaagtaaaacctgaaataacctttattgcgtccactaataggacaatgtttaaacaaatgacacgtccatcatacagaatactgtgtggtcactggaaggcacatggacctgtatacactgacatgaaaagatgtggaaagaatgctgggagcgttaaaattttctgaagtacaacgtagcacaatgcatacatggtttaggctttttagaataaaaaatacttatacgcagacatttatatttacacgtataacactgtgtacagccccgaagcaatgccgaaactttcactgttgttacctccgagtggggactgggaaagcagaggttagggtcgttctctctgttttacaaacatttattggcgcatccatcaattccaggccccgaggacacagctgcgtcaacgacatcgagtccacctgctctggggacccggatgactgctataggttttgttcactgtggcgtccccagaacctgcacggcgccgggcactgagcgggcgctcacatgtgcgtccaatgaacgaattaacaaatgaaccctcagtgcgctactgggaggcggggaggggtaaagcacgatccatggaactagcacgatcaccccgagtgagtccattccccgcaacatgcacccgcaaagactccgcgctccgcagcggctccacctgcacgtgcgctacctgactggaccgaagctccaggagggacgaccccgcagccgctccgcccgaccccgcgaccccccaagacccagcctccttcagggctcccatgggcgggtggcgaggggagtccagccgaggaaaaggcagccaagctggagctggcgaggagcggagcgaaagtaaacgcgtctgccgcgcttggcctcgccggacctcccacgcctgtgaagcaggtgccggcgcctcgctccccggagcacagggacgtccctgccgtctccgtggcccggcccgcccgctgcccgtccagccaggacgccctcacctcccggcacggccgccagcgccggcgcccgcagcaaaggccgcaggcggcggccccacagcagcagcgcccgcagctcgcgcgccatgtcgtactcccagagcgccgcgcgcagccacgcgggaccgtacacgatgggaaggggcgggacggggctgcgcggggcggggcttcctcgggcgcggggcggtgacgtcacggcgggcgccgggctgtccgggcagctgcctgctcgggcgcgtggcggggtactacccgtctcgtggacggtcgggcctgggggtgggacctccgtgaccttggatcgcgttgtcaagggcgacgggccttgcgcgcggaggtgggggaggtggccccgccgcccccggcccacgctggccggctgcgcctagctgtgcgcattcctggaatggggcggatgtcagtatccacgcgagggtgtggaggcgacgctggggaagaagcagttcccgtgtctgcgacctttgtgaatcccggccatccgtctaggccgctgcaagtctcttgcaaaccaagactggacaaaaagctaaagcgaatgaggaaggggattccaggcttgactggctactactccaaaacctgaacccagtgaccaataccaccaggaaaactgcggttattcgtttattccacttctcttgtccttgtcgagaagagtcaaactctaaagtatttagaaggttattctgagccaaatatgagtgtgcatggagggaggcacagtctcaaaaggtcctgagaacttggcccaaggtgcttgggttacagcttgcttggttttatacattttagagagacataagacatcagtcaatgcatgtaagacataggttggttccgtgtggaaaggcaggacaactcaaagggtgaaatacttagaggtcataggtggattcagatactttctgattggcaattggttaaaagagttgagttctggttgggcgcggtggctcacgcctgtaatcctagcactttgggaggctgaggtgggcggactgcctgcggtcaggagtccgagaccagcctggccaacatggtgaaaacccatcatctctactaagatacaaaaaattagctgggcaaggtggcacgtgcctgtagtcccagctcctggggaggctgaggcggaagaatagcgtgaacccgggaggctgcggttgcagtgagccgagatcgtgccacttgcactgcagcctgggcgacagagctgtgactccgtctcaaaaaaaaaaaaaaaagaaaacaaaaaaaagaaaaaaaagagttgagttatacagacctggaatcaataaaaagagtgtctgggtgaagataaggggttgtgggcacgagcacggtgactcacacctgtaatcccaacactttgggatgccgaggtgggcgaattgcttgaggtcaggagttggagagcagcgtgggcaacatggtgagaccctgtctgtaccaaacatacctgtaccggatgtggtggcggaggcctgtaatcccagctacaagggaggctgaggtgggtggattgcttaagcccaggagggagaggttgcagtgagccaagttcgtgccattgaactccagcttgggcaagagagccacaccctgtctcaaaacaaacaaacaaacaaacaaacaaaaaacaggttgtgaagaccaaggttcttattatgtagaggaagtctcatagatgaccacccttacaggtaatagatggcaaatgttttcgcaaatattgtttattcagaccgttaaaaattcctagaccctcaggatcaggaaaagacctgcaaaggtggcctggcatggtggcttacgcatgtaattccagcactttaggaggccaaggtggtcttatcacttgaggtcaggaggttgagaccagcctggtcggcatggcaaaaccccatctctactaaaaatacaaaaattaggccaagagcagtggctcacgcctgtaatcctagcactttgggaggctgaggcgggcagatcacctgaggtcgggagttcgagaccagcgtgactgacagggagaaactccgtctctactaaaaatacaaaaaatcagtcaggcgtggtggcgcatgcctgtaatcccagctacgcaggaggttaaggcaggagaatcgctggaacccaggaggtgaaggttgcagtgagctgataccgcaccattgcactccagcctgggcaacaagagtgaaagtctgtctcaaaaacaaaaaaaattacctgggtgtggtggtgtgcacctgtgtacagctgaggctactcgggaggctgaagcaggggaatcgcttgaacccaggaggcagagattgcagtgagccaagatcgcaccactgcactcccactccagcctgggcaacagaacaagattccgtctcaaaaaaaaaaaaaagtcctttgtaatgttaacgctggtcagttgtgcctcatttccaaggggtggagggtgtaatgaggcaggacccaccccatccttccaattatggcctgaactagttttttaggtttctttgaaatccccttggtggagaggaatgatccattccatgggttgggggacttataatgtgtttttgccggctgggcacggtggctcacgcctgtaatcccagtactttgggaggccgaggcaggcggatcacctgatgttgggagttcaagaccagcctgaccaacatggagaaaccctgtctccactaaaaatacaaaattagccgggcatggcggcacatgcctataatcccagctactcgggaggctgaggcaggagaatcgcttgaacccgggaggcagaggttgcagtgagctgagatcgtgccactgcactccagcctgggcaacagagtgagactctatctcaaaaaacaacagcaaaaaaagaatttgtttttgctttacaccttgctggaggttagagactagttggagattcagaccatacaccctggtctaacatttggtccagacccagctgcagcctcataatgccgatttcccggcacctcctcagtcccggagtggggcccaggcggctccactgaggttcccaggtaattcggaggcacactgaagattcactgccacactctaataactgtacaaaaatagcgactccagctcgtggcacgtgctgcagagaagcacaggagccaggagagtgaccttcagtggggccgggacagagctgggtggaagaggatgtgtcaggaaacgcttccaggtggaaagtggcaagttcccagcttaagcaattgagaagggaatggaaagagggtgggcagatttgggtggaagagcagggtcctgtcacccagaccactccagcagccctgacaggccccctgcttccgctcttgccagcctcccatcctccacagcagccggatcatactccgtctctcagatcctccagtggtccccctaccaacacacatgcacatatttacaatcctttccaaactccttctgcctcctcctataggcctgcatgggcctgcctgtgttccctatcaccacactccaggcagagccctttccagcatgtcctcagggaatgggggtgggtggggggtgtctcggcttcacatttcatccctttttcgctccattcaggaaatcatctctctctttttttttttttttttttttttgagacagagtcttgctctgttgcccaggctggagtgcagtggtgtgatctcggctcactgcaagctctgcctcccgggttcactccattctcctgccttagcctcccgagtagctgggactacaggcgcccaccaccacacccggctaatttctttttgaatttttagtagagacggggtttcaccatgttagccagaatggtctcgatctcctgacctcgtgatccgcccatctctgcctcccaaagtgctgggattacaggcgtgagccaccgcacccggccaatcctctgttttgtaacagctgtcacattggtccatggggcaatatatctggcttaggccttttatttctttttttgttttgttttgttttttgttgtttgagacagagtttcgtgcttgttgcccaggcttaagtgcagtggtgtgatctcggctcactgcaacctctgcctcccatgttcaagtgattctcctgcctcagcctcctgagtagctgggattgtaggcacccgccaccatgcctggccgatttttgtatttttagtagagacggggtttcaccatgttggccaggctggtctcgaacacctgacctcaagtgatccgcctgcctcggcctcccaaaatgctgggattacaggcttaagccaccacaccaggccagtttcaacaaggggaagtgatatttggcaaaaggagggaaacctgggctttagttaagggtggggggcctctgccaagactggcaggccccaagttctgtggagggcaaatctaccaagttccagaaaaacccccagagccttctgtcctgttggcctgtagccttcagagacaaaccctcagcctcagagccttgtggtcctggggcctctgctagcccagggccctgtgacttttttttatttttttatttttgagacggagtctcactctgtcacccaggctggagttcagtggcgcagtcttggctcactgcaacctccgcctcccgggttcaagtgattctcctgcctcagcctcccaagtagctgggactacaggcacgtgccactatgcccagctaatttttttgtatttttggtagagatagtgtttcaccctgttagccaggatggtctcgatctcctgacctcgtgatccgcctgccttggcctcccaaagtgctgggattacaggcgtgagcccctgcgcccggctggacctgtggctttgtaaggtactgagggatccaaggcatgtcctaaggtggccacacatggacttcaggctccgcgtaaaccaagaatctagaaagaggaaaaaatgtttacacgcagacgtacttgacttgaattagtggagaatgactgggagctgcttggggagggaaagggaagaacccccaagtctcctgcccacctctatggccaatacgaggctgcccatatgaagccactgccttccactggggtcagctgagggccgtgaaaaatgcccggtgctttattcacaatagccaaaatgtggaagcaactcaggtaaccatgaacgatgaatgggtcagcaaaatgtggtctattcatacaatggaatattactcagccataaaaaggaaggaagtagccgggcgtggtggctcacacctgtaatcctggcactttgagaggccgaggcaggtggatcacttgaggtcaggagttcgaggagtcctctataaaaagatgtgagcccatcaaaagcaccgttttatgcacaatttagatcaacggcaaagcactgtcatctactcatcaaagctcctcagaatctactttgctagtctgggcattacactcacttaaatttcttcagtatcttataagggacctatgttttcccacctctgcctatttattatgaagtgtatacaagtaattcatgtggaattaacacataaaatccatacgtccatgaggctgcgatgtcttcatggtctgagatgaagttattctcctgcctacatgcccctgcccgtctgttacggcgctgtgggcgcagcctctgcttcccggcacacactgtcctgtgctgagaatgtcctggtagcaaaatggccactgatgtgcaatcctctccttcataaaaggtgtgtttcttttttaaaaacagcttatttcaccatgcaatgctccaagcatgttttggctcaaataaaatctttggttctattttatagtaatcaaaaggaccgggcatgtttgctgacgcctgtaatcccagcactttgggaggccaaggcgggtggatcacttgaggtcgggagttcaagaccagcctggccaacatggcgaaatcctgcctctactaaaaatacaaaaattagctgggcatggtggcacatgcctctagtcccagctactcgggaggctgagataggagaatcgcctgaacccggaaggcagaggttgcagtgagccgagatcacgtcactgcactccagccagggtgacagagggagactctgtctcaaaaagaaaaaaggaagacagttacacgtcttcaacctgagattttttttttttttttttcagtcagagtcttgctctgttccccaggctggagtgcagtggcgtgatctcggctcactgcaacctctgcctcctgggttcaagcaattctcccgcttcatcctcccgagtagctgggactataggcgcatgctgccacgcctggctaattttttgtattttagtagacggggtttcaccacgttgcccaggctggttgtcaactcctgagctcaggcaatctgcccacctcagcctcccaaagtgctgggattacaggcgtgagccaccatgcccagcccaacctgagatcttagaagcagaagcctctccatgccacattatccagggacagctcattctatgtttctaacatgctagaatttcaaagatagcatcaaacacatgctctgtagagaaaaactccactgaacatctgcaattttttttttctttctgagatgaagtctcactctgttgcccaggctggagtgcagtggcgcgctcttggctcactgtaacctccgcctcctgggtttaaccgattttcctgcctcagcctccttagtagctaggactacaggtgcacaccaccatgcccggctgaatattttttttttttttttttttttgagacagagtcttgctctgtcgcccaggccagagtgcagtggtgcaatcttggctcactgcaacctccacctcccgggtttaagtgattctcctgcctcagtctcctgagtagctgggattacaggcgtgcgccaccatgcccagctaatttttgtatgtttagtagagacggggtttcaccacgctggtcagactggtctcgaactgctgacgtcgtgatctgcctgccttggcctcccaaagtgttgggattacaggcgtgagccactacacctcggccaattttttgtattttttgtagtagagatggggtttcaccatattggccaggctcgtctcaaactcctgaccatgtgatctgcccgcctcagactcccaaagtgctgggattacaggcatgagccaccaagcccggccagcaccacctacaatcgtttttttgagacaaaatctcactgttgcccaggctgtagtgcagtggcacgatcccggctcactgcaacctccgcctcctgggttcaagcgattctctgcctcagcctcctgagtagctgggattctaggcgcctgccaccacacccggctaatttttttgtattttaatagagatggggtttcaccttcttggccaggctggtctcgaactcccgacttcatgatccacccgccttggcctcccaaagtgctgggattacaggcgtgagccaccgcaccgggcccgcatctgcaatcctataatgacgagccgttgagctaactgtaagtcattagccaatctgaaccatctttgaatccaagtagttttaccatcttttattataaacaccatcacatttcaagtttcctctttttgatcacaaatataggactttttcttctcctcttaagtatacagcatgagacacagcgttggggctttccaggtttcttacagaaatttccttacgacaaacttagggttagcatccacagaccatgctctcggtcacatccttcgacatctggattgcccaagacggttgcacaggatgcagactccaaagaggatgaggttggtacataacgttttgaattccaggataacctgaaacagaggcccctccactgcccacattaaaaggctgcacaaccaggagggcgccactttctgagtgtgggcttagagctgctgctctcgggctctagccccacttcttgtttgaacacatggctcaaggtttccctacgggtggaaaagatgaagaggacactggaggttaagaacccagcaggccgagcagtggcagcaatctccaccggaggcccggcctgtgcttcccctcctgggatggggtgaatgggggctggtcaggggtgccagatggtggtcttatttttacttgaattattctgcattttataactcaaggttcaaagctctgtgctaaaactagatcggacctttccaacttcttagaaaggttcctcgaattcagattcccaaaccaagtattcagctatttaaaacctatctgtgaatgtaagggcccaaacggaagctatttggggcgtgatttctaaaattaccatcacccccacctagaccagcctttgttgggggactagggataaagtgggttctctgggtgctgggggtggtagacttaggggatgaacttcagctcccctgcccatggtcctcctctcagttttacggtttttgtgaacttgtctcacccactcagtaagggagcctggaactggactccaagggaggcaggaccatgtggctaagtgcaagtatcccccgaagtgggggacctttctcactgtaacagggaccggagctggtgctccaaggtgtctgtccctcagcatttcctcaaacgccacacgggacatgctgcgcggcagcggcaggatttggggggaagtcagaaagcacctcgcgagcctggagcactctctgcctcagattctgggagtcgtgtacggggggggggagccgcctgaacacgggaagaagcgccgcctctgggggtggcagctacgacggacagggaggatggaggagtgggccaaatgcagtttcagaccaactgacgaccctaactgtgtgagcgacaatcacctgtgagcctcgaatgtgtggggccaacgctgagccgcccacctcagtcgcccacctcagtctccgggaagaaaagcctccgggcggccgctaagcctgggccacagttcccagccaccacccacgccgccacaaccacaaccgcagccccagcctctccgctatgagcgaacaaccagaaccatgtcttacaaagaacagactcaaaaaatatatataaataaataaaaaccttaaacattcttacagggatcttaaagaacagaatacatgttaaaaacctcagtaatttatatcaattttaagcggtactttatatacaatggggaaaaaacacatgcatagtccaaatacaatgttgaaaacagcattttcataacaaaaaaccccgaacactaagtgttaataccatgtacatgaattcaagaaggaccaccctttttgtctgttgcacacagtttatttaacaatatgatataagaaatgagttggtattttaccattctatacagtgattgaatcttctcgagtttcgtatttataggaattagagcgcttgcatgatttacactagaattgcttttcctcatttcaagtttcacatagaagaaagaaaagaaggcttcttctctagtaacattagcatggtctaagagtgatcatccctattttttgtctaaaaccagttttatcagagaaacaaagcaacaatttctacatctgcaagacaagtttggcttcagccattatgtatagatagatgtgtgtgggtgtgtacgtgtgtgcacgccggagtcaattcctatcatccagggtaatactgggagacgcccacagagttcactatagaaaaaaatcttcccgaaacatcacaaagttatcgggatacattataagcttgcattatttcaggaatcagttctgaatattatttttcttcttacttttaaacataaatgtttaaagtcttgaaaatacaaataaaaaatatgaatataatgaacttgtttttcccgttaaaaaaaggcatgagtcaccagcaatgacgacaaaaagaatccaaacaaaacccccctccccccaaacaaaaacaaaacggaaaaaaaagaaccccccccacccccccgccaaaaaaaaaccaaagagagagaccagatatttaaatcaactggtttttaacaaaaaaatatattctttgtattgtttctttaaacatcaatccacccttccatggctcggaagtcgcagttccatctaggaataaaaagaacctagatgcctggattttcagtacaaaaggtccaagaacatgaaagggaaaaggtgatgctctcacaatgctacaagccctccacaaacttctctagcgtgtcccccgtggtgtccccgaccagggacagttcgctggacagcgcactcctgctgggggtgttcagctgggggagcattgcactctgttcggggttccccaagtgtccctgatctatggagctggccatggtgactgcgagtccggggtggggggaaccagtctggggtgagacgtggtgtggcgaaggctggggctgtatccgtggtgacgggctggaatgtggaggctgggactggggccgtggagactggacaggggctggagaccgcacctggttactaagggacgtggcgatctgctggccagggagatgcgaggcctgtggctgtcctgagagcatgtgttgctgggggctcatggggttcggctggcctggggacccaatctgctgcttcatctgctgttgctgcagaatccgctgctgcagggcttgctggatgttgggggtgctgtctgcccccagccccggctgccccatctggccaagctgtcccatctgagccgccatctggcccatggagctgccctggagggggagatgctgctgcatgcgctgctgctgctgcatggccggtgggtagcctccgggtccttgaggctgctggaactggccgtgccccgccatgcccccagccatgccggcactcccttgctgctgctgctgttgctgctgttgttgctgctgctgttgctgctgctgctgcagcagctgcctccgtaacatttctcggtactgtggattcatactcgccatgttggggttgtgtcctgggttcatgatgttcaaggcctggccctgggggttcaggcctcccatcgcctgctgctgtggaggcacaccgggccgcggcacgccagcctgcatggcattcaggttctgcaggctgggctgctggtgcatgccaggctggggttgcatgccgggctgggactggaggccaggctggggctgcatgccgggctgattggccacgtacttggctgtgcgctgtttgatgaaagctgccattagctgcgggtttgatttgagaatgttcagcacctgctgttgctgctgaggggagctgggcgacttcagggtccgcagcaggtcttgcagagcgctgggtgagatgctcctgggtggctgcacgctgggcatccggggcccagccacggccgcctgggcctgcatggatatcacaggcctgggcaagcctggcatgggctgctgctggggaaggggcgcctgctgccactgcccgggaggcatgctgggcatgacgggcccgctcacctggttgggtcggggcacattcaggctcacgggggccatctggctccccggggtccccatgcccgtgcgtcctgggggcatgctgttgttgatgttcacccggtacaggtgctgctgctgctgggcctcacgctcgatctgccgagccgcttccaccgctgcaggagggggctgggccgggggtgggggggccggcacctggctggtaggcttccctgtggacaccgtggtggggggctgagtccgggccacgctggggaagccagctggtgacatgctcacgggtgagggttggggctgggcagggggctgcggcgtctggggtgtgctgggctgctgtgtgggggtcccgggcggtgctgaggtaggagaaggcagactctgctgaggcacgttgcgggtgttcatggtggccatccgccggcgcatgagctgggcctgctgcaggcggtgctggatctgctgctggcggagcttgtgtttgatgttgaggcagaagggcacggggcatttgttttcttggcagtgcttggcgtggtagcagcagagggcgatgagctgcttgcacaccgggcagcccccgttggtcttgcgtttgcagcccttggtgtgctgcaccacccgcttcatcttctggcaggatggcagcgagcagttggcgttgcggcactggcacgcgtgcaccagcgactggatgcagcgctggatgctcagccggcgtgactcctgggggctctttgactgtggctcgccctggctgctgccctcgtcatccaggcccagcccccacttcaccatcttatgggcatggctcttcgtgttatagcagttgatgcagaggtcgtagtcctgcaagcaaggaaaggggacaggccggtgtcagcatgggacccagtaccaccaggcatcctggctgcttccctccaccgctaagtctgggtctgtgccaggagacccaggcaggataggagacccagacaggatgcgagcacggacaggtgggagacccggacagggcgggagcacggacaagatgggatcatggacgggatgggatcatggacaacatgggatcatggacaggacgggggcatggactgcctatgtgttgctcccaaggaccttcactcctggcaacagccctgaaggctcaaagataacctgacccatgccccaagaacccctggcctgtaagctcacggacagtagacaccagcccccttccttccgacttcctctgacctgggagtcacatcagcccttgccacagcctgtccaactcctgtactcaaactatgaagccagacagtgaaaggctgagggaggccggtccctcccaaagcgccgacagctgccgtgaagtgcctctgggaaggcctgagctatccgcagtgcaccagtgggacttccccaacgcgcaagcccaagttactgaaaactgctcgcacctggcaacctgatggagccctaggaccaggtaccatgactgtgttcacaaaaagatatgaaaactgccgcattcagaaactagaaagaggacaaaggagactggagaaaggtggaaagcggaagaagtgtgtgaaggtggggagggaagaaaggccctcgctctgctgaggacccgctctgccccgctacagacaccacagcaagtgaggaggctccgggttggcaggtgatggtgactgtcctgggagggggatggtgggatctgtcacctgcctgccctgcacagcctgactcggcccatgcaagggacacccacgtcatttcacaggggggtcaaaattcctagaggggagtgagggagcatgaccggggggtccttcaggaacaagtggccagaggggcccaagctgccaacaggacagcgggtgtttccagccatttagcaagactagaactgggcacagacaggccagacttcccagcagagcctccctctggccgtccccagggtcaggcctgtggctgtggctacacagagcaggtttaggaaacacacacacagcaacgccttctgccttgtgacgctgtcctagttctggaggagtcagtgcagccaccatcaggtacagacaccaacccgggcacccatgcaaagggacaggatgcttcgtcagaccccaggccggctgtgggggtgggggtgggggcagggcctacctcgcacacagtgcagtgccagcgcgtctccacgtggtgcttgcactcgttgcaggtgtagacaaagcggtcctggccctgggtgtgcagctccaccagcatgcagagcgtggaccacttggagcggcgcaaggaggagaactcccagtgcttgtctctggcgagggtgaggaaggcgtcgcgcccatccatgaggtcacagctgagcagggggtcggggtcgacgatggggggcagggtgttgatgacaggcccagcgtgcaggtggatcacgaagaagacctgcaggagaggaggggctttagtcccacacaagggacatggcacctccagtggtgagctcagggcaggcgcagccacccagcctgcagaataggcaggtggctgagcctgatggccctgatgccttgggatggaacaaaattggtgacacgttgcatgatgtcacccaactggtccacttggtttcctgggggccacttccctcccaccacagacctgcacacgggcccacgcccgccagctgcgagtctttccctcctcccggccagaggcacggctgcagcaccgcagcccacgcctacctccttgtgcttctccatggtggcatacagcttctgggacaggtcattggacacgttgggcatgctgggcttcttcttgttggcgcggctgatgctgcttttgttcttgttggttttcttgttgttcttcttcttggcattcttgctgtcgccctgactgccctgcaacaacacgcaaggctgtgagaccaggcaagtgcccctccacacttggcacggacgcccagctcccaggccgtgggcatcaggaagctcaggccaaagtaggtcaccaccaggcagaccccatacgtgaacggctacaggtggctgtaggtgctgcagccttcgggacagagcagggcctgtcctcggccaggctggtgtcattatcagctttatgccacgctgcctctaaaggggaaaagagacccagagtgcgagttcagaaattaacaaatgagggcagtgggggctgtttccactgtgccacaaccagatgcggaagattccacgtcacaactgtggtcagcagctgtctgccttgaggaaggctctacacacccgagaaagcatgagagcttccaggagacaggaaagctgctgatgggaaaagcagctgccccatcaagagcagggactctgaggcccctgcggggtccactcaaggcccacggagagcaggctggctccctgctggggccatcagtgctgcgcctgactggctgaaggtgggcttgctctcagcccacaggctcctcctctggaaagaacgcaggattaccactcacttacactttaacagagagctttattttttttgagagacggagttttgctcttgttgccaggctggagtgcagtggtgtcatcttgggttcaagtgattctcctgcctcagcctcctgggtagctgggattataggcacccgccaccatgcccggctacctatcattttttttgagacagagtctcgctcttgtcacccaagctgaagtgcaataacgcgatctcggctcactgcaacctctgcctccaaggttcaagcgattctcctgcctgaacctccctagtagctgagattataggtgctgccaccacacccagctaatttttgtatttttagtagagatggggtttcaccatgttggtcaggctggccttgaactccggacctcgggtgatccgcccgcctgagcctcccaaagtgctgagattacaggcatgagccaccgtgcccagccagagagtttcatttttaacaagatgagagagactcttggtgttcaaagagaggggtcagtccagagagaattcaacaatccagccgggcggggtggctcacacctgtaatcccagcactttggaaggccaaggcaggcggatctcgaggtcaggaaatcaagaccaacctggctaacacggtgaaactccgtctctactaaaaacacaaaaaattagccaggcgtggtggcgggtgcctgcagtcccacctactcgggaggctgaggcaggagaatggtgtgaacccgggaggcggagcttgcagtgagctgagatggcgccactgcactccagcctgggcgacagagcgagactccatctcaaaaaaaaaaaaaaaaaattcccaccccaccgacaagcagcccgaggagcccaaatatcacgtgggtcctccgcaggattcagagacagaaaagggacgtcaggggaaaactgaggaaattggaacgaagtgtagacttaacaataatgcatcaacatcaacaaatggctcaccgtggcagcaaatgtgccacactaaggtaagacattagtaacaggagaaactgcgtgctgcaatatactggaactctgtgctcaatttttgtgtcagccttaaaacaaaggaagcctattttttttgagatggagtctcgctctgtcaccaggctggagtgcagtggcacaatcttggctcactgcaatctgtgcctcccgggttcaagtgattctcctgcctcagcctcccaagtagctgggactacaggcgtgcgccaccacacctggctaatttttgtatttttagtagagacggggtttcaccatgttggccaagctggtctcaaactcctgacctcaagtgatccacctgccttggcctctcaaagtgctgggattacaggcgtgagccaccacgcccggcctggaagtctatttttacaaaattataaaataaatatgttcatgaaattaagaaaatatagacaagtaattttaaaaagttttgtttttctggtcttcccgagcagcagtgttctgtgttctggagctttccctgggcacatttgtctccgtgtttgcgacattcctcacgaagctgggactgcacacagggagctggttccgtttctcgccccacctgacactatcgcgagcctttccccatttcccagaattgacagcatgatgcagagcagagctaatagcaaagcagtgctccaccccacgcaccagccctcactaaggctgacccccagagcgagctcctggggtgttgctgacgaaggcatgtccctgcccattgttgtccatgaaccaaacacacaagggacagcaggtctacatgccgacacctcagcatcccgcctcctaacacatgcatgtccccggtgcacagggaaggctgccccagcaggagcccctatcaggcctgtcttctggacaaccccactgctgccatgccacaggcaggtgccccctcctggggtggaactcagctgcgcaaagcctgtctcggacgcggtaacctcccgtgtcacccttaggagatggaactcaagcattaactcaccagacaccagtgagaccagctacactccagcgggagcaagtccgaagacaacaggccaggagctctgcttaggagccacctagggcgtaaacccacgccaccccctgcccgcgcctcctctgtcctgcgaatgacactctggggcgccgtccagcaggtggctgcctctcaaccacctgtgcagtgagcacgagtgtgtgtggcggaagcggcccaggccccacgctccgcctacagcccatccggcacccacctcacagacgtgctctcatatgggacaggcaccagagtggcagtatgtccccagccggctcccggctgcctcacccatggcagcagcccacgcaagagccacctccattcaccgcttttcctcactggtcacaatcgcctgtcccaagttctggggctgcagccttcaacgttcgtcatcgctctccctgcacctacagctacagcccacacccacgccaccatcatctcttccccagacagccgcacaaacccgcacacagcgcgcctcctcccaccgcctggcgggtcctcttccagcaccttcctgtggtgggcgggtctggcccacacgccacctccccaaggctccttccccttcagagctctgccacgctcagagcacaccatgcttgggtctgggttctttttgtttcacatcctaccaggacacagccactcccttgggggcggagatggggttttgtttgttctgaaacggagtctcgcactgtctcctgggctggagtgcaacggcgcaatctaggctcactgcaacctccgcctcccgggttcaagcgattctcctgcctcaacctccctcgtagctgggattacaggtgccccctcccacaaccggctaaatttttgtatttttagtagagatggggtttcactgtgttagccaggctggtctccctttcctgaccttgtgatccgcctgcctcggcctcccaaagtgcggggttacaggtgtgagccaccgcgcctggccagggatggggttttgtttggctcagtctgcactgcctggcactcaggggcagcgccaaggagagagggcagcagggcatgagcatcatgtgcagagtggccaccaaacacggaataaggcctggcaaccctgtgcctcctcgactcactttttacatcagcgggttgtgtcctgactgccccatgtcccattttctgtcttcctctcttccctctccgagtctaagtggacccccagctccccagagcatccactgtgcagagagtgcagagcccacactgctgcccaccaacgccctgtgctgcaggtggtgtcgacgtgcatgtgtgaacggagacaccaccacaggaaggacctaacagtcgacacgcgcctcccagcctgccaccctgcagctccagcgggacacgtgggcaatggagctcagagaagggtctgtacctcagtggtttcactggctgcagtgctctcttcctttttcctctcctcttcttcttgttctagttccttaatgctctcttctaacacattgggccagaaatcaccttcaaaatagggcagttccttggcactggtgagcctgtcttcagttgcttgtttgaaaatatcctgagtgggcaaagcacaacagtgagatgagggccatgcacgcgtgccccccaccatggtgcgacagacccccacgcaagcgtgcccctcaccatggtgtggcagagtcccatgcatgtgtgcccccccaccacagtgcagcagacccccacacatgtgcaccccccaccacagtgctggagcccctatgtgtgcaacagtgatgcacaggccccaatgcccactgatggaaacagctccaactgtgctgctctcagacggccaggggaaagcctcaatcagctgaagaaaatgcttctaagttctcactttaggcttttatttttctgctttctaatcctcataagtgaaggtaattaacaagtatgcgaatgcaagaaaaaggcacacaaatatcctcccctcagttgtgacaaaagccaccaccttccttcagcgccgggtaccttgtagtcatggatgatccgctctgcaaacgccttgtccagcatctttttgtaccactcctgcagtcgttttggcttgggtattttttgatcaggtgggtggcaatggaagatgtaatcatctccttcacttggaggacaggcccagatgtgccctgtcacatacctgcaggacccacgcacacacgtcagatgaacgtgccagtgaaatcggccctgcctttaaggagttatagcagaggagcaaggactaaagccaggacagaagtaaccagagagagagaatgaatgcccacaaagctgggtgtggtgggggcaaggctcgaactttatcctgagcaaatgcaagcctgcaaattagccctgcaacacttctcccttggggtgcacacacagggcagggccgaggctgcaaaagaaacctgaggcctcattaaagaaccagggaatatgatggctcatcaaggcaatgccatccccttcctcctgtgcactgtaaaggcagttcggttgactatttttctccaagggtcaatgtcaacataaacctcattcattctgttcaagacactttgatcaaatgcccctatccttttcaagtttcagaagggaatggggcaggtctagagtacagaaaccaagggctagagaaggaagccagacccaagacagcatacgctgcagggttccgtttacacaaaggattcacaaaagacaaattcagagagacaaagtagattagtggtcgcctggggcagggaaggtttaacagcaaggggcaggaggaacattttttttcttttttctttttttttttttgcgggcggggggcagagtttcattgttgttgcccagggtggagtgcaatggcatgatctcgactcagcgcatcctctgtctccctggttcgagtggctctcctgcccccacctcctgaggagctgggattacgctaggcacccgccaccacgcctggctcattttttgtatttttagtacagacagggtttcaccatgttggtcaggctggtcttgaactcctgatctcaggtgatccacctgccttggcctcccaaagtactaggattacagactaggtgagccaatttttttttgtatttttctttttttcttttctttcttttttctttttttgagatggagtcttgctctgtcgcccaggctggagtgcagtggcacaatctcagctcactgcaaccccccgcctcctggattcaaggaattctcctgcctcagcctcttgagtagctgggattacaggctcatgctactatgcccggctaacttttgtatttttagtagagacagggtttcaccatgttggtcaggctggtctcaaactcctgaccttgtgatccgcccgcctcggcctcccaaagtgctgagattacaggtgtgagccaccgcgcccggccttttttttaatttttagtagagatggggtttcaccatgttggtcaggctggtcttgaactcctgacttcaggtgatccaccgcagcaggagggatcttataggtcaataacaatgttctgaaactgacttgtgatagttgcactaatgggtaaagttactaaaaaccactgaatcatatatccaaaaaaggggaattctatgatatgtaaactttgcctcaataaagttaaaaaaaaaaaaaaagggaatgaaaaggaagtaaaggtagggaaagagcttgctacgtgcccaggagccagacctgtgaggctcggggagcacctggaaagaggagctttggagattctgaattgatcttaggatggaaaaataaaaacgcataaaacttaaaatacccattatttcacggaataaacatacagtaaaaaataaagggttcttactagttccaaataatttaatccaaactcaccctaatttcttcacatactctaaatatccaataaggatctcatggtaaacggctgtgcggaggcaacgtggccggaagaaatgaatactatccagataagaaatgtacacacgcctgtgggaaggaggcacatgtttaactcagggtatccctcaaatctgaaatcaaacacaagcaacaaacaacaccctggaagtttactttttagacagggtcttgctctgtcattcaggctgcaatgcggtgacgcggtcacagctcactgcaacctcaacctcatgggctcaagcaatcctcctgcctcagactcccacatagttaggatgacaaggcatgtaccatcatgcccagataatttattttttgtagagctagggtctcactttgttgttcagacttgtctcagactcctgtggtccagttatcctcccacctcggcctcccacagtgctgtgattggccagtttttcttttgatggtatttacactggccaccaaacaggatgtgataaacaaacaaacaaaccaaaacccaaaaaccaaccagtcaccaaccctgctgccaatcagttaaatggaattcagttttcgtcactgaacaaaaggatgaatggcaccactcggcacagagagccacagttaaggcaaactgagaaaagccacttttagttccttcttgcccagattcctgactgcacatgaagccctcgtggcagagctacttcctctgttcaggtgccaggctgtcccatcccaactccccaggtttacctgcgttaggtaagagcgggtcccacacagactcgccacacaaaacacgctcactgcagtcatctcaacagttcatttcccgctagtttaatggaaaacaaaactaactactttggttagttaattgtggtttcatttactttaatcccctatgaaggctcacaggctcctctgggacacttaagagccctggtctatcctaacacggctcactgaatgacacgccctggaaggagctggaaaactacctcgtgtttggaggggggcaatcagagccgtattcttggacgtgcattccaaaaaagcagacatccacgccgtcaatttcctcaaaagcaaacagagctttggttcgatatgggaaagattcagacatttccccagaatccacaaacctgaaacaaaagccagagccggacatttacaaaggctgttgctgacaaggtgcttctgcacaccaggcctgctcctctaactctggccactgcagatgagcggaggcatggccacctcctcagaccgtggcctggagtcctccctatgggccagtcagccccggagcagggagcacttgctttctgaccagtttccctcactagggaactgcacctctgtgaatgaaatacgggattctgaggaggactggctatacagcagtcccccttatccacggggtgtatgttccaagaccagcagtggatgctggaaaccatggacagtatcaacctctatgcgttttttcttatacacctgtactggtcacaaaattttaatttataaattaggcacagcaagagattaacaagaataagtaataataaaataagaaaattataaacagtatactataatatggtatgtggtctctctctcaaaatagcttactgcactgtatagggtaactaaaaccccagacaggacaaccgcagctgagggggctactgcacgcattcgctgctgcaaagtcttggaaggatgacctcaaactcaagagctttgcagagagcaggctctggcaagcgggcgtggggactgctcgcagagcactgtagagagcaggcacactgaccgtgacttcatcccgggcttgacctccaccgtcttgtctgagctggccaccactcggacaaaaacctccccggcttcagggtgattctggcgccgcaaaaatttgttcactcggtcttccaagtggtttcccagtcttgtggtctgcagccctaggaagtccagaaggagcaggtgagagggcttcaacagcactgctgagacagtgactgagactagagaatccaccccactttgcagcacaggctgatattttaaaggactaatgttctccaaacacggaagaaatctaatctgtcctgtgacacgagtgttatataaaggaaaggtggactctgggatctcaggcactccactcctgaaaaccgtttacgtgcccaggtaacctgcatctttttctaacagtatggggcagaagacctatagcggtgggtccaaaattgacaggggctctagggcggagcagatggatgtttccctgttgcttcccgctttccctggagggcagagatggcacaccctcagtgggctcctcctgcccagctctgaggagaaagtccctactatggagtctgacgtgaacgtggaacgttctagggctaaccaattaagctctggccagagcctgtccggtgcctcaggagctggcaaagtattggtgtccaagcctgccctgagccatcgcctcgtgcggtgcacgaatgaagtttccgagccttggcgagggcagcctttcctgggctcacctccccgccgccacccctcctcacccagggccagccccgggagggctaccgtcacaggagctagccagaggcaggacattacttcaggacagagaacgcctcatatacaggttaaaaaactataagggaaagttgcaaaaggttcttagtgattacgtatagacaatgagattttaaaagatgttttcttctttgctggcttttaaatatttcctacattagtgagaaataggaaaattgggaattttcgaagattccttagcgagctagaaaatttagaccaaacttctaaatttcatttttctgcaataaacaaaccagtggtgctgatttttggataagttgtacctgaataaaaatgatttaaaaagaaaaatgtggccgggcacaatggctcatgcctgtaatcccagcactttgggaggccgaggcaggtggatcacctgaggtcaggagttcaagaccagcctgaccaaaacggagaaaccccatctctactaaaaatacaaaattaagctgagcgcagtgactcacacctgtaatcccagctctttgggaggctgaggcgagtggatcacctgaggtcaggagttcgagaccagcctggccaacatggtgaaacccccgtctccactaagaatgcaaaattaagtcgggagcgatggctcatgcctgtaattccagcattttgggaggccgaggcaggcggatcacgaggtcaggcgatcgggaccatcctggctaacacggtgaaaccccatctctactaaaaaacagaaaaaattaggactacaggcatggtggcgggcgcctgtagtcccagctactcgggaggctgaggcaggcgaatggcgtgaacccgggaggcaagagcttgcagtgagccgacatcacgtgactgcactccagtgtgggcgacagagcgagactctgtctgcacaaacaaaacaaaacaaaaaaaaaacaaaaaaaccccccaaaaaaacaaacaaaaaaaactcttccagagtaacttcgctatttgacacctgtgatccacacatggctgcatactccagaggtggtctcagacagcacaggggtctaggcgcaggccgtgctcactgcggtgcactctgcgcaaccttcctcacagtgctgcctccttttctgttatcactcgatttggccactgttcctactttttcatcactccttgccattgctgcagttatgtccttgtatgtgccgttatgcatatgtgcaaatatttttataggatacatgtgtgaaagtagacttgctaaatctaaaaatgaacactttaaattgtgcccctcgctttctggcattcaacttgtatcttcatccatggcgcatgacaggggccttttgtgccttttcctttctcatctctgggctgtatctttttaaggaaggcttttcataactcaacacaataaaattattatcttacttttatcctgaatgcatctgcagttttgtttacttttctcgctttttaatctacctgaatttggttttgcatatggtgtatgcgaaggagatggttttcaatgcaagattaaggaagcatacctttactctgtgatcagacaccacaacgcctgtgctgacacacgctcacactgagagtagagctacctctagtctcctaggcccttttctccagtaatgttccatttctagatcttgggctcatctaccgaatgcccacgggtctttctggatgctgcggtgggagggggctggacctgctctggggccacttgtgccattccgcccagtcacctcctgcccctttcaggcaatgactgttctacggaggcctagttctctgggtaattctgttttggctactgagcctctggcccagggaagaacttccaatttgctcaaatgcattagcgaactcactcagagtgaatcctctgaagcagggcctctcaaatggaggcaactgtgcccctccaggggacatctggcaatgtctggagacatttctgacagacgtaatgaattgctgaggaaggtgttactggcactgagtgggcagaggccaggcatgctgctaaaatcctgtaatgcgcaggacagcccctaaaacagagggttacctggcctgaaatgtcaacagtgcctcagttgagaaaccgagctaaggaaaagtattacaatagtttatcaatgagtgatatttcacaagtttttaacagaggcagtgtaagctattgcataactttggatgttggttaacaacagagtttgaacttgaattaagactcagtctcaagtctacagggtggcttcctcctccccttcccccagtgcatggtccatcctagcatttccatctctcttctactctgagctccccaaatgaccctggttctattggggatctcctgagcaacatgctagtcacctgtcctgccagagaaaggtgacagctgtagggagcagctggcaagtcaatgttagaacactgctgcagttgccgttcttgtgtgggtttgctggttaactcggcaaaaggccagcctggcgcgtcaagctgcagaaggccatcccaagacttgagaattgactctataaagattaaataaccataaacttttgataacaatgcaatgtggtcttaaaaaaaaaagtcagccgggcgcggtggctaatggctgtaatcccagcactttgggaggccgaggcgggcggatcacaaggtcaagagattgagaccgtcctggccaacatggtgaaacccgtctctactaaaaatacaaaaattagctgggcaaggtggcgggcgcctgtagtcccagctactcgggaggctgaggcaggagaatcgcttgaacccaggaggtggaggttgcagtgagctgagattgcaccactgcactccagcctggcgacagagcgagaatgtctcaaattaaaaaaaaaagaaagtctactcatgcaaagttacttctagcagtaacaggttgttccttctatttctgcacaggcaccaccagctgcagtaacatgtccagccaagtccacatgcaggccaggctcctaccgctcctggggtggtggctggttcccagaggccatggctcataccccactgtagcagaagccagcacccacgggacagacccacggcagcccacatagggcccagggttagagagtgctggccaacattacaccacacatgcacgcacgaggggtgaggggtcttaggtctaaaccacttgagaataatctgttgataaattttctcagaatttacaaagtttactgcacatctaacctttcatctaaaacatgcgctgatcataaatgctgactttcatataacaatcaggccaaatattccctttaagggtggactgagatgttttacacttgatgaagatccacagcccaaggctgcgagtcctgctctgagctctgtgctcagcagccccgtggctgagatgaccattctgagaagcacagacttcagggactcacagctgtgctgcctattctcagtgaagcccctgaagaacattcttgcattcttaccctcatgactggcctggctctccttaaggatgagacaagaaaaatacaaagtactggggaaaaaactaacgaaaatctttgacaaccgaacctcagaaccatgtgttgagaggaaccaaagaacaatggggacaatttctacaagtttctaaaatgtgcagtccaggaaacagaaagcttcccgaaacttactcttagcactgaatttgttttcttttcgaggtctgccagttttcttcaagcagttgtcgcacacaaaactgcaaaataatagtggtatgatgagactgtatataatgatgtaaattgtcaaaccaacaaaatgcagcattcagatagtttgttggcagtttaaatcacattattataaaattaaagagtgaagaggcagactgctttgattccacaattcctaaagcggacaaacgcttagaacttaaatttagaaccaactgccatctctcttaatcgctgaattcttgctgacaacaatgaatgagatgcagtagccactgcaactgccccgccactggctctgtgcagaactgccctccaggccaggggaaacaactcaccctgaaggccaaatgatgtcatagtgcagaacgcaaatctgatgcatcttccggccacactccttgcaatcaacgaaactaggaggcaaagaaggcgcactgttaaagcacacggaaccacaagaccagagtcacttgtagaagtctgtgtgtgcgtccacaccttgttctctgggttactttgagtagtgctgacattaatgcgtgtgttggctgattcagctatattttacaatgcatccgtatgatatcttctacaggaaaaagctttcttcttttgtttgtacaagcgcttcattcctcttttctcccaatctccctttgcaaccagaaaggaaactttactttttaaaaattgctgcgacaaatacatatttcacaggccggtatttctgacactgctacacatttgcaagaacaatgccttctctaggtgatttcacatgccaaaactgacttaaaaaatagagaacaatactttgagttctaaacatgtgctcttaagtctaaaattgttgaggatactaatgggaaacacggccagttcagagcagccacgctaggcgcgaggcacaaaaacaccagttctgagtcagttacaaaaggtggaatgtgtcaggcctactggcaagttgacaagggtttattcaagtaaacactggtgaagcgagagaatggaccacccattccccacgaatcctccacactgttctacggcagcccacaaccacggcccaccagggctccgtcacctccaggaaccgcctcaacccaggaatcttaaatgccaagatgacattttgaggtcaagaccttgggtttttgtcagctccctcccttgctgccaccacaatgcatacctccgaggataggctgaagggactggtgagtaatgtgattccctgtgtgctcctgagctttgagctacagctcctctaaagtgtgcccctgccctcgtccccttaatctgtccattgcacgtgctatgcaagccctcagccatgggtctaccctcatctggcttctctgcccagtctgctggagggaaagaaaagacacacacacagatctgtgaaaaaaaaaacacacacacacaaatggcggcacccgttcatggtcctatggcactctctgacagcccggctctgtctggctacctctcccttccacgtggcagctgctctgaatctgcactcctttcctccagtgcttatcctccacaagctctgtctttgacaactcagccactgagctcatccccaacgctaagaatttcaaaggttggggccaagaacttcctcaattcctgtgccgtctccaaaggtcccctgctctcaactcttccctcccatgtcaggggaaaggagtgtcccccaaaactacactggggacaggtgcagtggctcacacctgtaatcctagcatgtggagaggctggggtggaaggattgctttactgggagtttgagaccagcctgggtaaaatagggagaccccatttctacaaaaaatttaaaaattagctgggcatggtggtgtgtgcctgtagtcccagttacttagaaggctgagctgggaggactgcttgggtctgggaggttgtggctgcagtgagctatgactgcaccactgcactccagcctgggtgacacagcaagaccctgtttcaaaaacaacaaacaaaatccaaacaaacaaaacacactgcatattctagaccccatgacatccattttgaatttccccctttctcccactcccaattattatgggccaactagatgtctccccttccctcagtcccccagcaagcccccctgcctggctccaaaagctcttgctttaattggtgtttcagtttcttgccttctcctgctttgtgtctcttaactaacttctctactacagaacaatgtcttctcctcttctgttcagttcacctcatagaccaaagatgaccctcttacactagaaccagtgctattcttcaaaacctcctcagcacattataggataaagtctaaacgtcaagagacagtgtaatggcccttcatgaagttaacctctgcctaccaaccacccactctaggggccttgtagttttattgagcaacctgtgttctttcatgcctttgtttctagaatgctctgcagcttcaatgtaaatgtcatcttgtccaggaaaccaggcgcaactgtggtgatgccgctctgcccaagcagggtcccttctgtctgggactcacttgtactgtctcctgctgcaggctgtgccattacccagctgtctctctagactacaaccagcaggaaggagaccccttcactcatccatgtgttccctctgcctggcacctactacttgaatgtaatatattttgaagttgaaaagtagatataaattggccgggcacggtggctcacgcctgtaatcccagcactttgggaggccgaggtgggtggatcacgaggtcaggagttcaagaccagcctggtcaagatggtgaaacctcgtctctactaaaaatacaggctgggtgcggtggctcacacctgtaatcccagcaccttgagaggccgaggcgggtggaccacgaggtcaggagatcgagaccatcctggctaacatggtgaaaccccgtctctactaaaaatacaaaaaaattagccaggtgtggtggcacatgcctgtaatcccagctactcgggaggctgaggcaggagaatcgcttgaacccgggagacggaggttgcggtgagctgagattgtgccattgcactccagcctgggcaacaagagtgaaactccatctcaaaaataaaaataaatacatacatacatacatacataagttagctgggcgtggtggcgggcacctgtaatcccagccacttgggaggccaaggcagagaattgcttgaatctgggaggcggaggctgcagtgagccgagatcgcgccactgcactccagcctgggggacagagcaagacttgtctcagggggaaaaaaaaaaaggaaagaaaagtagatataaataataatgaaactataaagccaaggagagaaagacacaatgtgaaaagaaaggtggaaagtcaggaaaaacaatccgatggtcatgagaggggtgggcgctctgccctggcatctcgccaagactacagctctaggatttcacatcatcgtcctgtctgtgtaccatgtgctggtagagatgaagtaacctgccaaaagtcaagctaggtttccagaggtggcctgggtagaaatctgtgcttgccactctagccactggcttccctggagagggtcaggatagggagagcagggtctgtttcttgccttggctgagtcacagcccacacttcccaagtagccaacgctcctggagcctgtgctcaccctggggacaaaaaatagccagtatcgccatgccaatttggagcgccctcagaactttacattggggacctgggaagaggctaccacactgaaaaaaatctgaagtctctttaggggctgttatgaagcaaggttagcaaatgcagcactctcactcatcactgtagaaaagtgcttaacagggccgggcgcggtggctcacgcctggaatcccagcactttgggaggccgagacaggcacatcacctgaggtcaggagatcgagaccatcctggctaacacagtgaaaccccgtctctactaaaaatacaaaaaattagccaggcgtggtggtgggcgcctgtagtcccagctactcgggaggctgaggcaggagaatggcgtgaacccgggaggcggagcctgcagtgagccgagatcgtgccactgcactccagcctcggggacagagcgagactgtctcaaaaaacaaaacaaaacaaaaacaacaacaaaaaaagtgcttaacaatggcaagaaaatgtgccaagctttacattatttgagaaagcagtttccaagaggttttctttctggtatttccctttaaacgatactactagtactaccccaccaaatactcctaacctttggtctctaaagattcatgctaaatggcttcttaaagacacccatgaccaaattattagagaggttctcatagaactaaaacatccatttaatcttatcattgttaaaatccagtaactagagtacatgttacagagacatacatattttgtttaagtttaaaagaaatctatatctaaaagataacctcacaccagaaattccacttacggcaacatatttccaatgtttttacccacaacccactccataaggagtaactttaccgatttcaaaccaaaactgaaagtaaaaaagaaatagctatatacttacggttcggggtctaaggtatcatttttcttcttttcaaactgatcctttgaaattgtccttgttttaaaataagaaaacatgttttattaactaaaatttatctgttgagtataaactatagggtctctggaatgttattttgtaactagttcttcaaacaaaaagacatgatggccccttaaaatctcaagtacatgtaataacggaatgaacagaaaatttaatttcgtagaacactacaatgtctttttctacatattccactatcatttcttttccttctgttttttcagagacaaggtcttgctctgttgcccaggctggagtgcagtggcgtgaccatggctcactgcagccttaacctcctaggctcaagtgatcctcctgggtagctgggactataggcatgcaccaccaggactggctaattttttgattttttgtggagatgagggtctcattatgttgccaaggctgaactcaaactcaccccggttctgagtagctgggactacaggtacaaaccaccacgccctgttaagtttttttaattttttgtagagatggggtctcactatgttgctcaggcaacaatccaattattaatcacacaactagactaaagagaattaggatgacaagggaaataaattgaaaatgtagaatttcagtcactttggtttgtttgtcttacaagttaggttttttctgcatttgaacaaagaaaatggtagagcgtaagtgcctacactgctggaagaagctcctgtggcaaacccttcctttctgttggggaagtcacactgtggtagggtggtaggaatcatggaagactggggaactcagtctgacgaaaagagggaacggcagacctgggcagatgtggtgggtggctggcaggtttttagttacttaagtatagaaatgagttgataacacaatttgtgcatttgctttttcttgccacacagtggccattctaacactcgaaggtaactctgccggataataaacactggaaatacaagtttaaccctgtgcaggagtgaactaacaaagtcatagctgtccactttggagctggtaaacaacaggtaaagcactagtgaaggaaggaaacacatttagactttaggccaaaaaatggggttggagaacactggaatccattaatctggattagacttcagtaactgaaaggatggaggtttaagtggagataaactaaatgtaaagggcagggcatgtacaccaaactcattttttgctactgccagttctgcaaatggggatacctggtttctcaggtataactgaaaatttacatggtcgggcatggtggccccagcactttggaaggccaaggcaggaggactgcttgaggcaagagttcaagaccagcctgggtaacaacagtgagaccccatttcaaaaaaaaaattaaaataaagaaaatttctaattccccaaaatggaaccactaggaaaaagcaattattttagaaaaaaagacagaccaaggtcaagagagaccagtggtctccagtggtaggccacagtaccaccgccttgaatgataaaggcagaggtggcgctgtggttcagccaaaacacatttttcagtgtaaatgtatacgtatacacatattcaaattaaatgtgatcatagttaatatgaaacaaaccccacaacacaacagactgtaatcccagcactttggaaggcccaggcaggtggattgtgcttcagtctaggagtttgagactagcctgggcaacatggcgagacctcgtctctacaaaaaatacaaaaaaattagctgggtatggtggcgtgcacctgtaatcccagctacttgagaggctgagaaaggaggatcgcttgaacccaagtggtcaaggctgcagtgagtcgagatagtgccactgcacaccacccaggtgacagaatgagaacctgtctcaaaaacaaaaaaccaaaaaacattgcaaggaagtcaaaatggcaccggtaccttccttatagtcattggtaagaggaaaaaacaatttaaggtcaccctccctcaccccagagaaaatgacaggacggtacttacgtctggggctgtgaagggtcgtcacccagggtcacattctcgccctggatctctgtgaaacacttctcacagaaatgatacctgtcagcaagaaggccatacttgggtgaactggtccatcataacacacagccacccaagcaacgaagccaccaatcagagcagggcagagcaccacgacgaagggggggcgttgttggttgattgatgggtcagtgaggacaatgaaaggaacagggggcaggtggggaaaggcaggattagagaacagggaagggaacaaatagcacagacacagaggtaagacgcagacaccaagacaacacagagcagaaagccaaggcaaagcattgattagcattcggtctcattgcacacatcacaggccatcatcactaacaacgacaggctcggtccggctccaagaggcaaatgttttcaaggagttgttaatactagaattgcatggagcccaaatttaggaatctgaattttgttcttactcagagaaagtcaaatataactccagggtttgagatggaaaaatttacttgaacaaaacagtctgacaaaaggccttaaaaaagcaatttaaactgaaatagctttatttttcaaaatggaaaatttatgcttgacagcaattcagagattttatttccggtattaagccagatctttaaatgtatgaaaatgctgagcacccagaactgattttaattttttcctgtttttttttttttcatgttaatcattcagttaattgtgttacaatacaaatgaaaccaaatccatattctagacaaacatttaacataaatgcagtcagggtcaaagactttccacccatttatcaatatgaatatacagagtaagaaatgtgatatattgtataagaaatacaatatatgtaaatccatgaacaatctttgaaaattcaattctaagctttgatttgacatttttggtactgggaccaatcattcatcaatctgaaagacttagcgaatgactgttctgacttgggggcaatccaagttaagtgaatttagagttaatctttaaagaacaatctgcatttgagaaattatccatcaccccaatttcttgtaagacaatatagagcctgggctcaagctatcaaatacaaacaattaaaataaaaactactaaatgtttggaaaggacataaatgagaaatcaacagaaatgcaggctgatgctgcataaaacaagatgagtacacaagaataccgtaagaataaacaagcgggtggaggtggatcacacaagcgagaagaatgagtgtcaggtagcgacggcagcacgaatgcggtttagtgctcaaaactatgtctacaagatgccaggaaggattagtattaaaaacagtgcgacaggactcgagcgccaggctgaaccaccaagtgcagaatgggacgcggcagctgcagtctcactcacttgcgcactcacacggctacagaagactgaggcgtgggccaccgtgtggccagttcactaccactaggacaggtcccccacaagtcccaaatctaatcttaattcaatacattgagcattttgtctgttgtatttcactaaccacacacatacagcaaattttaaagcatacaacttcagtgcatgcacatctcaagatgagccaattttttgtgtttggttgatgaggaacatgacagattcactagattaatgaaggtttcttgctgggactaatttatttggcactaactcaattaataaattatgtcaggatttaacactctgacaggcaagaggcagattaatgtttttctttaaatatgtattttttttttccctgaatgaactatagcaatattctggccattcactattttgtaaatatcctaaaatccggtatgaagaagaacttccgtgtgcaggagggtatggtcatcactggcaagaaggaattaaagtacagaaactataaaccaattcagtggcaaccaaaacaatacacaaaaaagacattccctcaatccccaatacttcccttttataagtaaaactcctaattgagtgccccattcatgatacaatcaaacacgcagaactatggccaactagaagggaccgttcaagacattctgaaatgaaactcccaccgtaatcacaggtgagtctaaatggttttaaaatcctggagaaatcctttgcttttatttaaggacagcaagcccagcaacatccaggaaacaagaaccataaacccatccttccccaccgaggaaagtgacactgagggaggcactggtggtggaatggcagcccatgcagtggctgggaaactgaggctcttcctgtatgactgactcccaccctggaaaatcccaggatcagaaccggggaggcaaagcattatcaacagactccttgtctgcctcaaaactgctggagaaatggacaatttagcctgttcgtgtttaagaaggggaggaagaggggcccgtggcttcactttattactgttctgagagaggaagacagcacacagaaaagggaacagtcacccccaactagtaaaatcagctaaagcaaccctggcagtctatgagtgatagatgttattgccagactgcccctaccttcttacctagtccacactttattctccctggaaacacataaagatttagaaattcacttttcaacttaagcgcctagatgacattttgcctggtgtgaaggaagcagcttgatgaatatggaattgcaaaggagaaatacttcacataatccagtgatgatgcatttcagggttgctatagtaccatggaactgcatagtttatctgtaagggtaatttaatatatggactaagttttcaaatgcagattgttttaagtaccatatcagtacatatcactgggatatctatagataatacttatattatctacagatactaactgggaaagctaaagaacagtttttccaacatgagttactttcaaatttgcaaagtatgaaaacaagtgaaaatgtaatcatacgctcacttatatattagggtttcacttgtttaaatgatctgtaggattttttattgttctaagtgcccagtttaggactacaagtgccaagacaattattcataagaacactgcagtgttcataaatagtcaaagttgaaaataaaaacataagcagttaaagtatttgttacagaatcaggccactgctttctcaggatgataatatgctaacctactcagtcagatacactgttctagagagcatgcctgtgatcgtctgaggaacgctacgcctacgctttaaaaattatcactaataaaatggaactcctttatttgcatttccactcttaaaaatacattacttttgtttagtaaaaatgaagttctatacagaaataaaattagacgtttcagaactttcatgccatcaatgactttatatgccatcaatgacttcatatgccatcaatgactctttggtcctaccaattccatttaactttaattgctctcaatgtaaaagaccaaaatctgtgcaaatcagcaaaggcagggtaccaacggacccaggaacaggccccacaacactttagagacagtggtaaacaatctaccttccttctagaccaaaactgtgttgggcaacgtagcaggggtggcatttttctgggtgtagttaatattaacctttctctgaagatatcattaactttattttgcttggcacaaatggtttttaaagtgcattcctattcattatttcatcattgaggacctgacaaaatgaggctgcgagggaagacgctattgtctgtatcacagacaaggctaagcttaatacattaatacatcatggggtctgctgaaggtcatggggctaaaagcataaaaggagtggccagaacttcccaaagagcagcaagtcactatgggagagatcccattaggaaggggctatggtatcattttaaacttggtcataaaatgtttctattgataaaggggaagttgagatggaaatcagactctgaatgttaaactattttcagcaggacaattgcacacgctgcacttctagcagggatgcagtttagggtctgtccttcccccttgcaccagtgtttcactacactgaacagtattaggaataagcaggccaggcttattcctaatagaaaaggcttaggaaccttttttgagacatttttgtgtcaaaaggattttttttaaaaataggattttgatgggagttattacttatcttgaatatggatttttaaaaaaaacatagaagaattaaaacacataaccataaaactccaaaattttcaggcctgtgaacaaataacaaaaagccttctgtcttctttgaagtataggacataattactctgaccaaatgagagtaaaataataaaaaacgccaaaccccactgttgacgcttattatttgaacctaaagacaaagaacaggcacaaacctctatcttggccacagagaatccagctgctggctcataaaatagaggcaacgtcacagtttgagcaagattcctgacctgtgcctccacgcatggtgcgctcacactgcagcggcacatggacacttacacgctgcggtacagataagctgacttctcaaacaactccaaaactacgcaagctgtattttgtgggaaaccacaacaaaaaatactattctcactctctacctattttaagacaggagatctattctttagccatcttcatattccaaaagaatggcaagtatttcttaagcagatccaccactcacaaaaccctgaaatggccatcttataataggaggcaacagaatcacattcttgaactcaattaaaacaccagatctcattttgtatcgtgctgctagtgtaaaatttaaaaataaagatcatggacccttttcctctgccttataggaagcagcactcatgcaagtctttccatgagactgatcaggccaaattaccaggcaaatatttgcaggtagaatagtaaaatccacattttctactctatgaacatcttgaaaaaggcatgtcaacctttatcagagttactctcaacttcagacgcttgcttctagggctgcgttttagaacgggcagggctgaagaaataacgtacctaatccaagtagtacggcaagacttggctctgaggttacagtttttacactgtaaaagtacgctttataactaactaagaggccatgggcctaagtgactaacaagacactgaaaccgagccactttttctctttttttttcttttcaaatagagatgggggtttctctatgtcgccaaggctgataacataactcctgggctcaagtgattctcccacctcagcctcccaaagtgctgggattacaggcgtgagccaccacacccggcctgaaattgggccactttttattggaacttcaggaaagaaataatgtacacagactataaccagatgaacgtgccttgccctaagacataatgcaggatgctgcttgacgcttacctattctgatagctgtagtaggcagcatcgcgaggaatggtacacagctgcttcccatagcagcacaaagtctgtggggaaaactcatactgcaaaaataaaggagaaatacttttatataaaaatacattccatttactgtcttataatgttctagtctactatagagactagtaaattatttctgttagtatattagacagttttctaacaattttagtagctttaaagacattttgggatagcatgtgatagaactggctctaagagacattcactacagacaggtaccacaggcagagaggggcagccagaaacgcttccccatggcctccctcagtaagcgcctgtacacccagctctgatcacccatcacatcgcttcaggcatcaactgtgtcaccagacagcagattgcacatatgcactcccagtatacaggcgtggtctcatattagtataacacccctctggctggattaaccaggaaaattcactttccggaaaaacttaaaactgtaccttgcgtccacagcaatatccaagggactgcatgacagggtcaatttcctgctcaaagacctctgcaagcttactgcaaaacttatagactcgggatgtcttgcgattatagagccaggcattgttgaacatgagccagacgtcgtccacgtactgccagggctcttggtattgccctgtgtccagcttccgcttgatggtggagaggtccatgggattctttacgatgtcaaaatagtccttaaaaaaaaaaaaatggtctcagtatagggaatcccccaatatccaaatgccagtctcatctggcagctttgttttaaaataatagaaacagaaagcaccaaaataacttccattcccaacagtaagaaataggaaatgaaaagaaaataacctctgacgcaactgattttactcactaaaagtgtaattagtattttcaggtatgatcacattataatactccaaaggcaaaagtaaagaaaaattgttaaaagatacttctaacaaaaaattttaaaaatagatctttaatccactgaattaaaatagtgaacaagtttatcaaacagtgtgtatttctagatattcactcttgatcctagcaagcaaaatgaaattacaagacaaatataaacacaaagctagtaatgactgctacatagaatcggctgggtccccatggcctttgcaaggctatccaggaatataaaagagagaagcccaaatatttttttacagttcatgttcacaaattctttcagacaaaagtgacacaaggccccaaatataaagtgaagtctcaggggcatgtgcttcccttgcttcagtgcacccctcctccaaggaccagggcttcatgaacaggtgaaatcaaacaaaataaacactttcactgataactgttaacagacaacagttttttatattaggagaacaatcttcaaggcagggggattattttatctaatttcaagagataaaacaatggacactcagaagtcacaccagcaaagttataatctatttttatgaattaacttactggaattccgaggagctggggatctacaggctgccggaaaggtaatgactctgggtcctgtcgatacagtgcttctagggttggcatgagggcctggcgtaactcctctggtttaaagactgcagagaaaacatcaagaaaagacactttgtaaaaggtgctcagatccctcctacctcacatttaaaacggaatcctggctgctgtgacatcccagccacgatgctcctaaggcactcgaggggctctcgtccatcaccgttaaggactaaagcttctgaaaacacactagtgtcagaactgtgttcagcttgtgaggcaaaatacaacactgggaagtttgcttcttccatgaaaggtttccaacattaaaaacttggctgaaaaagaaagtaaagctaactcccaaatctgtctcattcatcaaactgggtggcaaataaagccatttcaggctgggcatggtggctcacacatgtaatcccagcactttgggagactgaggagggcggatcacctgaggtcaggagttcaagaccagcctgaccaacgtagtgaaacctcgtctctactaaacacaaatttagcctggtgtgtgtcgggggttcctataagccccgctactcgagagggtgagaaaggaaaattgcttgaacccaggagacggaggttgcagtgagccgagattgcgccactgcactccagcctggacaacaagagcaaaactctgtctccaaaaaaaaaagaccatttcattggaagggaccttaaaagatcctctgagtaaagttttttatccttggctaaattaaattcaggccactggagacaaacggttttgaatctcataaatgtaaacagtaatagagctacaaaataaagcatttttataaaaagttccatattgcttactcccacatttactaatgccaatttctccaacccctcagacaccttactgcctactacactctctgttttcactaatacaaacataaaatactggctgccaaatacattcaagatggtacattcatacaaaccctcaacaagtatgggaacaggtgccagggaagctgttcggtgtgggaggccggccagtcagcagtcagcgtgtcacgaccccacctggctcatgttcactcacacagagaagaaactggaggcaaagatgtctcaggcattctgatgccttagcttataagtgatgtattttttcttggtgttctttaatttttaattaaattattatttttgagacaaggtcgcactctgttgcccaggttgggggacaatggcatcatctcagctcactgcagcttcaacctcccaggctcaagccatcctcctgcctcagcctcaggagtaactgggactacaggtgtgtgctaccatgcctgactcatttttaaattttttatggagatgaggtctcactatgttgtccaagctggtctcgaactcctgagctcaagcgctccccctgcctcagccttccaaagtgctgagattacgggcactaagctatcatgcccaggtttttttttttttttttttttttttttttgagacagagtcttgctctgtcacccaggctggagtgcagtggtacgatctcggctcacagcaacctcagcctcctgaattcaagtgattctcctgcctcagcctcccgagtagctgggattacaggtgcccaccaccacgcccagctgatttttgtaatttttagtagaagatgggtttcatcatgttggccaggttggtctcaaactcttgatctcaaatgatctacccgccctggccttccaaagtgctgggattacaggcatgagccactgtacccagccatcatgcccatctcattttatatttttagagacagagtcttgctccaacgcccaggctggagggcaatgtagtggcgccatcatagccactgtagctgcaaactcctgggctcaagtgatcttgtcatatcactatgttgcccaggctggtattgaactctcggcctcaagtgattctcctgcctcagcctctcaaagcaataacattataggtgtgagccactgggcctggtctgttttttgtatcttgaaaagatttgttttttttgagacggagtttcactcttgttgtctaggctggagtgcaatggcgtgatcttggctcactgcaatctccgcctcccgggttcaagcgattctcctgcctcagccttccgagtagttgggattacaggcatgcaccaccacacccagctaattttgtatttttagtagagactgggtttctccatgttggtcaggctggtctcgaactcctgacctcaggtgatgtgatctgcttgcctcagcctcccaaagtgctgggattacaggtgtgagccaccatgcccggctgaaaagatttcttacaacaggtaagtggtaaactgtaatttaaaaatcagattaaaatatggtaaacatttaaagttccagttgggaagcggcaagcatcaggtacatggacctgccatcaattctgtgtggggtggggatggtctaacttgacaaattctggaaagcgtcatctgattcctaactggtgaaagcaaaagttaaaagttggaaggaaaaacccatgtgtttaacaggctcactttagagatgaaaacaggcgcaccaagaacatgcctcagggctcatttccatcaaagcccaggatacagactcttgaccaacctccgcagacaccgcctcctctccagggcacgtggctgcttcagacctctgacagcagcctgaggtccgggcaaccaggtaaaaaccccgacgcagcactccccacgcacacggtccccagcacttgaaggtgcaaaggcctggtccagggtgcagacgtgcccttcacagtgggaagcgtcggaaacacacagccttgcttcctactaactcctttcttctgttttatgcacagacgaagcagcatttgctagtctttgaataactttttatgagaaaacaattatgtaacaaatagccttttgatttctctgaatgaggggttggcaaattatgaccaagaggccaaatgtggccagctgcttgcttttctgtatggcccaagagctaacaatggatttcacattgtttaatgtttggcagaagaaaaagaaaagaatactatttcatgacatgtgaaaatcacacaaaattcaagtgttagtctccaaaaatacagctttattggcacatagctgtgctcattcgtttatataggatctgtagctgcctccgtgccacagtggcagcactgaggagtggtaacagaggcctcaggacgcacaaagcccacagcgtggatcactgggcctctgcacggagaaggcctgcagaccctgtcaccgccccagtggtaatcgggagtgacagggcctgaaacaagtgtcactttggttgatcatttattcattcattaaataactattcaaattccgtgctgaggagagcattttctttccttttttttttttttttttttgagatggagtctcgcgctgtcacccaggctggagtgcagtggtgcaatctcggcccccaaagtgctgggattacaggcgtgagccacggtgcctggccgaggagagcattttcagactcctgtcttcaccagcacctttctgtaagaagatcccatatgtgcagaagtgaagtcaggagtgtatgtgaactgcgccgctcccctcctctggcccgaggacctgctccacgcggcagggctgttgcagcgcaccagcatctcccaaaaacgcggctctcgagcccttggaggctgctgtctcatatcgcagtccccagcccctgtgactactgaaattttaccaaacgaataatattacaaaaaataaaaaactcagttcctcggtcaccctggtcacatttttatttttttgagacggagtcttgctctgtcgcccaggctggagtgcagtggcgcgatctcggctcactgcaagctccgcctcccaggttcatgccattctcctgcctcagcctcccgagtcgctgggactacaggcgcctgtcaccatggccggctaattttttgtacttttagtagagacagggtttcactgtattagccaggatggtctcgatctcccgacctcgtgatccgcccgcctcggcctcccaaagtgctgtgattataggggtgagccaccacgcccggccaccctggtcacattttaggtgctcaagttatagcactgccctaggcccttctatgtgctgtaagatgaaaactatttcaccaaaactgaaaccaattttttttttttttttgagacgaggtcttctggagtgcagtagcgtaatcacagcccactgcatgcaaacttgacctcctaggctcaagcaaccctcctaattcagcctcatgagtagcatgagggactataagcatgcaccaccataaccagctattttcttatttttttctacagagacagggtctcaccatgttgcccaggctggtcttgaactctgggcctcaagtgatcttcccacctcagcctccaaaagtgctggagttgcaggtgtgaaccccaaagcccagcctgaaacaattttgttttgagacgaagtttctctcttgttgcccaggctggagtgcaatggcacgatctcagctcactgcaacctctgccgcctcctgggttcaagtgattcttctgcctcagcctcctgagtagttgggattacaggcatgcgccaccaggcccgactaatttttgtatttttagtagagacggggtttcgccatgttggccaggctggtctggaactcctgacctcaggtgatccacccgcctcagcttcccaaagtgttgggattacaggtgtgagccactgcgcccggcctgaaacaatttttataacactaaattatcatttgccttttgcactatgttggacatctgcacagatgggaaaaaagcaatcttttttttttttttttttgagaaggagtctcactctgttgcccaggctggagtgcagtggcataatctcggctcactgcagcctccacctcctgggttcaagtgattctcctgcctcagccttccgagtagctgggactacaggcgcatgctgccacacccagctaaaaagcaaaaacaaaggaaaagaaagccaacatcaccaaactctactgttatcacacacactgctgctgctgtacagtcacaagaaaaaaaataccagccatgcttaagaaaatttgtttaaaatttttcttcttttttttgggtagagatgggttcttgctatgttgcccaggctggcttgaactcctggcctcaagtattcctcctgccttagcctcccaaagtccttggattataggcatgagccactgctcccagccaagaaaaaatattctttatttttaagacagggtctcactctctcatccaggctagaacgcactggcacaatcatggttcactacagcctcaacctcctgggctcaagcaatcttcccacctcagcctcctgagccattgggactacaggtgcaccaccacacctggctaatttttaaactgttttgtagagacagggtctcactacgttgcccaggctggtcttgaacgcctggccataagtaatcctcctgtgttcgcctcccaaagtgctgggattataggtgggagccactgtgtccactcatttcttaattaattaatttatttttgagatagggccttgctctgttgtccaggctggagtccaacagtggcatcacagcttgctgcagccttggacccctgagctcaagtgatcctgctgcctcagcctcctgagtagccaggactacaggcatgcaccaccacacttggctgatttttaattttttgtagagacagggtcttactatgttgcccaggctagtcttgaactcctggcttcaagtgatcctcccactttggccttccaaagtgctgagattacagatgtgagccaccacacctggctgaaaaaatattcttgatgagatagtaaaaagtattccttgtattaaatcttaagcgtttggtacatgtgtgtggtttttttttttgttttgtttttgtttttgtttttgttttttgagacggcgtctcgctctgtctcccaggctggagtgcagtatctcggctcactacaagctctgcctcctgggttcacaccattctcctgcctcagcctcccgagcagctgggactacaggcgcccgccaccacgcccgcataattttttgtattttgtttagtagagacggggtttcaccgtattagccaggatggtcctgatctgctgacctcgtgatctgcctgccttggcctccgaaagtgcggggattacaggtgtgaggcaccgcgtctggccgcctggtacatgtcttttattctgtgtgatgaaacattctgcctatctcctcacacagaataaaagatgtgcgctgcataggcacagtggccacatcaggaggcagtacttgggcaagtgttggaatttacagctgaagtagctgcttgccctcgtggagcacattaaaactttcaggaatgactgagagataagctatagttactaagctctggttatatgtcagacattttctcagaaatgaacaaagagggccagttacttcaaggacaactgacagtatttgttgccaatgctaaaatttgggctttcataaaaaaatcaaatgctttggaaaacttgtacatgggcttcacagcttctcaaaatttattattagtattattttttgagacagggcctcactctgtcacttaggctggagtacagtgacatgatcaaggctcagtgcatctttgacctcccaggctcaggtgattctcccacctcaacctctcgagtagctgcagctacaggcatgcactaccatacccagctaatttttttttaatagagattaggtttcgccatgttgcctaggctgctctcgaactcctgagctccaggctagagtgcagtggtgcaatcatagaccctgaattcctgggctcaagcaatccttccccctcagcctcccaaaatgctgagattacgggtgtgagccaccatgcacgccctgcttttctaagttggtaagacttgtttgaagagactgatggtggtattaacaaatgttgatttttttttgacactgtatagtgaaatatgtcaacatatggaaaatctgcagaacttaagtgtcaattgaaaaaaaaatcatgcaagcacaaaagatccattccaagtacaagatggatcaatggattctaatgtcacagactatgaaaaatccagtgctatagattctggttcaatgtcgcaactaacctttaagaaaccttcactggctgaattttggtatagtatcaaagaatatccacaatcagctgaaagggctacgaaaatacttctccctttaccaactacaggattttcttcatacacttcaaccaaaataaccaatcacaacacagtaaatgcagaggcagatacccttaataacgccactattcttacttatttttgttttggaaaaattgtttttcatataaatgttttctatgggtgccatgtaacagactattttaaatgaactaaatatttaaaaatttttctctttttttttttcagacaacaatctcacttttgtctcccaggctagagtgcagtgatgtgatctgggctcactgcagcctcaaactcctaggctcaggcaatcctgccgcttccgcttctcgagcagctagaattataggcgtgcaccaccacacttagctagttttattttagttttgtagagatggagccttgctatgttgctcaggctggttttgaactcccagcatcaagcaagcctcccatctcagcctcccaaagtgctgggattacaggtgtaagccactgtactcaaatttctcaactttagtttccagtagagtaagcaatgatagataatccacacaacaactctctggggccctcaatttctaagagtataaagagccctgagattcactgtactccacactctccagggtcccttccagctgcagagtaacatggtctcagtctctaacatttctctgcaatctttcccaaaagtgtcatctgcagccttggactttctgagtcctgtctcccatttctaaggttcacttgacaattttctgataccctgttatctctttactgtggatacatctcaaatggattccatccaacttccactgtgaggcgggcttacctcacacatctcagaccccaaagatgcctaacctacccctcccccatgtctcactacacagggtccctaggcgccaccctgcccctcactctgcatgctcagcttcctcactgcacctgcagaaaccttctgcctccaagtcaccctgtgctgtcataatgaccatcttccttaaattatggcttttttggttattctcctactcacatacatcactggttctttatacttttatgagtaaagccaagctccttaacctgctcaaggacccagacacatttcaactcggcccctgccagcaccatcagaagacagctctgcagcctgggtgccctcggagcagcagctcatctctcactcctgccatgagccccacaggcacagggcaggggtcctgctcagcctgagtgtttctgcaggggaaagtctggggaatggcaggcaagaaaggtaaaagggcagatagaattatgtttctactttagcttttaatcctccacatggaatcctaacaccgtggaaaagcagcatgctttaataaggtaatgaataaatggcctactttttttgcgcggctgcgaaggagatgttgactgagaggctgtgccgttactgctactctcttcttcctctttaacttctactttcacttcaggtttcttttcatccacttccattggttctgatttctgctctgctatgtctgtttcttctttaacttgggaagctccttgcaaatcctcctccatcatcttgagaaaaacattacagataacatatgaatatcaaacacctttatgttaccgcaacctcacgggaagactcttacaagcctaaaacaggtttgttaaaaccttcctctagtcagagttgcatttatgattcctcttctcttccggaagaagaaataaagtacttggtgttcattaagtcgcttcagcacagagtcagtgcaattatggtcctaaatttaaaagtgtttttttttttttttttttttttttttttttttgagacagagtctaacacccaggctggagtgcaatggcaagatcttggctcactgcaacctccccctcctgggttctagcaattctcctgcctcagcctcccgagtagctgggattacacgtgtgtgccaccacactcggctaattttttatattcttggtagatatggggtttcatcatgttggcgaggctggtctcgaactcctgacctcaagtgatccacctgcctcggcctcccaaagtgctgggattacaggtgtgagccacagctcccagcctaatttaaaagtttttaaatgtaaaactgctttaaaaattgcacatactcagatttttcactacagatatttctaatttggaataaaaatctccttgaaagttggggcagggaccaaaagtccttctcagaggcaggtgtggtatgagacaggaaggagcagtggggactgtggctaattggagagcccactacagttggtgctcacaaccagactgctgtcacacagggatgcaggcacaatgctgaaagcatctcatttttcaagaaaagccagaaatctagagttttatttgcaatttcctgatttttaaggtattgtgtgggccaaacacatttagaggctggatccagcccacggtctgccagctttcagcttctgccataggttaattagtaaatgaatccaccaccccttctgtagtctacctctgcagaactagaaatgaatggagaacataaaataaaaggctgttggatgattcaagtatttcaaatataagccagtattcttcatttcgggcaaaataaacccacccctcatatttaaaaatgaaaaaccaagctgttttcaatcaatttcctatacaccaaaccccgaacccacattcaaacagaatattttaactaaagtcagggatacccatggcaggctccaagcctcgcccgaggacacctgggtaaagttgcgatacgcagtcaatgcattcctagggagcggcacccacctcagacctgggctcccctttggattcaccaggatcgggctcagtgtcctctgcttgggtctccgtcttcatttccagcacaggtacgtcaggtcctggctgctgggaattggtttctgcgctggccaccgaggagggggtagggactctgttatcaatgctggctgctgcctgggaaagctgtgaaaaaaccgaaagcactgacttcagtaagcaaggtaacataaatgatcttcaactatgctgctcatgcaacctacaatttcccattaacatttctcaatactgatccagcaggtgcccttctgtgaaaccgaagaacaggggttaaagtaggaatgagttctagagggaggtaacagcagccagaggtacaactcaggtcttgccacaaaggcagaggaaacagcagagcttttcaaactttgacataaatttattttctcgaagttttctagctaaatcatgaaatctcatattttgaaattaattcccttcaatatggtggttaatgtgtatggtaaaaggctgaattatgaatgcctaagcacatctgaagggagggaaatcaagtgcctacccaaagacagtgttacccagcctgtgtgaacggtaggaacacgggtgctggtggagtaaatgaacattacacgaaggaaccactaaaagaattcctaatttgcaaattcttactcaatggaatttttttttttttgagacggagtctcactctgtcacctaggctggagtacaatggcgcaatctcggctcgatacaatttctgcctcccaggctcaagcgattctcccgcctcagcctcccgagtagctgggaatacaggcaccagccatcatgcccggctaatttttatatttttgtagagacaaggtttcacaactttggccaggctggtctcgaactcctgagctccggtgatccgcctgcctcagcctcccaaagtagtgggattacaggcgtgaaccaccgcgcccagcctcaatggagttttaagtaaacaaacaaaagatgacaatgtctcgctctgttgcccaggctggagtacagtggcgtgatcttggctcactgtaacctgtacctcctaggctcaagtgatcttcccacctaagccttctgagtggctgggactacaggactacaggcacacaccaccatgcttgtctggttaaaaaaaatttttttttgctggagacgaggtctcactatgttgcccaggatggtcttgaactcatgggctcaagtgattctcccaccttggcctcccaaggtgctgaaattataggtgtgaaccaccgcgcctggcctgacacacaatttttatgggaaaattatcttctaagagtcttggcccaaaaacagcagagacagagaggcttaccggtgtgccaggaggctgggcgtgcacaggcgtcggctgttgctgcgatgactgaggggtagccacagacgggggctgaactggggtttgaggctgcggggtcacctgggcctgggctgctgcctggactgtaggggtgctctgggtttgggtagcactgggcactgagccaggagtcggggtgggagtctgcccggaagacgacacaggagttgatggctgagtgggagctgctggctggggaggagtcatcccaggtggtgtcgtgtgctggagagatggcatgccagcagccgtggaagcaggaggcggtgttgggtgcagtggtgactgtgtcactggagggcaaggtagctggctggcctgaggccccagcatgttgagagggttaggaagagcagcaccaggcacctgtccctaccagaaatggacagagtatggtaaaattatttcccccgtttgaaaatgtgatgaaacatttgaaaaattaaatgtatgaaaaaaaaatttttttttttgagacagtttcactcttgtcgcccaggctgcaatgcaatggtgcgatctcggctcactgcagcctccgcctcctgggttcaagcaattctcctgtctcagcttctcgagtagcagggattacaggtgcccgtcaccacgcccagctaatttttctgtttttagtagagatcgggttttgccatgttgtccaggctggtctcaaactcctgacctcaagtgatcctcccgcctcggccttccaaagtgctgggattacaggcgtgagccaccgcgcccagccaaatgtatgggaatttaatcacattttcttgggagtgttctgcttgtgaaaattcatcgagctatacacttgtaatgggcactcctcaataacggtaaaactacacacgtttcttatagtctgatttatataattaaaacaaccattgaaacttatggcttaaacacacacatctacagcagtcccctcatatccactcggatacattccaagacccccagtcttggaacgcctgaaactgcggatagtactgaacccaatatttaccaagatttttggatctgacaaccaaggtggacactcagtgactaagaggtgggtagtgtctacagtgtggaaatgctggacaaataaatgattcacatccctgggggcacagagtgggatggtgacagaattcatcatgcaacttggaatggcactcaatttaaaactttttttttttttttttaaaaaaaaaaagacagagtctcgctctgtcacccagtctggagtgcaatggcatgatcttggctcactgcaacctccatctcccgggttccagtgattctcctgcctcagcctcctcagtagctgggattacaggcgtgcaataccatgcctagctaattaatttaaaatttatgaattgtttattcccagaatttcccatttaatatttttggaccacagttgaccccaggtaactgaaacctcagaaagtgaaatgacagattgggggagctactgtacattgacccagcctataagcttcatgttctataacatgtacccaatgttctttaacattttctaagcttagcttagaaaaaggtattttttttttaagttgcttcttccctggggactataaaataaataaataaaaataagaataaaagttattgaccataaatatatacatccataagtacccttaacaattaaaaatttaaaaaaaaaattctctctgaaacacaaacacacacacacacacacacacacacacacacacacacgttagttactgaaagagaactgtttcagtgcagtggttctatactggggatacacttcagaattatttgtgaacattttaaaaatgattctgaatcactgttctagagcaggggttggcaatctcccagggcaaacacactgagctgcttgtttctgtaaataaagctttattggcacacagccacctcatttatgtaccacagcagcttctgcactacaagaacagaagtgatgaaaaccaagattgaatggcctgcaaagctgaaaatatttagtatctggccctttacacgaagtttgctaatccttgttctagagaaatgaaatgttatggaaagttaagaataatcatttagtgaggaaatctaatatataataatgacttatgcagcattatttcacattaaaaactcaaaacaaggctgggtacggtagcttactcctgtaatcccagcactttgggaggccgaggtgggtggatcacctgaggtcaggagatcgagatcagcctggccaacatggtgaaatcccgtctctactaaaaatacaaaaaaaaaaaaaaaaaaaaaaattagctgggtgtggtggcgggcatctgtaaccccaggtacttggcaggcttaggcaggagaatcgcttgaacccgggaggcggaggttgcagagccgagattgtaccactgcactccagtctgggcaacaaaacgagaccctgtcttaaaacagacaaacaaacaaaaaaaaacttaaaacaagaattttatcttttagggaggatttggtgtgttttaaatacatgtatattttgtatacagtagcaatgatacgcactacaactaacaaaagaggaaaaaaggaaggaataaatggaaaatcaatttcttcagctctagattgagaaattaaaaacatttaacaagaagggaactattgaaatgattctgttagcttgatttcacctggcagtggagacaggtcaaaagaaacaaaagccaaatcatcaagagtgaattcatgggtccttctcactcgctttttaaaatcctaatgcctctcagggtcacgttaaagttagaatttaaaatacacaaacaaaaaataagaaaacaaaaactcaaagatcaaaacacaaaagcatacaaaccaaaaattctaaatccattcccacttttgcatatagttaacccagaaaggataagagaaattccaaacgagttaaggactacaggacaaaggtggagaaaacaaagagaagctgatacaaagacatgaaatgtgcattctggaattttaatttccacgaaggaagacagaaaaaaaaaaccaaaacttaacacaagaattttatttcctagggagccacggtcccagtggggcacagtacctgtgacacgcctgtttgggctggcggctgccccatgcccacactcatcgccccgctggatgacgggaactggttctgtggcagaaactggctctgagcgggcgcctgggccatcatgttgttggtgtgtgcacccatcatgttcggaggctgaggcattcgggaaggagaaatggccatctacgagacaacaagcaccaccagagctgtagttcggaagctgacggccagagttttcaaggtgagccagaatgatccaaggcttcacaaccccagaggatggcaagcacagggctcacatcctgcccttcctcatgggaagagaccaccacttgctaagaactcccgcgctcctgggcaccttacacactttctcaggcaatctctcaaatgagccagcttcaaaatgtcctctgaatagaaatcaatagcaggctataatttaaagtttaagacatgcctatgagttctctaaagtgtttagaaagcagcctcggaacagcgagctctcagtcaacagatgctgacaattccctgctggccacatatctgaggctgccttctccagccttggaactcccacattctcacaaagccacacattcctatgaatttgttattccaataaaataactaacagtcaaataattctgtgtagtaataatttttttaaaatgagagatgaaagaaataaagcataacccaaattcaaaggaacaagaaccacaggattctcaagtgacatgaattctgctgcttagataatgttccatgtgagagggagggctatctgcagcacagcgaaagagaacacttacccctggcactgagcccatgctgttcatctggacagagtggttcattggggaggctgcacgaggtcccatgggtgcttgtggcaactggacgttccccaaggacatggggttaaatgaattcatccctgtaaatgtacccacaacggttcattaggaaaagcacccacaggaaaacagaattacaacttgctaaataaactcttaagtaaaataagatggaacgcacaggcaacagaaaactgaaaagaaatcacccaattaatcaatgaagatgatgaaggaacagacttctccatatccagagaaaacggcatcaatgtgggggtggtgacggtggcatggtgaggggtaccagggaaggacgaggacatgaaggcataaggttgggtaagacaggaacaagtgagacattaaacgaggctgtggtagagctgagccagagggcacagtaccaaagtgtcatagcaacaaagagggtgaggaggtgccctgaaaggacagcaccctcacaagctacagaagagatgtttccagagaccagggcaagcttctgtgcacacccatacctaatgcctctggagcagctgacgcccatcatccgaggattcccagctccttgctgggtttacattcattgttagaatctgtgctaagtctccaaatgttcttttaattttgcaagcaccttaagcattaagaagtgcccaagggtcagccgtcctcaaccttagcctcctgtagtttacaggaacaccacatcactgaaagacacttcacagccagtaagtgtctccagactgcggtgtctagttccttccaatttccaataatactctgtaaactctgagttctaaagaagcaccagttcaaattagtcttaggaccaacactagaatctgacagaaccctttagagaatttctggaaggtgctgccttagcgctgctgtagtcatgagaaggctcaaaggatgactcacggagcactaccttcaatggctacctagaaatggtaccctcaaataacggagtgccgatgcagaccaggaagactttccagggagtctataatgtaagcttccccactccttgagaatttttttaaacaaaatgaaaaacaattactaaggaacagcacttaaagaaatctgtatttacccagatgtgctggtagggaggttgctaagtgcataactagaaaacatctattccaatattctgctggtaaacagcaggggcatcataccccacaccagcagcatcttcctatccaggctgaagtcctggaccaatccccaacacagcatccagccactttcccaaggctcaatttctctgactccttgatttctttcttttttttttttgagatgagatttcgctcttgttgcccaggctggagtgcagtggtgtgatctcaactcactgcagcctccgcctcctgggttcaagcaattctcctgcctcagcctcccgcgtagctgggattacaggtgtgcaccaccatgcctggctaaattttgtatttttaatagagacgggggtttcaccatgttggctaggctggtctcaaactcctgacctcaagtgatcctcctgcttcggcctcccaaagtgctgggattacaggtgtgagccactgtgcccagcctgactccttgatttctttcaaaaatcaaagcctgagcaaagcctctttccttagagtcttctggataatgtcaccaccttgtttcacaacctggaaaaatgtcctcctgcttgggtctcaatggtcaagagctacagggttttcaaatgctccctgccccaaaataaaaatcactgcttcaaccaaccaaaaaccagaggctctctacttaagaacctttcaaggttgttgagacagctgctgacaccccaacctggcacaggacctgtgtgtacactctctccagaagttgacatccagccagctgggcttaacccctagggccaagagcagcccgtgccgtccccatttcagcctctgcaagtgctcagcagtctaggactgtcttgcatgcttctccttctcagcattcagaagcactccctccccacatctagggtgcttctttctcggactcttcctaagagtaacgtaccacacccccttcaccatccattaaaaaaataaaaagctggccgggtgcagtggctcatgcctgtaatcccagcactttggaaggccaaggtgggcagatcacaagttcacgcgattgagaccatcctggctaacatggtgaaaccccatctctactaaaaaaaaagatacaaaaaattagctgggcgtggtggcaggtgcctgtagtctcagctactatggaggctgaggcaggagaatggcatgaacccgggaggcggagcttgcagtgagcccagatcgtgccactgcactccagcctgggcaacaaagtaaggctctgtctcaaaaaaataaaagaaaagaaaataaagtaaaataaaaagctaaggccgggtgcagtggctcactcctgtaatcccagcactttgggaggctgaggtggacggatcacggagatcaagaccatcctggctaacacggtgaaaccccgtctctattaaaaatacaaaaaattagccacgcgtggtggtgggcgcctgtagtcccagctactcaggaggctgaggcaggagaatggtgtgaacccaggaggcggagcttgcagtgagccaagatggagccactgcactccagcctgggcgacagagcgagactccatctcaaaaaaataaaaataaaataaaataaaatagaaataaataaataaataaatagctaaatactgcttcttatctcttggaagatctttcctataatctccaaacttcatactataaacatatccatactacctgtagaactgaattctgcttatcagcaaaaaggaatggaaagaagaaagggttagaaagaaatatacagggggagaggaaaaaacagtgaaagttatggctgttgaatgtaaaactaaaatatgattcaccacaaacagttcaataccttgagaaacttgcatgcgattcactggcagggacaggggtccatctatggtggcaaaacaaaaacaaaaacaaaaccaccctagttatttaatataatccttgattcaggaataggaaatttcttattaggacttcaaacttaaaagggaaaacagccaataggtccaaaagcacgtgtgttccaatgccagcgcaccctgtaaagggccttcccaagagagaaactcagtgtcccaacacagcctgaggcaggtggtcagggccactgccacatcaacagcttctgcagggcatgcatcagatattctaattctctgttcttagaaatacaccccaaacacgaaggaaaaccaaggaaacaggctaagggatggcagtaggaaataaaatccttacttggaggtctcacaggttgtgcctgtggaatcacagggggctgagcccccggggctggtaaggctggctggttccccaagatgccttgtttatgtaaacgcgacctccgtttttcttctagttctttttgtatcttgtagattttctctgctaataagtgataatattcatcctaaaaagcaataatattcaatatgaaacagttaaaactgtaaaaagcaactgaatgatctgtgttgtaggttctaactaatgaacttcctcattgagtacactggcaaaagtagtatgcaaatacctgatacaccagaagcccacattcttgctgaattcccaatgactttataggacatatcaaatagtaggtacttaatacatgttccatttcattcaaatgaacttcttgaatattcactgatgctaacaatattacaacaccacctactatgaaaaatatatcccatggatataatgtaaatttatatactccatgcaccaatgtagctaatcaagagagttctgcaggagatttgtgtcttatctgggaagtctccttggtcagtggcctcaaggggaggagtctgtcccaactacatagattccactatttccagataacaaagcagacaaatgtagtgctgtctactacagatgctgtagaggccagagcacggtaaacagcaacctaccctgctgttggcagactcgtacatgtccccttccactttcttagcataggctaccaggttttccatgcggcgatcctttagagctgcgggatcaggtgttgggaagatggcttggacgctgaaaggataacacatctatcaaactacttttttttttcttcttttttttaaagacatggggtttcgtccaggcgcggtggctcacgcttgtaatcccagcactttgggaggctgaggcgggagaatcacctgaggtcagcagtttgagatctgcctggccaacgtggtgaaatcccgtctctactaaaaatacaaaaattagctgggcatggtggtggatgcctgtaatcccagctactcgggaggctgaggcaagagaattgcttgaacccgggaggcagaggttgcagtgagctgagatcgtgccattgcactccagcctgggcgacagagtcagactccataccaaaaaaagaagaaaaaaaaaaaaaagacacagggtcttgctctatcgcccaggctggagtacagtggcatgatcatagctcactgcaactttgaactcctgggctcaatgatcttcccacctcagcctctaaagtaagctgggaagtacaggtgcacaccaccatgcctggctaatttttaaattttctgtagagatggagttttattatgttgccccggctggcctgaactcctgggctcacataatcctcccacctcagcctcccaaagcactggaattacacgtgggggccactgcacctggcctgaagctacttccaatgccatcaaataagcactacaaaatcaggatcatgtatctctggtggcaatacagtgtggagagaaatgccaagcctctcttgcctcgcatgtcaatacatgaatgaagttaactccctggagacaatcctgacctatcaacttatctacacatcaaacacatcaatattttgctattaacaagtatgtgctgggtcatttccagaataacacgattttcaaatccctaatttttaaactacttattactaaaaaaaatttgatcaaaataaggaagggaaaaaactcaaagggaatgtaagtctagctcatttaaaataactagctcaacaacgttaggcttggtgtggtggctcatgccacccagcactttgggaggccaaggcaagaggattacttgaggccaggagtttgagaccagcttgggtaacctggcaagactccgtctctctctctcaacaacaacaacaacaaaaaggccgggtgcggtggctcataaccccagcacttcgggaggctgaggtggacggatcacttgaggtcaggagtttgagaccagcctggccagcgtggtgaaaccctgtctctaccaaaaacacaaaaagtagctgggggtggtggcacgtgcttgtaatcccaggtactcgggaggctgaggcaggagaatcacttgaacctgggaggcggaggttgcagtgagctaagactgtgccactgcactccagtctaagcaacagagcgagactctgtctcaaaaaaaaaaaaaaaaaaaaaagttaactgttaactttccgttatgttaactaactgtaaggtgataatgacatgccatctatactctaaacttttccaattctgaggggtctccacaactagaatctggaactacaaaataaggtgaggctcttgagctaaccccagccccctcacgcagcctaaagtgcagaagcacattaaggccgggctgcactgagggtctttgcctcggtgataggggctgcaagtcagtgcccctcggcagtacagagccaccaatgctctctttgtcacccccgctcaccgaggacatagagtgtgggaatctctggcctgcctagggctgccagaactctaccagcagtgagagtggctccctaaataagcacgtgacttgtataggctcctagggtactgtcatctggtagccaatgggcaacacaggaataaaatcaaacatctatgaaactgcaaaactgttacgtacagtttatgcactagatggctccgcaggtcctgagtgacatgttcgtgccagcctttccttacaccggtgctagaaggaggagctgctgttggtatagtgctgagggttccaatgttaccagagttggagccatcgttcatcagtgggctaaggaggaaataaagacacttcatccatctactgaagtgactcaaacacactttgtctagtaaggttcttctgccaccacatgtgacttttaaaagtttaagtcaggagagccaagtgatgtaaataaataaaacttaaactatgttttaatctattatctgctctacatttataattaaagaaaaaaaggaaaacagcattcacccctcaccaccccatttaaactattttctctgccacacatttagaaagaatcagttttgtgtggttctcagtccatgctcctgttggactgtcactcagatctgaaacagggtcttactttgtggcccccagggaagtcggaagagctgattctgaaatcaagtttgggggctgctgatctgttgttattcctcctgctggaatgttcattggattatttcctttaaagacagaaaagaaatcaatcaacagttaaattttaatatatacttcaaagttttgatgacagataaccaacatgccaccatataaacaattggtggttatttaaataagtgattctggccagttatagtaagcactgcggcaggaactctgagtgtcatattttcaataatggtaatcaacgtgcacaaataatcagtagacaccctccccactctactttgtaaccaaagtaaggtgtgtttatggaggttagctgctatctaagtgaaaaagttataaatgacccacatgcagcctcttactttcattctgcttcattagtatcgctcctgagtgactcagctgcactgacacacacctctgtgtctccacccccaatatcagaaaataaaatcatagaaattaagctcaggaaaaaaatatagaggtcaatttgtctacaatcttcctattaaaggaaacgaaagctgagactaaaaaaggttaagctagtcccaaattataccatcaacaggagaggagttagattaacacttgggtctcaggattctaactcagtctcctggccagtattagttagacattcattagggcagttgttttccagaaagcaacaagtaagatgactttagctgggcatattttaaggagtaatttttaagtgtaaaatagttactctattagggaaagaacaaaactagcacaactagtcagccagtcttgacttcacagacatcactgcttagcttaagcctaaatgtaaagggactgtgtccacttaaagaaaaatattaaggaaaccatatgcagaaatggcaaaatcatggcgatgtgtgagcaaacgatcaaaggctggcaaataatgggctggggtgacaaaagaaaccatgacatgtccagcagcctgagccaagagtttccaggactcctgtcattgtcattaacctgctgaagtccaggctggtcacttccaactgaggggtagaccctaaccaagatgtgtgagaaactggcaaacacaagtactccaacaaataaatgacaacagtcagcatgaggcgtccagtcagcatcctgacttgtgagatctgcattctgaggcacatggcacattctttatgaaaaccgtccagacagaagtggcacagcaagcaacaaaaacattgcttcatttgcaaatgctgctctttttataagcatgtaacattttccttgcatcagatacttcagctttttcctgggagattttttatttcaaccaccgtagtaaaaaacacaaaacaaactgaaaactgccttgggttccatcactccattccctttgctgcatgtggacaagtaagaacgaagttgagagttccttcacctacccagggggttgagagtcctcatctgctggtgggtttgaggctgtgctggttgctggccaggaacctgaggctgcagctgcgtctggggctggttcatgtaggggagtccgagagcagcataggctcgctgcatggagctggggtctatgggatttgggttacttaaagaagtggcattctgttgccctgtgccaacagaaccaattgtgttttgaattccactagctggagaccccaggatggctataacgacaaacagacagacagacaaaaacgagaggtaagtaaaagggagaagcccacgaatgatttaaaaactattgagaagcaaatacatttcatcaaaatactacacatgaatatcataaagcagtaaacaagcctagggagaaaggaactgtgctgaaggactcatttattctgcctagcagtaagtgaggaacaaaaagttaaagaaaagtcaagtttctatcttagcatgcaacagaccataaaatctcacagataacacttgaaaaaaattattatgtcttaaaacctagagactcctcaagaagtcagttccagggagtggcaaatgtatgacaagggaaacgtctgattctctggggaccagcagacacctctgagatgaacagaggagccccctcctgttgaccccaaccctgtccttcactgctcacctgcacaggtacagagggcttaagagaaggagcagagatgatacctggtcggtcagttttgattaataaatctataatgtgctcttccaaatcacataattgcaagtccttgaaacatacacaaacaatgacagcatggacatatccttctgatgggattcctatgcagcagagcaccatgctgagctctccggctacatgaagctgttcaagaaatactgtacttgattgattgactgactgagctgtttgaaattaaggttggagtgaggcttcgcaattctgcatgggtcttattatccaggggctacctcagcacctctgatattcaggaggtggctctgcctcacgtggccaaagtcagcttctgctactgaggcccactgctggctggcagggaagctgccccatccagctagctaaccccaggagactaaaggaaaaactggtgtcaacataaggagctccatcccaaagggcttccaaggtaatggagagacaactccaaacttgcatcaacttggacatttcaaggtcaattcatctacccacctacctacccacctgttacctgtttgcctgccccctcatctgtcgcaacaacccaaatgctgttgtgtgaaaatttatcatatggcagaagttctatatgataccatttattcctatttttgagttcctttctaacttccacaaattttagagtcatgttaaaaatagcatcttatagtgttgttgctataacacaccatttttgatacataaaacacgaccacaaagcctttctttcaaatcccaaccactatgtgtaacagtaatattctcacattcaaccatcagcacacctataataaacccaatacctaccagagcaacttaattaaactaaaatgtgtgaaaaaaaattcctggtaattatactttccatactattaacttttctaataatgatattcagatcaactcattaacactcatcagacacaactacatacaccaagcactcattaacataaatgaaaagcaactcccaaggtgcactttatgacaagtgtgtagctgaagtaagtcacgcacaatacctttaaaagtattctaatacttactactccccaaaactttaaacatgtgtccaccatacttctgaaaccgacatcctacatttttaagaagcactatggtatagaaatcaaagttaacagtggtaggatagtttatttttctacaaccttgcgctgtaaggaagaacagggctacactatatttaacacacatggtgatggactgtggagaagaacttaaaagaaacaaagtatggagccttccatttcccgtaaaccctttattgacttcttcctactacatttctcttttatccacacctccccaagtgccatctacttaactaaaatgccccaccttacagtgaatgccactcctaagctcacagcacttacagggcagccaacgcctcatactcacataggcctcccacggaagctgctgacacggtcactgcattttgtgttagaggcattcattttctaaacgtaaacattattatatttttattttaaaagaaaatatacctatgagaagcatttggaactcatcatttctaaaattcagaagcaaaggaaattaattatgaacaaataaagaaggtctctgccatttaagcatggctgaatttgaagtccaaatgatgctattacatgaaatgacacaaatactgaagggtaagggtgctcaggcattcactgcagggtgatggctgactgaaaggggagtcactatgtataagccaccatcaactgtactgcaacctcaaggtgctccaagtgctccatggtggtattcccaatccctctctgaaatcccacagtgactcctgtacccgcttgtctttagacactgacccttcgtgtattcactcactcacgtgacagactcagtgagtacactctgccaggctcccagacatggtgtgggcacaatctctgcattccctgagcctagggacaacagattatctaataatcacctaatgcacccaaactgcaccttggaaccctgggacagggaaaatcaggctcatgtcacgttccctgtgcatccctgaaaggtgggattaatgtcaaattcggttttgctcttcaccacctgccacatgggccacgtaacctgctgtgcagagtccaggggacgtgccagctatagcgcagcggccagcacatcgtgggccctcgcagcgcagcccatggagtgtcttggaactgaacagaaatgcacggagattggtccatctacctggcatccctaaggatgaagtttctctatttatcctttctgtattattgccacttaacttcttccaatgtcaaggccgtgtgctcatttggccatttttacatcttttttcctcgctagagcataaagctctaacttttaggaagtcacaacacacctgcaatgcactaacacagtggctgggttcttctgggcccatcaggcaacactcctgtcccggatatttacctctttaaagctccccaacatcccctagtctcaccaccccttctgatgttgctgaagaaggagcctatgacctatgaacaaaaggccaagttttatagcaggctctttctcggactcacctgccactcttcatgcacaaacaatgttccactaagaggccgggtacggccaagtgtaactgggtgcagtggctcatgcctgtaatcccagcactttgggaggccgaggcaggtggatcacttgaggtcaggagttcgagaccagcctggctaataacatggtgaaaccccatctctattaaaaatacaaaaattagctgagtgtggtggtgcgtgcctgtcatctcagctacttgggaggctgaggcaggagaaccgcttgaacctaggaggtagaagttgcagtgagctgagatcgcgccactacactccagcctgggcaacagagagactctgtctcaaaaaacaaaagaaaaaaggaatgttccactaagaggttttctgtacagtctatgttgctgatgcaaagaactcagttactcagacaacttaagcccctaatcatcctcaataaaactgaactccatttggaaattcagtgaaaacggacatgaatcaaatctccaaactttgtgagggtagggggagacagaccatgaagcagagcagtagttgctacagctgatgcttcaccagcacgagagtgagccacggggtcacccaacgcaggccagaaacacagtgcttgcgggaggcgaaacttgtgtatggggaaggccagctgtagggcttgagtccacctggttttggtatacctggggtgtcctggaaccaaattcccaaggataccaagacacttagatttctactaaaaaagcaatgctagaatttattcaggtggctcacgcctgtaatcccagcactttgggagtatgagggtggggagatcacctgaggtcaggagttcaagaccagcctggacaacatggtgaaaccccatctctgctaaaaatacataaagtagccaggcatggtggcatgtgcctgtaatcccagctactcgggaggctgaggcaggaatcacttgaactagggagacggaggttgcggtgaactaagatcgcgccactgcactctagcctgggcgacagagtgagacttcgtctcaaaaaaaaaaaaaaaagaatttattcagacctgcagccatctctacaaagttgctggtggcaccaccgtaccttgcgggcattgtgtgggccaggacctacttcctacctggcaccttcctatgcactgcgtggggcaccacagtgaagagaagcactgaggggaacccaggcactgccaggctggagactcagcctcctatcaggcacggccacaagccctcaagcaaaaggctttcttcagaagccaagtgacactggcgcagtgacactgctccttgctagcaaggagaaaagctgttcagatgaaacacatcacccacgaccctttggtgcttaagtcagggtcaatcaagcccaccattctctctacagccttcagattctgctccttgctgtcccccatcccactacagtctgtcaaaagaggtgaaaatctctgaagggccctcaagtgaacaaagggcctgctccacacacactcactgggcacctgatgggctattcgatgagtggcagttcaaaggacggagatcttgactccatataaaaaaaggaggtttttttttttgttttgttttggttttttgttttgttttgttttgtttgagacgtagtcttgctctgtcgcccaggctggagtgcagtggtgcgatcttggctcactgcaacctctgcctcccgggttcatcaagtcattctcctgcctcagcctcccacctcaggataccgagtagctgggactacaggcgcatgctgccatgcccagctaattatttgtattttagtagagacggggtttcactgtgttgctcaggctggtgttgaacatgagctcaggcaacccgcctgtctcactcagcctcccaaagtgcaaggattacagacgttagccactgcgtccggccaaaaggaggtgttttaaacaatctgaggcacctacagatggaacatgttgccaggtgaagcagtgggagctacactcatggagatgccgggcagcagctggggccatggctgacgcagccgggacagtgcgtgcattaggctggctctggggccgaccctgcacacttgcttcaacagtccctgggggactctaggttggaaaacccctggtctctctctcagagaatgactcaaaccctctcaccagcactggcccagatacctggtcttccaaggcatccagagcagtgcatctcagattttaatgtgcacactaatcacccaggatttttataaaaatgcaggttttaatataagaggtctcaaatgggggcccaatttctttattgcttacaacctgggagcacctctatggcttccctgaggcctacactttgagcagcaagaacttcacaagtgaggcagcataagccccaagaggggaacctgctcacgggtcccaaagcccagtcaaccatgccactctgtgcactgaatttactggaggtcagatgccaggactgacataagatacttatcttggcaagtcctaattattcaaaaaaaattgaatattgctataagggatggttaactcgagatcagtgattacagaatctttaaaaaacaattcaaggaaaaatcgaatgaggccaggcgcggtggctcacgcctctaatcccaggacttttgggaggtcaaggtgggaagatcacttgagctcaggagttcgagacaagcctgagcaacatggtgaaaccccatctctacaaaaaatacaaaaattagccaggtatggtggcagatgcctgcagtcccaggtactcaggaggctgaagtggaatgactgcttgagcccgagaggttgaggctgcagtgagacttggctatgccactgcatgccagtctgggtgacagagcaagactccgtctcaaaacaaaccaaccaaccaaacaaaactcaacacaggccaaaaaggtaatcaatggtctgggcttcatttcaaagaacctcagattagcgccacaggtgattctggaaggttctctcagtagagacattaatcacagaagttaagagagtggagcatgtgctgaccaaggaagtgtgcatcaggtaagaccagcgctggcctgtgggaaacactgcctaaaaagcagagtcccggggcccctaaggcagtctccacagagcgagcacaggtgggtctcggcagagtccctgaggcttccaggagctcatcacagtccacctttctgttcacctcgtttgcacaggaaccccagtccagtcaaatgcatgccctcacaagctgtgcactgtgcagacactgtccccactgtctgaaatgttcttcctttgttattctgtttgcactgggctccaccaagtcccacctttctctacaaagtagtcaggtgcgctccaattctcctcgaaaagaatgctgattgcactgacttgtctctacctcggtcctttgagggaggtcacccttacgttatttttaacatatatattgtcttcaaaacccaaccttaagccaacgtagggtcagattcacattttcctctctgggttcctaactcaagagttcacacacgataagcataatttgctttgggagaagagaaaaaacaataaaatttacaaaaaggatattgctgaaaccttgtcaatcatacttttgtaaaaaaaaactaccaaaaccttgcagcaagttaatctaaatcttccttgtgactttataaaatcatcctggtaatatcttacattctgactagtagaaaacctgtggtttaccacttgagagagcatgcacagaatcaattttcacaacactcaggccgttataaggatggtttaaaaaaaaaaaaccacatacgcttcttttttcttttaaaacaaaaaccacataagtgtttcttaaaaagagaaatcaccaaagtttacaactgtcatggtagtatgtactaaaaacaaaagatcctcaaaaagccacacccccaaattaaagttaagaataaaattctagctcattattcatagaatattgtataactacaaacttgacaatgaatattttggcacttaaagagcctattactgaaatgtgccctaaaacacaagaaatttagccatcacaatatactaaagaaaaaacttttacagtaatgtgggaggaaaaacagactgtattccattagaactactgtcccaaatatctggttctagaagacccaggattccagaatgtcactttatataagaaatgtccagggaaattgtttattaattcaaattttagtcaatcaaagaataatttaactgacttttaggaaactggctttttttttttttttttttttttttgagacggagtttcgcccttgttgcccaggctggagtgcactggcgtgatctcggctcaccgcaacctccacctcccaggtttaagtgattctcctgcctcagcctcccaagtagctggaattacaggcatgcgccaccacgcccggctaattttgtgtttttagtagagactggtctccaactcccaacctcaggtgatctgcccgcctcggcctcccaaagtgttgggattacaggcgtgagccattgcgcctggccaggaaactggcttttaaaggaaactcgttgtggttcttctgtagggaggcagataacaggccccattaccctggcatttctcttctctatgacagggacaccctgctttaaaggaagcagggtcagcgtcagctcgctgcctactccctcgccgccagagggaggtgggctggactcagtaaaaggaaaaccacgggggctgtcactggcacgccactccacagtactcttaggaacaaagcactttttccatctttccctgggccactcagaaacaaccagaaagaaaagcagcacatgttctccaggcagctgcggggtcttgaggaaggatgatcaagaagaatgagaggaatgaacacgtaatacacaaaacaggggagggtggcaagatggcacagacgagatggaggaagatgaggaagactgtgctgtgctggaagggtcgctaagggtacagctccagccagaggggacaggagactgaagggcacttcctagctgtccgaaactgaatgacacacccaaagaccacagttttacctctaaaatgacaggaagatggttgaaaaacgggagggaggttcatccttcttactgcctgaagcctacaaatggcagggagccccagagccccaggcggacctcccaacaagcagggatcgctgcgtaaccagccgtgccgagggctacagacaacctagacaacggcaaaacgactggggtgatcaggatgcagcagccctagggcagaggctctcactgtgaagcagagtgaacgtttagttatacaaagagttctggggaccatagctccacgtagagggaaaccttcataaatgtctgtgtgggattttatactgacccagactgactgacagagccttcaaaatttacttcaggataagggctttccaattccaaaagaagtatcccctctatccccctccctaagacgtcactgccattatagcgacatggaatttaaattctcacgtatggagtaactgtcaggaaataccatgtcttcgtgttggctcagtgaacaaagtgactctgctgttccatgctgcttcaagtgcatgtatgcagggggcagggagagggagaggcagtgagtgagtcagggtccaacattatcacagccgttcctgacacggagagcccgcctgccctctgagcttggctgtaccttgggctgctgtccgccctacctcaccctgcactccatggctcataacccctgcccactccctacctactctctgaattttctttagaaacaacttctattctcatctccaagcttctctgcccccgtgctcacttactttgttggtttcgcttgtcactggcatttttcaaagggaggcaaacaggacagtcatgtcgtgtgcagttcttccaatgagagatgatttgtcgtgaagatgcacaatgggcaactatgaccagaaaaacaacgagatgttatttttctatccaaatcgtcacactttcaattatacctaaattataatgccagattccataagaaaatggtaacaagtgtaaccataacacagtataggcagtcctcaacttacaaacaggctgttttccaaaaagtttgtaagttgactgttgagaaatccaaacaaaacttcccctagaagcaatgttatgaaggatgggtgataaagggcagcccacaaaacaaaacaaaaactattcaacctggaatagcgaacaactgcaatgaaaggtagaacaaataatagttctgtgatgtcactatttaaaataaaaatgttcaattatgtttcaagatgaaaccacctaaatactacagtgaagaaatacagatagagaagcaaatgagaagtctgtagagattctgaaagggactctgggcacttggtgaagaagtactcgagaggctaactgaccctggttattccgtcttcatcttctaaaggtctaaccttacccttctctgcttctctgttacaacagggttactctggggactcacaaatgtcacaacgggagacggggagaccagggggagattcccctaagtttatgagcataagcagagaaggaaagagaataaagattaaaggaaagtacagctgttaataagaaacacttccttcggtagaaatgaggtgtctgcggtaaaaggggagacagagggcacgtgaagtgcctagttcaccaccccccctgggatgatacagtgcatagttccccatgtcactgccagtcacccaggacaacttcgctgtcatccgcacttgcctcaagacacaggacagaggagcaaggccgcaggccaccaagacagatgttgggatgcaggaagggcgtgtgcctgcacgtgcctgtgctatgttcattgccccaaaagaaaaccacaatctagacattcacaacaaagacagtgctcaagaagtgaccaatgtcttccgtgacagaggaaggaggaaaagaacaaatacggggcacagcttcaagcagcagaagttcacagagtatcagaaaaccaaatcgcctttctcttcagcagataagacttcctggagcacctgactgtcgtcgcgtggggaacgtgagcgcaacatgtcttgccacacccaatggaaggcagcactcaggctgccggagccttatgaaccagagagctgctgtaagaacaataaaggcaaattcttcctgacctctaccactaggagttccaaaaacagcacttaccttggcaggctttcccagcctgacaatgcgtcatgtgattcaaaacgtttttcatggttcgacaatgcgggagcgagcaggcccgaacctctccgtttgcttgctctcgtctctgacacttatgagcatgaagcagtagaaccagctgctgctgtatcagtttgcgtttttcaggatctgcagtggggcctgttgcaattgcttgtgtgggtacaattcccactgatgtttgcatctgagactaaaataaagcaaaataataaaaatactttaacctctcagagttccaagtcatattcattaattatttctcaaacaaaagcaaaagctgatggataataccgaccacagagagaaggctggtgtagttctctaacccactgatgactttaagaagatccagcagcacagaaatcaacccaactcagcagcaaggctgattcaagttcacttgtatacaattatcatccaagcaagacaatggctggctcttcactgtagcaaccaaaatccaactcactctacaatatacacaactacaggaaaagctgtgtactataccagctggaccatatgaaactgctgtttctgtaggtcccaaatggccaaacactggcaatttcatagggtacaacctaattaaaaagattgccaaggcctggccgagcgcgttggctcacgcctgtaatctcagcactctgggaggccgaggcaggcggatcacgaggtcaggagatcgggaccaccctggctaacacgatgagacctcatctctactaaaaaacagaaaaaattaggactataggcgtggtggcgggtgcctgtagtcccacctactcgggaggctgaggcaggagaatggtgtgaacccgggaggcggagcttgcagtgagctgagatggcgccaccgcactccagcctgggcgacagatcgagactccgtctcaaaaaaaaaaaaaaaaaaaaaaaaaaaaaaaaaagatttgccaaggcctgaccaattgcaatgtactacaaacatttgatgtagcaaaaagaatcagagccaccttttggatttcattatcacatgactagaaggacaatgcgtgcagcttgatttcacagcaaccattacctctcctaaaagaataatgacagttagccttaatacaaccacccagtgcaatgggaaatgcattcttgtcctatgctttgtttttcattacaatttccactcagacagctgacaatttttaaagatttggtgatctgctaaaaatacagaaagggtttgctttcagttgcctgaaataacaagccagaccaaacaaaccttttaacagcaaggcaaatggaaaaggggacccatagagtcttcttctttacaaactataagcattcttcagataaacttactgaaaaagacttaggcagtaagagaagtgttcctaatgtgcaacagtatcatccacagttccgggatttccaattttctctagtactctgatatttccagcttgcttccacgaccctcattacctcccctaaagtacgccactcggattttttaaaaatgtatgaatcaaaactgtatattcacaaagaggagagaaaactatacaaataatttttaatgaatcaaagctcacttttaaaagtttatagagttttctgttttgattttacctttatgagaactagaaaataagtacgtagaaaagctgggtggctgggcttgggagcaaaactcttggaagtctgagaaggacccaaagcaattctgagaaggacccaaagcaaaatcagcatcctagctgagaagcagaacaccatgaatgcagggctcaactcctaagagaaaatagcctcttatgtttattttttcctgattataaaagtatatatatacactgcaggaaatttggaaagctagagaactactacagaaataattaacaacaattaaaatcccattatccaggagtccactactaaagcgttgataggtttttttcccttcttttttctatataaatgtttacgtatgaaccataatcaatagagcctcgtatctcccctgcaacacacatgttttgcttagtgttttttccatgttctgccccataccactaaactgtctcagatagtgggctggaatgacttgtaatgaacagcatgttactcttttaactttatactcatttaactagttcttgttatggggcataaactggaatccctggcccctcctttattttttataactgtaaataaagcttcagtaagcaaacaggccttgagctgcccctgcaagcatgcagtactggtgttaagtccactgctcaactggcttatccctgtggattggaaggtccatcgagaaatcaacaggaatggagatatggaggaatgggagaaacacaaaatgagcctcatttaggactctttcttttacgtttatgaaaatttcaaacatacagaaaaatggaaaggaaaggatatcatccttacacctaagaaaaagaaccatccttcttgggcatcagctaatactgagtcatatcccaatttctctggttgtccaaaacatgtcttttagagctggtgttcacaaatcaggaccccaagaaggcccacatcctgtatttggttgtttttaaggttcttaatctattgtatcttccctttttttactcctgacactaccttgttgaagagaccacacagttgtcctctcactgtgtcttaaagtacagaaatatcacataccaaaaaaattatataaaaattaggcaaaaaatttagctctacaagtaaattataaccagactgttcttaattcaccaacaattaacacactgatttcatttgggacttaaaaatattctttttttaaaatttcagagacaaggtcttgctatgttgcccaggctggcctcctgggctcaactgatcttcccacctcagcctcccatgtagctgggatcacagatgtgtggtgccacctaactggcttgtacttttttttttttttttgagacgggagtctcactctatcgcctaagctggagtgcagtggcgccacctcagcttactgcaacctctgcctcctgggttcaagcgattctcctgcctcagcctcccaagtagctgggattacagatgcccaccaccacgcctggctactttttgtatttttagtagagatggggtttcaccatgttggccaagctggtcttgaactcctgacctaaagagaccggcacacctcagcctcccaaagtgctgagattacaggcatgagccaccacgcccagcctggcatgtatttttaatagtgtcttttgcactacacctgaccatatgtcaaaacaggatggttggaaactatatggcaaatttaaaatttgttctgttatttgtctacctctggatggaggacaaatgcacagtttaatgagctctacatattgtttacaacatgcatctcaaaagccattctgagggtgaatcaacagtggaatggaaaatgtcttatgtccctgtctctgtctttccccatggaattctgtatatttgtctgggactagcttagttttgcaaagtacttacaaatacaggggcacacttaatttcctcctctcccaggctggtgttcaatgagccatgagagttagatgtgaactgcaggtggcccccaaatctgtcagaagcatccttcagactttcccaacctccctgcccagttcccactggcaggcaggcactgaggatggagggagagtacttcggaacctccctttaaagcacagaacaaagccatcgtggtggaagctgccccaaaagtaatctacgttttgtgtgattttgtttttctaagagccaagaaaattttgaaaaacagtaaaaataaaggggcaatctatattgccagatactgaaacatactataaagctaatttctttacttaagtccagaaacagacataggtgtatatcaaattagcatatagaagtccccccttatcctcagagttcaggttccaactcccagtggatgcctgaaacttcagatagtactgaatcctatatatactgtattatttcctatacacacacctatgataaagtttaatttataaattaggtatagtaagagattaacattaactaataatgaaatagaaccattactaacaatacactgtaataaaagctacatgaatgtggtctctctctctctctctctaaacaccttattgtactgcactcacttattttgtgattgctggtaagtgaaaccccagaaagtgaaaccccagataagagaggacgattgtctcctaaaggtggtgctttacattcaagagtggtgaggcatctttgatccttatcttcccttttatttaaaaaaaaaaaaattcacatgaactaaagtgaataaaaatggcttaaaatggagaaaaaaatttaaaaacttttaggacatgaggatgagaaagccttcttaacataaacacataatggagtttaaaaagtgaaaaactgcgagcaaattggttgatcttttatgcaaatgctctcaggaaagaaaggatactatcccactaaaaaattgggcaaagaaaatgcagacacctcacaaaacacaaagaaacgacaaatacaaaaatgttctacaccttggtgctgaggcaacacaagggagggagggatcgtttctcaatgacaatgaggaggagcacaggcactggacagcccaggcagaaggatgcaggcagcctcctctctacctcccactcaaaaatgaactcaaggtggagcaaacacttcaacgtaagagtgacaatcgtaccattcacagaagaaaaccgagaataaatcttcacgaccttggattaggcagtttcttactacgtcaccaaaagtgcaagtgataaaagaaaaataaactgatttcataaaaaattaaacttttatgcttcaaaggataccattacaaaataatgaactgtgaaagtggaaagtgaaagagaaaatatttgcaaatcataggtctgataaagcacttgcatctagaacatattttaaaaactcttacaactcagtaataaaaagactaatagcccaattaaaaaataagtgaaagctctgaacagttatttatgcaaagaagatacacgaatggccaataagcacatgaaaagatgttgaaccttattagccattagggaaatgcaagttaagaccacagtgagataccacttcacacccaccacatggctataataaaaagtcaaatgctaaccaatagcaacagggtggccaggacgtggagaacctggaatcctcatacattggtgtgggaatgtagaaggcagcagccactctggaaaacagtctggcaattcctcaaaaggtcaaacataaaattaccacatgacctctgcaattcctattttaggtatacaaccaaaagaactgaaaatgcacgttcacacgaaaactgtaaaaaatgttcacaacagccttttacaaatagccaaaaagtggatacaattcaaatgcccatcaagtgatgaagggaaaaacaaaacacggtgtataaccaaaacggaatattattcaaccgtaaaaagggaagtaaccacacatactacaacatgaactccgaaaacatgcttcgtaaaagaagccagtcacaaaagaccacatattctgtgattcaatttctaggaaatgcccagaatagatacatccatgggggtagaaagactagcggttggctggagatgggggttcaggggaaatggggaataactgctaatggtactaggtttctctttggagtggtgaaaatgtttcagaattgactgtggtgatggttacacaatatactaaataccactcaactgtacacttgaagcaaggactatatggtacatgaattatatcttaaaaagctgtttttaaaaagttcttactaatcactaaaggaatagaaataaaacaatgaggcatgtttaatctatctatatggccaagatttaaaaaatgctaattggtattgatgaggatataaagaaatggcaattctcaagtactctggcaattcggtgtaattttggaaagcaacatgtatcaaaaagaaaaacatgcatttcttttgacagtaactccacttctcatgattcattgttaaggaagtaattggacaagtatgttaaaatatgtgtgcaaagataatgcatcacattctgattaaatattgaaaactggaaaaaattctaaatgtctattaaaggtggactaattaaacatcctatggctacagacttataatgaaacaagaggcacccatgaaaaataaggcagacctcaaataacccctgtcaaagccatgtggagcaggggaatgggccagccaagccctgtctgaatttgtgggagaaaacatccaatgactgttatttaaggcaacgaattactaacaacaataaggcagacctttatgctttaacaaaaagctgtttaagtgactactattttaataccaaaaagcattccattttggggggaaattcccgagaaaacaaaatcagacgaatcagtaagaaaatgatgaggaactaaatataaaaaattaaattgtaaaagtatgggaaggtaattaaggtgggtactttgttacgtaaaggcagtaaaggctttagtcacagaacataaagcagtgttcctcactattaccagtaaaaattctttttatttttggagacagggtctcactgctacccaggctgaagtgaagtagtgcaatcatggctcacacagtctcaccctcctgggctcaagcgatcctctcacctcagcttcctgagtagctgagatgacaagtgtgcatcacgacgcccagctaagttttaaaattttttgtagagacagagtcttgccatgttgttcgagctggtcttgaactcctgggcagaagcaattatctcgccttggcctcccaaagtgctgggattatagctatgagccattgcacccggccttccagtaaaaattcttaaaatacagatcctctcatttttcccctaagagacgagcctgctttgtttttttaatttagacttttcccaatttttccaaaattaacatatatgtgcctttacaatgagaataaagacatttaagaagccaggagtggtggtacacctgtagtcccagctactcaggaggcaaaggtgggagaactgctggagcccaggagatcaatgctatagtctcccacgactgtgcttgtgaattgccactgtaccccagcctgggcaacatagcaagaccctgttgctaaaaaaagacaaaaacaaaatcaaaaacattgagaaaagagaaaaaagaacaaaagccccatgggcgactccaatgcaggagaagactgtacaattaaataggtgtgagaggctagattacataaagactggcattctttctatgactaaaatcactaggaacaagtgtaagggccatttatgaactaggaaaaattaaatctgaaagacacaagacaaaacaaatcatgatggagctattattttttctcctcccagtccatctttattcctcactctgtgccaggctctgtgttcagggtccaaggtacagcagttcattgaagacacacacatccccgagggaagagtactctggggactagccacacacgacaggtgaagtaactgaggccccaaggaaagggccttgcctgggtgatgagccaaccaactagcagcaaagccccaatcctgcagctctctgtgcccctcctccacagagggctgaccaccttgcattataaagtgttctaagagaatctgacaggaaaactggtgaacaacaggaccaaagcaactcaaataaatgcctatgtctctaaacataagcactttaaatcttactcatgagagaaatgctcatcaaagtaagatgacatcattttctcctattaaaggacagggtgggctgggtgcagcagctcacacctgtaatccagccctttgggaggccgaggtgggcagatcacttgaggtcagcagtttgagaccagcctaactaacatggtgaaaccccatttctactaaaaatataaaaaattagctgggtgtggtggcgcacacctgtaatcccagctactcgggaggctgaggcaaaagaatcgcttgaacccaggaagtggaggcgtcagtgagcagagattgcgccactgcactccagcttgtgcaacaagagcaacattctgtctaaaaaaaaacagaagaacggggtaacagtccctagccttgggaagatggtgtgatgctggtaatcgggtacatggcttttgatggaaagcactataatggtatctgtcagaagccttaaaatatatgcaatatgtgtttctggagcgaggatcatttcacatgcaatttgtaatgtggaaggaggaggtgagtatggtgtgagagccatactggtttaaaccttagtctcccctgcctgttactattttgagccactgagtaaagggaggttaacacaaagctcactgagcccactcaccccacccatcatcttcactcggtttagccacaggctctttgcatgtgttgcttattacataattggcagcctcaaccactgtgtatactccactgtcaaactacctttaaaagcaaactctttatatttactctggtattccttaatttttttttttttttttttttttttttttttttttgtgacagagtctcgctctgtcacccaggctggagtgcaatagcatgatctcggctcactgcaacctctgcctcccagattcaagcaattctcctgtctcaccctcccaagtagctggacttacagacgtgtgccaccacacctgactaatttttgtatttttagtagagacggggctttaccgtgttagccagactggtctcaaactcctgacttcaagtgatccacccgccttggcctcccaaagtgctgggattacaggagtgagccaccgcgcccagcctattccttaaattttaaaagaatctaacatgcatttttattaggactgttattgctacataggttttgggtaatttagccccaatgccatttttcctatagtgcctgtattctatgctaaggacataacagagatgtgcatacagaatgtggataataacgcttatcctcacattcctcacaaaaaaataagtcattttttactgtgtgtccaagagtaggttatcatgtcttcaaaggaccctgtgttccaaacagcaagagactgaccaagaaagaacaaggaaggacagtgtcacccctctgtgcagccaatgccccggatccacaccaggctgggattcttgctgctcgtcctcaaccttccacatcgcaacagggtccaaacctatgctcctcggatactcccccacccacctggaaacctgactcctccacaacctccacctagaatcagaaaacgataccaaagcgaacatcaggcagaacaagggctggctctgcaataaccacttgctcaggttccctcataaggacctacaacagctgggtatgcaaagctgtggcgccataaaacaaagaaaatgctcattaaatgtacacagctgccaacctgggaagaagcgataatcacctcagaggtgataaactggtaagaaacacaacatagctattttcatagaggaaatgtttcttgtgttttcttctttttgctttgtgtttattgattttttttaaaaaaataagattatcttaaaatttaagatctaaattcaggccgggcaaggtggctcacgcctgtaatcccagcactttgggaggctgacggcggggagggggggggggggggtggatcacgaggtcaggagttcaagaccagcctggccaacatgccgaaaccctgtctccactaaaaatacaaaaattagccaggtgcggtggcgggcgcctgtaatcccaactactcggaaggctgaggcaggagaatagcttgaacctgggaggcagaggtggcagtgagccaagatcgcgccactgcactctagcctgggcgacagatcgagactctctctcaacaacaacaacaacaaaaaaaacaaaacatctaaattcaatagggaaataatccagaatgatttataagtaatcttaaagctgtgatttaaagtagaaagcaaatggctaaggggagcaggaaagcctgagcccaaggccaaggctcagggtaagaaatgtggccaagggcgagggacttgccactccctccccactctcttcctggacccacagccacagccttcagaacccagcattctacctagaaggggtgggagttacttgttacagcacaaagaaaacctataaggtggccgggagaggtggctcacacctgtgatgctagcactttgggaggcccaggtgggtggatctcctgagctcaggagtttgagaccagcctcagcaacatggcgaaacctgtctctaccaaaaaaaatacaaaaaatttgctgtgcatggtggcacgtgcctgtggtccaagctactcgggggctgaagtgggaggatcgcttgagcctgggaggaagaggatgcagtgagctgaagactacaccactgcactccaaatggggtgacagtgagaccccagcttaaaaaaaaaaaatcacccgaccaaccaaccaaagaaacaacaaaaaagacaacctgcaagatagaagatagaaggcaccagatctattcctacggtcaaagtgactgctggaccagaccaggagtcgaatgaccaagttcaagagaattaccaatttactaaaaacttaaagtttttagaatactcttcttgaatactgttgatatatacatatgtattcttcaagaatacttacgacatttacaggttctaaggattagagggaaaaaaaggaacataaacaaaaatttacacaattttttgataacttggcaaattagttactggacagactgtctttttggtgacgtgaacctcagggccatctcaaagggttgtggaaaaggtaaaaggaagttagggtgatttgggctgtgcagagactgatgtagctcacaccgctccagaggaagtgaagtattatattcgcattactgctagctacgactgacctcacccagacccatgacctgtgctgtttactgagttgttgcttcttgcaggactactgcggtgtatttactcggttcttctaaaagtcacttcatttctcagaaatgcctgctatcctcattatacacttccagcaggcaggcagaggctgcaatgctggctgttagtaagtatgcagcacatcttgtgtagacaaaaaacaaaacaaaaaaaaccttctggctaggcctccactttacatgagtatctttgagatgatttatgcttccacctaggaggttttgctgaagaaaggattatactaatcagactctagaaaagatactgctggttaatgggaaacccatactggaaagtaagttaaatgaccttgactgaggccttgtaatatgtggggctacccctaataccaaaggactcgctactttctctcaatttatagtttcttctcatttgcaacacatcacgtatcattattttgtgcttaaattatgtttcccagctgatacttattgccaaaaccaacggggataagtttgaatagaagatttatacttagcggcatttgaaggccctgcatacatgttttctcagtgatcttcaagatacagatggagtcaatagatgtaaactcttaagaatacacaaacacttaaatcactaataattatagacaagggcttacttccaaaccttccccacgttttccagttcaattagtgagacacaattcataatcatagtgtaatttttctatagacactgttatggtaaagagatgacatgactattcacctgccgtctccacagaactctgtaaggactctctttagtcctaggatagagggaggtattagacaagcagtgattttacaatttctacttgtgcagtgaaaggagcttgtgtataatgttagggaacacaggcatttgtgcaaggaaaccaaaactaagaggagctcatcaaagacgacaacagagagagatcctggcgttcacgaagcttaaccctatgcagccagtttaagtcttgctccctcaatgatcacaatctagacaggggacagaaaattatgaaaatatgacaaacaaggttggggagtgggggaagattagtgaagccttctgaagtactaaagtggacatgaagaccaacaaagtaagtccactccacagtgggacagctggtcacaatgccaatggctcatggtgtcagtggacagtggctttcatgatctttattccacatcagaatcactagaccagctcatgtaaaaccacgagttccagcagaacacaaagaaccgcaagcccatgtatttaagaattatctgagttataattagagggaattaggtggaattgggaaattgagaaagaaaaaagctgaagtttcacaagttaagagtgactacaagacacagattctgcaccttcgtcctaagagattgtgaatcgggaggactgggtgaggcccaggaactgccagtcactcggatgcaggtggggccatggacaggtgctgagacacagcaatggaatgaacccctggacacagggggccctggagggcatcctagcacatggcttgccgctcaggtgctaccagtgtcactgccgcagctgtgatattctggcaggacacagaagaccactctcccatcctcccgtctacacagtcttccagccacaccacccttccattcagagacgtagatcagcagctgccgtgggccctgtccacaacctccactccaaaattctgaaactcagtcacaacaaatcgtaacatcactcatgagcaattttaaataagcagcactactgatgaatctcctgcatctcaactttaatggtgaagtctccataacgcagttcttaaaaaaaaaaaaaaatcacacctacgaactccacattagaaataactcttgcaggagaccacgtgggagaacctgaagatgaggcccctctggtcactgaatgttctcagtctaagacgtatcccacttctacacggcattttgtgaaaatgtcagaaagcccaatccaaagcttaagcaagacgtcaccaagaatcaggtgggttccacttccagaaggatcgcccttgaacttctcctcctcactcagctaaagtggcttcaacttcctgcatcacaccccaccctgtaagccgatggcccatcttccctccaaggccccctgaaatggttcctgctcaacccccaacttccactcacgccctgctcccttccctcatggtggcctttctggacttctaccagttcctacgcaagccagtgctgtcccaataccctggggtctctgtggcttcttctcaactttccaatcttgcctttaaatctccttcctcaatgtggccttctctgatggctccatctaaagaggtccctatgacaatctgaaccgctgagtgctacgcagacctcttggagcagtttgtaacgatttgttttccgtggccactacaccttccatttcacaaaagtggagtgagctctgtgtcactcccagttgccttctggggagccgactccagcacctgagcccacaaaaggctttcaacacatgtgacaaattaattgaatgatcatatccttcccttcctcaatgctacccagtgttggactcctatagaaactaggaggggagaggaacaagagctccctggcccaagaccacgtggctaaatcactccaggaaagagctgcagagggcaccaggtgatttggcactggagtcctgactgggattgtttgggacaccaaatttagttgggtaccccctaaagcatgacaataaatgcaaatatgtttgacacctcattttttcagtaaatagacctagatttctttgtaagtgtttgccctcagtatgcaaaagtctgtgggttttgaggccagatataattttcaaaattcaaaaagactacaaaacacatctgaggaactgcagacaaactgtgtaagcacgggctggtgaagcattcccggcaggctcagggctgcaaaaacatgacctcagaacataactgaagagtttcaggctttgcaaacaggaagctacatagctttgaacaacccaaactcctcagagtctcaacttgctcagctgtaaaatgggacctggaatgatgtctctcaagaggctattgcaggaatatgttaaaaattacctagaaagatgttggggagaccatgtgtgctggtaccccactttcccaccagcccctctggttcctaccactatgtggagcactgaaggctgttcctgggtcaggctgcctcacaaaggcacacgtgggcacagccccatctgatctgtgccctccagggtcagtggtgtcattcagtttacccccaacaggcatttgtggatctgtctcaaagtccacaggggttcttgtgagacagtggccaccaggcaaccaatgcagttcccatggacaaaaatgctttctcagtttaccctgagaagatcagagacagaccaagaaacaggaagagagggagagagaaagagagggggtggggagagaaggggagagggagggatgaaagaaggggggggcagcgggggagagagagaggcagagaggaaaagaagtggttctacttttgtcagatgtctggaagacaagcaaaaggatgagatgctgttgctactgcttctcctaattactctccagttctccagagcaggagtttttaactaggggcgactatgccctggagaacatatgttggtgccttgagccatttttgattatcatggcttagaggagaaggctgtaagcacccagtgggtagggccagggatgctgcccaacatcctctggggcacaaccggctcacagcagagaactgccatcagtgcagaggcagaggggagcctgccccagaccaaacggctccagccctgctgcaggtgaagggaatgagcagcctctttgcagtcccgggcagaaactgcccttgacaagcataccacatctgccaagttcagccctctggagcagcagtggaggcagcagaggggcccggagcacagattctgtcactaagttgtagataaaggagaggggatggggaagtggggctggagaatattttaaaagagaaaagggagcaaaatgttaggtcagggtttccctgactgtaaaacacaagaagtcttggaaaaagcaaatgctttcactatgaagccaaaatgtgctcctggttactgagcaggcataatcgatgacagctaaccccagagtccacactactgtcctttcggtgaggactggaaaaggaagcacaggagagaacgggatctgtgtggtgccagagcccagcattatgcaggtcagtaccgttccctgaacttgaggggctgacctagggtcctctgggctctgtttcaggttctggacctgcactatcaggaacaggacaatcctggcaacaaaaagttattggaaagaaagaagcatatcaaggaaagttacaaggggattatcagaagaaataaagaagtcctaagaactttaggttgttttcacagttttgagagcaagttttgttacttgtacatacccaaccaccttttttttttttgagacagagtcttgctctgccacccaggctagagtgcagtggcgcgatctccgctcactgcaacctccacctcccaggttcaagcgattctcttgcctcagcctcctgagtagctggaattacaggtgcccgccaccatgcccggctaatttttgtatttttagcagagacggggtttcatcatcttggccagcctggcctcgaactcctgacctagtgatccacccgcctcagcctcccaaagtgctggcattacaggtgtgagccaccacgcccggcctcaaccacctttttaaatggaggtaccatacagcagggagccagcacctgacaggacacctcattattcccatttcctgattttatcaaacaagtaaataaagagatctggctctctctgcttcccagcaacctcaaaacttctaagcactgtaagcaatgttaattacttagttttgagaaaagaccaaggttatgtaagatgcatcagaggaagctggatgaggtgaaagatatataggaattctctgtgctatctttacaacaaatacttcaaaataaaaagcataaaaaaccgaaagacaaaaagcaactttttctgaacataatcctctcactttcttgtgatcttcccaaatcactatggcagctgggaaggtcaggctctcagcaacaagcacagtggggagagatggctgcttgtggtcctcacccaccaccaagagcacaccagacatgcagcactgggggtgaacaagagaggctggacaaaagaacgcactacccctcagtgttttgaaataaaagagattctattatttggtggtgcaaaaggagatattttcccattaatatcttgattcatcaggttgagaagtgataaggataattcccattttatagatttcccatctataaaatcccttcaaacctcagggaggatgaagacacgtggaatcatctattgtgttggacgtaatatgcatctcatcaacagagtattgtctttggaagataaatgtccatcatctgacggtaatacaaatcaatgggcttctactgacatcatcaagccactaacaaacaggaagtgtaagaaaagccagtgtctctggttctcatgattctggagagaaaggtaaagtgattcgtgcacgtgaattctctccatcaacaaaaggagcctgggaagagcggctgaatcatcctcacctatctctcctgttgctagctcatcacagaaaatgttaaactcatttagagagctactcatgagaaatctgggttctcttcctatcacctactgacacacttttagttatagactttcactgtgagaatggtaaaaatccacagaccacagcacccaccggagagccataacactgagggccaagggtaacttaccatatttggcacgttggtgactgaagtattcttgatatctgtagggaaggtgggcaaactgttgaccatgctctgtttgctggctaactgggggttcactccagtggctcccattggctgccctccagcttgactaaagggctgtccaaatggacttgtgttcccagttattcccatctgaaacaaaaaagaggtaacatcagctgtggtgacgcagtcaatataaaaggaagggcctgggaaatgctcacacagtttcctatgaaatactcattgcaatgataaattcaaggttcattatcaggttcacatgctccaagcagaaggctcatgaagcagctcctagcagccactctctcctcaccctaaaccccatcccgcaagtagacgagctgtttccccccaccctcagccactctcctcactcaatccctcctgccccaacaatggcaccaacacccgaagaaagtcatttggaaaacaaaaccttccaaagctgctacccaaggggaattctttcagtttaatccttaattactctataggtatctagtttctgttaggttccccatcagatttgaactaagtttccattagttcaaaacacacagtggaaatattgcaatgaaatgatacaacacctgggatctcctttaaaatacacctgacccatgaccaacatgggtttgaactgcatgggtctacatatatggaaatatttttcaatctctcctgctcctcttcaaactcctcagcctctgccaaccaagagatcaagaccagcacctcctcatcctcctcaacgtgaagacaatgaggatgaagaccttgatgatgacccactttcacttaatgaatggtacatatattttcttttccttatggttttatttatttattttaatagagacagcatcttgctctgtcgcctaggctggagtgcagtggagctgtctcggctcactgccaacctctaccgcctgggttcaagcgattctcttgcctcagcctcctgagtagctggtactacaggcacgtgccaccaggtccggctaatttttttgtatttttagtagagacacggtttcatcatgctggccaggctgttctcaaactcctgacctcaggtgatccatccaccttggcctcccaaagtgctcggattacaggcatgagccaccgtgcccggccccttacggttttcctaataacgttttcttttctctagcttacttcactgtaaagatacagtatataacacataaaacatgaaatttgtgttaagcaaatgtgtatgctattggtaaggcttctgatcaacagcaggggattagtagtagttaaacttttatggagtcaaaaggttacaagcagattttcgactggcagggtcagcacccttaacccctgagttgcttaagggtcacctctaatccactgggcaggaggaggtggcaggaaaagggcatagatggagagagcctggtaaggtactgataatcactaaccaagcagtaggcgatgggtacagagaggttatagtatcctctctaccactgtacaggtgtaaaatttatgtatttatttatattttttgagagtgtgtcactctgtcacccaggctggagtgcagtggcgtgatctcggctcactgaaacctccctctcccaggttcaagcaattctcctgcctcagcctcctgagtagctgggattatgggctcgtgccatcacacccagctaatttttgtatttttagtagagacaaagtttcatcatgttggccaagctggtcttgaactcctgacctcaggtgatccgcccaccttggcctcccaatgtactgggattacaggtgtgagccactgcgcccggcctaaaattttccataataaagttttttataaaattaaagtgcactgaaatcaaatatatactagataaaggcaggaatgggaaagaggaaccctcagctatgcttccgtgagggcctgcaaccaactggaattccttccatcaacagatgtgggccaagttccctgatgacccccagctccagcctccacaggtcaattcaggaattgccatggcaatatcccagtgcttatctttctccctgtggagaaacaacgactaattaagaaactggatgcttgggctgcctgtctttgcttttttgcaaagctctaatattccaccttctgtctattgtgtgttctgtatttctggagtagtggtcagtttgatggactgggaaggtccccgcatagggaaaacctcccaggggtgagtttccagttaagaaatcatagctcagttctctccatcagcctcacctggtgactgccacgccagcatgtccactctgggtaacttaacattccttctatggacttcaaactcctcgcctgtaagatgagtgtcttgaacaagatggatcgtattatttctttcagctctaaaagtctaggctacaaacaaatcaacactcaacacaactggccctttctgctgaaatgcctgtacagaaacacaaataaaaaccaaaggagtataaccagaaagttctagctctgtgcatttcatacgcaggtgatttccttccccatgtagtcctcctaggtgacatttctcaccttttggaaagcaatcacattcttgtcaccactaggtgctctacttaagtgaactgagacactaattcttctgcaagtccacaaaccagactcaatttcgagttcaaatgacttaatctaggcaagatggtagctcgataaatattaagcacatttctgatttgcaagaagcttccttcaactgtcatctgaaacttaattgaagcaggaatttatattttcagaaaccactatactaaattaattccatggaacacttactactctcagaatttgtcttattacatataaccaaaccgctgaaacattgttcttagaagcctagaatttgaatacaacaacacgaacaacaacaaaaaatatagttttttttcccccagttcctaaatttctgacttcggacaaaatatgacagaacacccacactcattttccctcgatcaattcatcctcgaagtcaactggtattcaccaagtgcctggtatgagccaagcccagttctgaggctgcgtagatgcatttcccacttgtcacggagctcacaccttatgtcaaccaatttgacaaacaaacaaacaaaaaatcaacgtcttttggaagtttctaattaattaggcccagcattgacaaaccaaagtgggtgacagctgaaggggtggggaagggaacaggtaaccatcttccttccacaccaaatgcccaggcaccctggctccagagaagaggggacctaagtaccaagaggccagtgtgctctgtggacctcaaagttcacctgacttgcttcagaaagtttatttccaaaacttcccagatattttgacaattttcctaagatagccctgccagggtgagtatgagtgtgtgatcagatgggtaatacttgcctggcctggggcccttttctaactggtcaatgttgtttagtgtgtgtgtgtgtgtgtgtgtgtgtgtgtgtttgagacagagtctcgttctgtgtgtgtgtgtgtgtgtgtgtgtgtgtgtgtgtgtgtgtgtgtgtgtgtgtgtttgagacagagtctcgttctgttgcctaggctggaatgcagtggcatgatttcagctccctgcaacctccgcctcccagattcaagcaattctcgtgtctcagcctcccaagtagttgagttcacaggcatgcaccaccacacccagcaaatttttgtattttttagtagagacagggttttaccatgttggccacgctggcctcaaactcctggcctcaagtgatccatacacctcaagcctccccaggtgttgggattacaggtataagccaccacgcctggccataactggtcaatttcaaagggtaacccagtgtttggaagcgctctgacagatttcatcaaaaacgtgtttgtaccttttcttcttggccatcagataagagagtgaaggaaacagtctcaacaagtttttaccttgattctcacaaggtaaaaaagatggcaagtcaaagatcatgaacggtatgtaaggaacgtccagctcatagggatctacacaattctcaaaaataggggaaaaaattcccgtctttagcctatgataaaaacaaaacccaggctacatgcaggaggttagggttcaaatctctggcaccagggccagccccagcctctccttatcagagaaagttaataaccaggctaaagaggtcagctctctcacagggtatcactgctcattgcccaggcaaggctacctcctggtgccaaaccacctcctggcagaactcaagagccatgcactggtcctagcctgcagttatgaataaaaaccatttgcttctagagattctagatttctgaattcctagtatatatctattctccattaatcaaactgagcactgtggtcccccaccctaggctaacatatacttcttaggaccaatgcccaaaatgaaatactaaaatcaagatgtctaacgctaattaatgaaaatctacatttctttaaacgtcccaacaggtacttgataatagtttggtaggctgggtgctcatgcctgtaattccagcactttgggaggctaaggcaggcggatcacttaaggtcagcagttcgagaccagcctggccaacatggtgaaactccatctctactaaaaatacaaaaattagctaggcatggtggtgcgtgcgtataatcccacgatgagccagaataaactgcttgaacccgggaggcagaaaatgcagtgagctgagatcttgccactgcactccagcctggatgacagaggggagactccatctcaaaaaaaaaaaaaaaaaaaatttttttttttttttgtaaagctggctttattttcaatggaggttcatcaggatttggtttaatgctgctagagaacctctatataatcttttaaaaagttttttcatttttaattttgggaggtacatagtaggtatatatatttatgggttacatgagttttttttacaggcatgcactgtgtaataatcacacccaggttaaatggggtgtccgtcacctcaagcatttatcctttgtgttataaacaatccaattacagtctttcagttatttaaaaatgtagaattaaattatttttgaatagtcaccctgttgtgctagcaaatacaaagtcttattcattctttttttttgtattccatacactcttttaaataaaattaaaaaagcagaacagagaataggcaactgttcagttaatagtaaaatttatatattaacaaattaaaacccataaagtatttatattctgcctcattcaacaacagcccatacatattagaagtttcttttactctgttcttcctaacagaactcctttaagcatttaattcaagtttaatctcagaaaataggaaaagttaactatagtaagtacccaaaaaaagaacaagagcttccataatgaaactaaattaaacaatgcctcacagctctcccaggtttcccattaaaaagcattgtgaccaagcgtatcaatcaattaactgtttgagaacctacttctgttttctatcacttcactcagagagtaaaaatatgtaatgcatagtccctgtgtatgataagaaaaatattgaagccagatcctgaggtttccccaactccaaccactgcccccaagaaagaatgggggtgaaactggattagccttaacatgactgcagtgtgagctctgatgaggaaattcctctttaagttcagctcaaaacccaagaacaatacaaagaggcacctgcagcaaatcctggtgctgagcctagcccatccattaaatcctgtggctgcgggtctgaactgtctggcaagtaggtgagtgaccatgatcaacaaagaggagggaaaaggcagactgtgactgtccatctactccagcagacatgggtaccacggaaagtacaaagtaccacacggctctagaggattatctgtcacataaatgtttgtaataatctatcctgaacctgttttggtcacaaaactaggataaaacttctcaccttcctggaacattctctgcatcccctgcaacataccagggatgcagcggaaggacccaaatgaatgaacacgccaaagcaccaccatgccacgcagcccctaggaatagagccaggaaggaggtggtcaaagaaccacgaacaagtgaccaaagtcaaggcacaaagagggtcagcaatggctggagggggcatcggaagaggcagcaggaacagtgccctttctatcttcaaaacttccaaacaaggatctcagctaccagttggagtggacaggagtggacagctactttcccatgctgaaaagtcgggcagaacgagaacaggccttcggagttggttttcagaatggtgaaacgggtgtgtgtgatcacagcagatacacaagtccagtctggctataaaatgggtcctctgtgctacatctttgggccaggaaaaccctgactttggtacaaggccccactcatgcccttacccagagctttccacttgcacacagaattactgacccatcagcctccatggtcacttctggctgccaacagcctcctctgtttacctcagtgtgtgggacaaatactatcattttctacttgtaatgatatgacagctatcaaaacattagtaagaaaacaagctccaggctcagaaagaccagaaagattctctccactcactaaccaggagaatctctctactactcacctaactcccccttctctcaagtgagatctagtctcgtaaaaaagttagtaaatggaaatccaaaaactaattaagggtttaaggagagagaaaagtcaagtcaagtccttcaatatcatcagaaaaactcctgatattgaaaaggggtttagactgaaaggttatagaagaaatcatcaaaatagaagtatttccccagaacaggtttctacaatagtagcaagccaagcatccattttctggctcttctgtcgaaaaggtcagagaaacacgttctttgcaggccaaactccactggggggaggcaatgggccaggcagtccatgggggcaggggagggagcatttgggtgggcaccagttcacaattttgtgtgatgttcatttctgagggtcactctaagatctcctaaagattaagaatacctgtccttggaggaaggaaacttcctccatgcccctcattttcagggaagggcaagctggttcctcatctcacacaaccctgagccatgtatgggagcctttgcaaatagtccacttccagagacatcaaccactcataagaacaaccactccgacaaacaaactcccccagttttcatctccaaacgtcattttgaagtgcacactcacaagaaggggttgaccataaccacttatgagtatgcacctgagggggccaccatgtgaccaatggggggccggggaggaggacggccagaaatggcactgcgacgcagaacttgacctagagtcggccaggccatcagaaactctcagtgcaacaagtgccgagtttgatgtttaggttttcttttctttttttttttttttttttttgagatggagtctcactcttgttgcccaggctggagtgtagtggcaccgtcccagctcactgcaacctctgcctccctggttcaagcgattctcccgtctcagcctcctgagtagctgggactacaggcgcgtgccaccacgcctggctaatttttgtatttttagtagagatggggtttccccatctttactaaagaccacgttggccaggctggtctcaaactcctaacctcaagtgatccgcctgccttggcctcccaaagggctgggattacaggcgtgagccaccgcacctggccttaaggtggttccgaggagcccactaagtccatttttgcagcagctgactacttcagcagttttcctcacacctcaagacacgcctcaagccacaatacacagcagaccactcagaggaagtgggctttggggggtgtcactgatgctggtcaaaaacacacaaaaaggaaccaaaatatgatgttcagtaataagctttgcaaagacaagtggagaaataagactagctaaaacctaccactttataggtgaggaaggggccccccggaaagggcagggacacactaaatcagcctgagaactcagcagacgctccccacagcccccactagaggcttcacccttgcacgggggctcatcacctccccgcttaacgcaactctgtctccttcaagttcaccggcctcacgccagtagccgggacagagacaggatctgtctatgaaaacagggtggcaaagtgcggcctgtgggccaaaggcagcccaatgcctctttctgaaaaaaccaaatttttcttattggaacacagccacaaatacaatttcatccatagaggcaacatgccattgcggtcaactatgtgggctctggggatatctgaatggcgactccaccacttgctagggatttacttaaacctctctgcaccttggttttatcatctgtaaaatggagatcacagcacctcctctaagggttgcgtgagaactaaacaagttcctatatgcgaagcactaagatgagcagctgcgacagtgagtactaggggtgaggaggtgagagacagctttgggagcaatcattctacactacatatgatttctttcctgaccatgcttaaacagtaatgaaataaaggaatgctttacagagaacgtgtaatggtggagagtggttccaacatgtaggacgatagggagaggccggctgggattactggcatttggattatgggacattttcagaaaaacactgtgacaacaacaatcttgtgcatttgctatttgtagaaatactctgaaaaggccattattttctaattgtcctggtaaatcataagcgtttccagttttcattctacattgttttttagctttaagaacaataaactcagggtgtttatttcaaacttaaatcataagcaataatgacatatgattaaaataccctagcctaacattcttgggttaaaatttaaaccaaaacatagaagaactgaacatgaaagaacactcccacgaaaaaagaaatggatgcaactaccactcataagccagccacgacacagcaacaaacttccatttgatgtggcttcagcctaacctgacatatttttcaagctggagtttttttagcatctttctccacaagttggtatacatgtaaaaccacaaattcatataaggtgtaaaaaaacaacacagttcagtacatcaagagcaaaagtttgctaaataattgaatagccagaaatatttatcattttcaatgacataaagaaccagaaccaccccagactacggccagatcatttgtaaagccaaaagcattttctcttggcaacctaccattgttggaagaaagccaagaaaagcagttttcatggaaagacatgactgcattcagttgtctgctatcactcgcttgctcttggaatccttccagtatatcaacttggtaaatatagagtaaggagaaatacgccactgattacagtgccacagacagcacttggctgtccagggtgcacctggggcaggagagttgggctaaagcacctgggcaggtgaacagcccaccttccccctcaattgaagtcttatgtgctgccaacctggaatgcattcaggaaaatgtgcggcccccaggtctgaacatttgccctggaaggataagtcctaactggaagactagtaacaaagtatttagcaactctcactgtatttcatttggataatgtctttcaagaagcattccttgtcttcttgggttaagatcctcccaggcacgaggattgcttgaggccaggagtttgagaccaacctgggcaacgtagcaaaacccccttctctacaaaaaataattagccaggtgtgacggcgtgtgcttgtagtcccagctatttcggaggctgaggtgggaggactgctcgaacccaagaggttgaggatgtagtgatccataattgagccactgtgtacacacacacacagccacgaccagaatgtgacttagaagaagagtggaaatgcaggcctgtatcctcactgttagtcacccaactgctccagaaacttctagcagtgaaaccggcaccctaatactattggtacaccttggcaggtccctacagttagagacgctggttccccaaggtgcagtctgcattaatgcataagcaaaaacgacgggtcaaggtcactggagaaactatttctaatcctgtttctgcccctcatcagccatgtaactgggacaaacctcttggtccctcagttttccttatctataaaataggaagcatttagattatcattaggtgatctttaaagttctttctgattctaaaaatctgatgacattttttatttcaaaccatcagtgcttgattcacataaaggctacactcctgggagatgttgctactcgcagtgagtgacaactgagggttctgagtctgcagacttaactgtcaacccctggactgggaggccctcaccatggcaatcctccctgtggggcccagagtggatggccagcagcctttccaggagactggggagttcgtggagcaaggtcttccatccccactgcccagtgactgggattccatagccccgcaccctggacaccacttcccagagtattttacacaaagaacagctaatctgaggcaaaatgatccaagaaaagggagataaaatttgaaggcactgtttctcctaattcttttaagtcctaatatttttttttaggtagaagagtagactctcttcaggattaagtgcccctttcatgccaatccaagccaacttcacacgggcaatggaaaaagaggaaaaaagaagaaaaggtgataaaaaatgtgagaaaaattttattctataaagactgaatcttggctgggcgtggtggctcacgcctgtaatcccagcactttgaaaggccaaggcgggtggatcacctgaggtcaggagttggagacccgcctggccaatatggtgaaaccctgtctctactaaaaatacaaaaattagccaggcatggtggcacacacctgtagccccagctacaggtttaggcaggagaatcgcttaaggagaggcttaggcaggagaatcacttgaaccctgggagtaggaggttgcagtgagccaagattgcaccactgcactccagcctgggtaacacagcaagactctgtcacacacacacacaaaagagtgaatctttgtaaagacgaaattaatttacactgcaatccaactatggcccagcgggacagagggcctcaataagtcacctgacaaagccacccgatgttttccccagaccttccacatagagcgctcatgcaaggcagagaagcacctttttccacggatctacactccactcactcataaaaagggacgtcaagaacgcacagtaaaggaggcggcaataaaggaaggcgtgaatgtgtataggtaacgcaacggttcagagaaaaggagaaataaagatcggacagaactcacaaggctttaagacagacagccactgactatttctagtaaaatttaaaggagaaagaaagatgacatttcagaggactgtgttcctcctctactttggggcaggaaaacagaactaattcttgaactgggcaggccgtcagctctactgtgggagcaggaagaacagctcgtgggatgagccctgggaggtgacgtgaggctgcctgagggttctgtgtcatctcctcatggcgaatctcctggacctcagtggcaagaggaggactgcagcagccaaagaagatcttgcccagcttattaaatgccataaatctaaaagtgtaaagcacactcaaagatatattgttatcaaaaatatgtggctctacctcttaacaaaagctgaggtgtacagagtcctaacaaaaacataattagcaaagtaaagtgctcttaaatacagtcgtccctcctgactggtgatgtcagcgaggagacaaaacagggaagggtgctgagggagccaggagctggctcagtccgctgcagtctctgtgccttgtttcgagagaatacacaggaagcgcctagaaaagggagaggggtgaggtcaacataaggaaccgctggtaccacaaaggtgactctgattactgacagagaaaacgttccttctaagttacaaaattaaaaagaaaaaaaggacacaaatgtataatccccataaaacacacacctatacacagcaaggaggacagaacaccaaaatatttcatagtgatttctctggatggcttgtaagcaaatgttctttcttaatactttctattatgactcatattctctatacaaagcattattttaaggaggaaaagttgtttcttaaagtcgttctctactcaaacattctgagtgcccaaaatggcaagacgaccctgttaggctgcacaactctacttaaaacattaaactgtcattaaacactgaataaaactaggtagatcaaactgttggtgacagagattgccgctgagtggtaactgaaatcaaatttgccctggtcacaacgtggccgcgtaacctgtcaagctttgctcgaatgccttatacctgtggctagaagacatttcaaggagcctcagcacaggcccaccactctctgcagggagggcgggaggaaagaaaatagaaacaaacaaggtcgacacctactcaggacacaaaaagccaggcgtggctctaacagcttctgctttttctcctcagacatcccacgtttggctcttggtaccacaaaggtacaatgatccctgctgtttgaactctggttcaaagtttaggcagcaagggatgccccttcatcctgatctatctggcctgagcttcagggagcagcaagcaagagactggagcatgagggatggacctgaatgcatttagttcccaagtttccatggcaaggcacacttctagtcagacagttcctatcgagcagcagaccttcccagcaaggagaccactaggcagctatcacgttgccacccgcccctagctctcttcagcagtgatgctcttatctttaggacactggaagttgaaaaggctgtggcaacacacacacacacacacacacacacacacacacactcatctaggaacatgaagtgtgttaaagtctttcaggagggaggtactgtgcagtggtgacacacacagggccacgttctcccaagccaaaggtaagagacacaagccacaaggaaatcagacatgtgcggttaacaggtgccaccaacatcgactgctaaatggagtttcaaaagggagaggggtcctgactgggaggcaaacaagggggtcaagagctgggcctgcaaaggcgagctaaatggtaacagacacagttgaccgaggctacgcctctgcaacctcatcataaacaggaatggggaaaaacacctctgggatgggcctggatagccatgaatcttgcagtttcaaagtctatctctaatcaaataatctaaatgtccacaaaaaagtggtaggatgtgcagccacctggctgggggttaactgacagagctaaagtgttaattaaaatgaacacggaaactggaaagctcaggagagagctggttattcatactgatggttagtcacagaaggcaagcactgtctcagaagagcatcactcataacatcgacagacaggaacaaacgctgctctgatctctgcattcaaatcctgatggactcaagtcaagagtgatggcctcccacctctggccactcccatccccacacgcctttgcctcaccgagcccacacgcggcggcagcagcacgcctaggctgaaccatacccggtcaacttggagactacaactgccaagcaggccggtgcttcccgttctactgtaactctctaagcaaaatgtgccaggtttttaggggagaaaacacactcagtcccctccttgcactgtccccaatctctacgcctcaatcactccctgtgcctcaacagtgtgcccactcatcgctgatatatacactcctgtttgccattcacgcagggccgctctaacttgtggtttctggtttaaatgggatagcacatgggaaaatgctctgaaaactacaaagcactgtgcaatcttgaggtggctctaagatctctttgcaaaaatagagcacagaaaatctctaacatgagacaggattctataaaatgaacagactttctacagtacttaaaacaggcatgcatccttactacaataatttaaagtcaataactgcaagacaatgtctaaagttggcatttctcagtattatctatctcttgctttgttctaggaagagtttcaggtggcttgttttccagttcattcttcattacttggtagaaaaacatgaaatgaataatatgactcactgctaagggcattaagtttttacttagtaaataaaaatgcaatccctgcaatcacactacttcagaccatgcgccattttttgaaagccacaaaccacagtgccacattcttatccaaaaatatgtaataattacacagatgtatatctatggaagtatggccttggaattgcaattagttgataagcatttatacttgctggcaagaaaatgtcactgacattcagttcccagctctaagtggagggctctggacactttgcctcagtagagcactcagaaaaggggttcagtcctcttctgacaaaaaaaaaagaaaatgagatctacatcacagttagaaggcattttttatcaagtaatcaaagatgattaaagatgctggggggaaacctaatttgtgagtaactttgcctttattttaaaaattactaagacaaaatctcttgtttctgagattcagccacaccatttgaacctcttataagagacaaagttttcattaaaatgtcattgtgtatcttcaaaagcatagagaaaactgtaacggaaaaaaatacaaggaagaattcataatcatatgaacaggttagaataaatgaatcaaatctttatgtatgaattttaatactgttcttaaaaaagcaagatgaggccaggcatggtggctcatgcctgtaatcccagcactttgggagcctgaggcaggtggattgcttgagctcaggagtttgagactggcctaggccacatggcaaatctccatctctacaaaaaacagccgggtgcagtggcatgagcctgtagtcccagctcctcaggaggctggggtaggaggactgcttgtgccccagaggcaaaggctgcagtgagccaagataacatcactgcactccagcctgggtgacagagccagacccagtctcggcgggcggggagcaagatgaatacatatcatgtaaaagacactttcatttatcctgttaaaattgatttcatttagtaaaaaactatgaagagacagatctcccacactgaagaagtctaaataaattatgtagacactttgcctaaagaaggtagaatataaaccccctatccttaaacatagtgagtccttccaaagaggatggcatggaggagggaagcggagcattacagtggagaaacctgagaggcacgacctcaaccaggtggctgtgggcagcatcaaccatagtggtaaagtcaccatgacacaacgcaccctcaaagtgacgtggtaaaaatggcccttggctgctgagatcttcctttcaaaagcccataagcccagtcttaccatgagaaaaacatcagacaaatctgtacagaggggcatcctataatacacctgactcgttctcctcaaaactgtcaaggtcattaaaaaccaaggaaaggctgagaaaacgtcacaatcaagaggcgcctaaggagacaggacgattaaaagtaatggggtatcatggatggtattccacaacagaaggacattagggaaaattaaaggaaatttgattaaagtatggacttcagttaatcacaagtatcagtattggttcattacttatgacaaacacaacacaggaaaggtaagaggctaacaataggaagtgcgtggatggtggggaggagataaagaaccctgttgtactatcttttaatttttctgtaaatctaaaactgttctcaacatagagtctactcagtcagttgcaccgcctgtagtttcatctactgagaaagttgaggcttgaggatcgcttaaacccaggaattcaaggctgtagtacactataattgagcctgtgaacggccactgcttgggcaacataatagcaagatctatctctctaaaaaaaatttaagtctacttaaaaaatgaaaagaaaaaaaaaaactatgaaggaaatgtgataagtatcaacaggcattaattctaatgaaaacacagatgttggttatactatcctttgttcttgtgttgaaaatttaaaaaactcagaacataaaaatcaaacctttccttgctaccataatgtaagaaaaatatttttcaaaaagtgatcttgcttactttttattttattgattgattgactgagacagagtctcactctgttgcccaggctggagtgcagtgacgcaatctcggctcactgcaacctcccccttccaggttcacgagattcttctgcctcagactcccgagtagctgggactacaggcgcccgccaccacgcccggctaattttttatatttttagtggagacggggtttcacctagttagctaggatagtctcgatctcctgacctcgtgatccacccacctcagcctcccaaagtgctgggattacaggcataagccaccatgcctggctacttactttttatttttttagagacagggtctctctgtagcccaagctggagtacagtgatacaacaatggctgactacagccccggcctcctgagctcaagtgatcttcctacctcagcctcctgagtagctgggactataggcacgtgccaccacacccagctaatttttaaaatgttttgtagagatggagtctcactgtgttgcccacactggtctcaacctccttggctcaagcaatcctcctgcctcaacctcccaaagtgttgggattgcaggtgtgaaccactgcacctggccaagatcactttaaaaaataatgtttaagaaaattaattatgctggcctcttgcacataggccaaggcacatttttctagccagaaaagctgacttcttttttttttgttttgtttttgagacagagtctctcgctctgtcacccaggctagagtgcagtggcgcaacctcggctcaccgcaacctctgcctcctgggttcaagctactctcctgcctcagcctcccgagtagctgagattacaggcatgtgccaccatgcccagctaattttgtattttgagtagagatgaggtttctccatgttggtcaggctggtctcgaactcacgacgtcaggtgatccacccgcctcggcctcccaaagtactgggattacaagcgtgagccaccatgcccgtcgaaagctgacttctttatgggtcttacaaaaattgcttggctgaattagtatttcagattaagagccataacccaatcagaccacaggcaaagcttacagcatacaagggtatgtttctaaaaaggaataagcagtaaattctttcatttgacaaaaatactcctgggaaattagactcactctccaggttacctgttctataaatttcgtgcatgggggaaaacctgacccacacacagaaaataaggtcttatgtatttcaccatcatagtttgaatacagctgtattacagacaaaatgatgcagtcgaaaaaaatacaggcttggagtcaatcacaggtggattttaagtaaaattctaccactttcaaacatgtgtcgtcttgaataattttctgcataggcaggaaagtggttcagaatattttactccttgttataaaagacatatggcacccacctcacaggattattaaaaatgagaaaaagcaagatcatgtttgcaaagcacccagcacagtgcccagtacaataggcatgtccttttctgctcttcctcttactgttattcaggaagaataaatatagtaattgttatccttgctcatacctggatcacactgaaattttatgctatagtcatatacataattttgaaaaatgcaaaaaaaaaaaaattacatggtaatcaacataaaaacccttagatattttaacttggtgacagatggacagcaaattactgtctatggtaatttgtataaatataactctttttaaaatatagcaaaaatattttggaaaagttggtccttgaagttatgatttggacccatttacattaagaatgttagatgtggcacttcccaagtttctacagtgaacttaatcctcagacgattcagaagatgagagataacgtttaaagtgtgaaatacacagtcactacgggacaaccattatatatcataatgttacgttcacaccattaaaatggagagtatctcccagtgcgaccacacacaacaatcacatcaccaacacctcctagggcttactggagctgtaactaagtgtgcaggactacgaaggaattgtgaattgaacagattccagaggtggcacagtgctagagacatagaagttctgatcagtcggagtttcaagatcttgctgaacatcccaggaattaaactgagaccccaaggccatgtctaaggaacagggcttcaagacctgccctaagttaagtttaaaaacaagctttgagagaatcaaactgatctgagtaattaagagcctgccagaacaaaacaaactaataaaggacaataaaacccatattcaacaacattatcatccaccatttccactacacagtctaaaagtactggacatgccaaggagcaggaagatgtgacccataaccaggaattctatatttaaacaaacaagactgtaaatgaaacagatacagagatgacagagatgttggaatttgcctctacaagaagagcaggaagggagaaaaaaaggaacaaaacacagaagcagcaaacagaaaacaaataagatgagaaacctaaacccaacaattatcaacattaaatataaataaactaaacactacaattaaaagactaaggttatcagaataaattaaataagatctaatgctacgctgcttacaagagacatacttaagagacaaagttaagagtgggctgggtgtggtgactcatgcctgtaatcccagcactttgggaggtcgaggtgggcagatcgcttgagctcaggagtttgagaccagcctgggaaacatggtgaaaccctgtctctactaaaaatacaaaaaaatagccagacgtggtagtgtgtgcctgtggttccagctactcaggaggctgaggtgggaggatcacctcacccggggtggggggcagaggttgcagggagcccagactgcgccactggactgcagcttaggtgagagtgacatcctgtatcaaaacaaaacaaaacaaaaagagtgaaaaaaaaatgtgaatgctaatcataaggagtctacattaaatatgagaaaaaggagataaagacaaagaatattaacaaaaacaaatatttcataatgataaaaggctaaatttaccagaggcattacaatccaaaatacatattaacctaataaaacagtttcaaaacacatgaaacaagtacttacattttgttctgactaaatgaaaaaccagacaaacctaaaattgtaattgtagattttaataatcctctcttagtaaccaatagaacaaaaaaatcataaggatttgaacaccatcaaccaacttattctaatagacaattatgaaacatcacatcccacaactgtaggatacacattctatttttatgagacagagtcttgctccgtacccaggctgaagtgcagtggcgcgatctcagctcactgtaacctctacctcctggggtgaagcgatttttgtatctcagccccctcaagcagctgcaactacagaagcgcaccaccaagcctggctattaattttttttgtacctttagtagagacaggtttcaccacgttggccaggctggtctaaaactcaagtgatctgtccgccttggcctcccaaagtgctgggattacaggcatgagacactgcgcctgatcattcttttcaagtatagatagaatatttgtcaagaaaaaccatttgctgggccgtaagacaagtcttcaatttcaaaggacaaccaccatacaaagcatgttttctgaacacagtggagttaaaaaccaacaataaaatatctgcaaaattcctaaatatttaaaagctaaacacacttcagcataatccatgggtcaaagaataaatcacatgtaaaatataaacatattttaaactaatttaaaaaatgtattaaaatttgagatgcaattaacaacagtatttggggtacttttttatgtttatggatttaaaggattcaaagaaatggggaaataaaaaagatgcatagggtttaaggagaaatttattgcccaaatgttaatattggaaaagtctaaataaccagtgatacaaacttctaccccaaagaaaagccaacataagcagaagaaaataaagacagaaataaatgacatagaaaacaaacaagaaaaggctgacaacaacaaaagctggctgtttgaaaatattaataaaatggacaaaccccaacctagatcaatgagagaaaaacaagagagcacaccagacattattataaattctatccaaattaagaaaagagtacagaggccgggcatggtggctcacacctataatcccagcactttgggaggctgaggcaggcggatcacttgaggtcaggagttcgacaccagcctggccaacatggcaaaacccctcctctactaaaaatacgaaacttagccaggcatggtggtgtgcgcctgtaagcacagctacttgggaggctgacgtgggagaactgtttgaacccaggacgtggaggctgcagtgaactgagatgatgccactgtactccagcctgggcaacggagtgagactctgactcagttaaaaaaaaaagaaagaaaaaaaagaaaagagtagagaaatgttatgaacaccttcatgccaaatcaattcaagaacttaaaatggatatattactcaaaaatacaaattaccaaaattagcacaagaagcagaaaatttgaatagctaatacctattagctattcaaatttaaagtaactgaatcataattttaaaaccttcccacaaggaaaactccagacctggatcgcttcactggtgaattttatcaaacatttaatgaataaataatactaatcttaaatgaactttcagaacaaagggaacaattcccaggtaacttcatgaagccagtatattattgttatcaaaaacaaataagaacactccaaaaaaacagaaagttatagacccatatcactcatgaatataccaatcatgcttcgcccaaagacaaggacatcttctgagaaaagtgtcattaggtgattctggtcactgtgggaacttacactttgggtgtacttaaacaaacctagatggtgtagcctactacacacctaggctgtatggtatagcccactgcttccaggctacaaacctgtacagcttgttactgtgctgaatactggaggcaactgtaacaaaattgtaagtatttgtgtatctaaacatagaaaaggcacagtaaaaatatattatagtcttaaggggccactgttgtatatgtagtctgctgctgaccaaaattcgttatgtagcacattactgtggaagcataaatcctgaacaatattttaataaatctgatccagtaacatataaaaaagataacactccacaatcaagtggggttatctcacaggaatgcaaggctggttcaacactcagaaagacgtaattcacattcaaagaaaaaaaaaacaccctatgattcatctcaataaatgaaaaaagatgtggcaaaattcagtaatcgcttatgatcaaaagactcagcaaactagaaacagaattcctcatcctaatgaatgatacctaaagcctacaactaacattatacttaacgaaaggctgaatgcttttttcccacagatcatgaataagacaagggaagaacactgtcattggttttattaaacattgtgctggccaggcacggtggctcacacctataatcccagcactttgggaggctgagatgggcggaccacctgaggtgaggagttcgagaccagcctgaccaacatggtgaaaccccgtatctactaaaaatacaaaattagctgggtgtggtggcgcaagcctgtagtcccagttactcaggaggctgaggcacgagaatcgcttgagccccagaggtggaggttgcagtgaggcgagatagcaccactgcacttcagcttgggctacagagtgagagtccatctcaaaagaaacccaaaacaaacaaacaaaacattgtactagaggtcctaggcagaacattaaagccagaaaaatgaataaaatgcatacagatgaaaaaggaagaagcaagctatttttattctcagacaacatgtcccagaaaattctaagacatcttatagaattaataagtgagtttagcagggttacaagatacaacattaatacagaaacatttattatacttctccatactagcaacaaataatggtgtaaaacctaggaattaaacagaaatgaaaacgagaaactaagcaacctgactttaatacttactgtaaagctaaagtacaactatgaaagtttcatctatgaaacttttgtgattgataaaattgacttcattaaaattaaaactgccccttcaaagataatgtcaagagaatgagaagacaatccacagactgggagaaaatatgtgcaagaaacacatctgataaagatctatttacaaaaatatataaagaactctcaaaactcaacaataacaacctgtttaaaaaatgggccaaagaccttaacatacacctcatcaaagaagacacacagatggcaaataagcgtatgaaaagatgacccacatcttatcacagaaatgcaaatgacaacaatgggataccactatttgcctattagaacagccaaatccagaacactgtcaacacgaaatgctggcgaggatgtagtgcaacaggaactctcattcatcactggtgggaatgtaaaatgatatagacactttggaagacatttttgcagtttctcacaaaactaagcatactcttaccatatgatccagcaattgtgctcactggtatttacccaaaacaggtaaaaacttaaacctgcacatggatgtatatggcagctttattcataattgccaaaacttggaagcaaccatgaagtctttcagtaggtaaagggataattgccatgaaaagacccagaggaaccttaaatacatattattaaatgaatgaggccaatgagaaaaggctacacactgtgtgactgtaactttacaaaaaggcaaaactatggagacaatcagtggttgccagggttttgggaaggagagagggatgaagaggtgaaacacagacggcttttagggcagtgaaaatactctgcatgacactacaatgatgcacatcattatacatttgtccaagtccacagaatgtacaacaccaagagtgaaccctagtgtaaactacagacttcggattatgatgtatcaatataggtttattgattgtgacaaactgtaccattctagacagcggagttggggaggatgttgaaaatggaggagactatgaactaggagaacagggaatagatggaaaatctctgtaccttcatttcattgtgaagctcaaactactctaaaaaaacccaaaatctttaaaagcttttcttgggccaggcgcagtggctcacgcctgtaatcccagcactttgggaggccgaggcgggcggatcacgaggtcacgagatcgagaccatcctggctaacacggtgaaaccccgtctctagtaaaaatacaaaaaattggccgggcatggtggcaggcgcctgtagttccagctactaagggaggctgaggcaggagaatggcatgaacccgggaggtggaggttgcagtgagccgagaccacgccactgcactccggcctgggcaaaagagcgagactccttctccaaaacaaaacaaaacaaacaaacaaaaaagcttttcttaaaaaacaaactaaatgaatagaaaaatagatcaatagaacagactagaacaaaggtacagggattttttttttctatgaagggccagttaataaataatttagtctttgcagatgacctgcggtttccatcccagattgttttctttttaaacaatccttaaaaaatataaaacccatccttacgtggcaagccatataaaaacaggtcatggggctggatgtggttcatgggctatagtttgcccttagactacagagtccagaaacagacacctccttgtacagtgaatttcgttgctagttatttatctaagagaaatgaaaacttctatgcccacaaaaaaagctgtacaaaaatgctcacagaagatttcttctttttttttttttttttttttgagacggagtcttgctctgtcgcctaggctggagtgcagtagtgggatctcgggtcactgcaagctccgcctcccaggttcacgccattctcctgcctcagcctcccgagtagctgggactacaggcgcctggcaccacacctggctgattttttgtatttttagtagagatgggggtttcaccacgttagccaggatggtctcgatctcctgaccttgtgatccacccgccttggcctcccaaagtgctgggattacaggtgtgagccaccgcgcccggcagaagatttattcttaatagcttcaaactggaaacaaccccaatgtccattaatgggagaacggacaagcaaattatgctctagtcacaaaacagaataccatttagcaataaaaaagaactagttcatgccaacaacgtggatgaatctcagaaaacaagttgtgagcaaaagaagccttataaaaaagcacatactataagtcatcacactacatgattccattacgtgaggtctgagaacaggcaaagcaattcatggttacagaaattagcagctgggcgcggtggctcacacctgtaatcccaacactttgggaggctgaggtgggcggatcactaggtcaggagtttgagaccagcctggccaacatggtgaaaccctatctctaccaaaaagaaaaaagccagctgggcatggtggtgcacacctgtagtcccagctactcgggaggctgaggtaggagaatcgcttgaacccatgaggtggaggttgcagtgagccgagattgcgccagtacactccagcctgggtgacagagcgagactgtgtctcaaaaaaaaaaaaaaaagaaaaaaaagaaaaaaaagaaattagcagtaattgtcgggggatgagtggggacagaaaaagggaggcatacaaaggaactttctgggctaagagaaatgtcctgaatcttgataggggtgtgggttacatgggtaaagggttttgacaaatataagatctgtgcatttcatgctatataaattacaactccaaaaataatcaaagtaaaataataaaaatattttaaaaatataggtaggtctttaactccaaatcttaatagctacctttagttgataaagcaacgaagataatggtttttcgtacaagaacagtcatgtgttgcataacaacatttcagtaaactacagacctcatacacagtggtcccagaagattaccatggaactgaaaaattccaatggcctagtgacgtagtagctgttgaaactgtcatagcataaggcattactcaggtgtctgtgatgctgctggtgtaaacaaatcaatgcactaccagctgtataaaagcatggctcaattatgtatagtacataatagccgataatgataataaatgactatgttactggtttatgtatttactacacttattagagtataatccttctactttttcttaagttaactgtaaaacagcctcaaggcaggtccttcaggcggtattccagaaggcagcattgtcattataggagatgacagtctcccatacatgttactgcttctgaagacctttcagtgggacaagatgtggaggagaaaaacagtgatattcatgatcctgaccctgtacaggcttaggctagtgtgtgtgtgtctgtgtgtatgtgtgtacatttatgttttagcttttaacaaaaaagtttaaaaaattaaagaactggccgggcgcggtggctcacacctgtaatcccagcacttcgggaggccgaggcgggcagactgcctgagctcaagagtttacgaccagcctgggcaacatggtaaaacctcgtctctactgaaatacagaaaatcaggtgggcgtggcggcatgcacctgtagtcccagctactcgggaggctgaggcaggagaattgcttgaacccgggaggcggaggttgcagtgagcagagattgcaccactgcactccagcctgggatacacagcaagactgtctcaaaaaaaataataataataataaataaataaataataaaaaattttaaaatagaaaaagcttatagaataagtacaaatacgtttgtacacctgtacaatgtgtttagtgttttaagctaagtgttaatacaaaagaataaaaaagtttttaaaaaactgaagtttataaagtgaaaagttacagtaagctaatttattactgaaatttaaaaataaataaatttagcatggcctaagtatatagtgtttataaagtctatagcagtgtacagcaacgttctcagctgtcacattcactcaccactcattcactcatccacagcaacttccagtcctgcaaacaccattcatagtaaatgccttatacaggtgtgttttacacacacacccgcccacccctgccacacacaccaggatctatgctgcccaggctgttctccaactcacaggctcaagtgatcctccggcctcaccctcctaaagtgctgggattgcaggcatgggactgagtgtctggtcaggtgtactattttaaatcttttatacagtattttctactataccatttctatgtatagaaatgtttaggtttataaacacttagcattgtggcaccgtgttacaactgcccaagtatgcattacagtaacatgatgtacagatttatagtccaggagcaacagggtacactatatagcctaggtgtgtaacaggctatgccatctaggtttgcataactactctatgatgttcctagcataacataatcacttaatgatgcatttcacccccatcaagtgacacatgcctaagttactcttcaagatggtcccctgggagacatgtcaaatgaaaatcttcattgttgttattatgctaaacattcattccgtttgtgttacagaaaataatcagccaaaaagttaactggaaatactactccaactttgactttaaaaaagatacataattatagataaaagactggtagagaaaacatcaggagtatgttttctttagcgctaagtatgactggatgataggcttacaggcaagattttcttttctagacatttctgtgctaattttgtataacaaacatcaactttttaaaagttgatataggattttgatctgttgcccgggctggtgtcaaattcctggcctaaagcaatcctcccacctccgcctcccaagtagctgggatcacaagaatgagccaccaagctcaacagctactttcactaccaaaaaatgttttcggaaaacattagaaaagcagtctcattatcacttcaaatgttgtgtggctatctcaaatattttatgtggcacagcacctcgctagttcactactcaatattctctggaaggttttcagtaaacctatgcatatactaagaatgttacatacaccatctcatttaattggcatgcgattctgtaagatagagattattatccatttttaattgatagaacaattctcaatggcagctactattatcctcatttaaaagccaaaaaaactaaaacccagagagattaaataagtttcccatagctaataattagtgaaccctggatgtgaactgagtcagcttattccagagcccacgccaggcttgaaagcaattagccactacatctgcagaaggcagtctgagctgccgctattactactgctgctgcagtaagtacactaactactatgtgcgtgtcaatccatttaatatacatatgcaatctcattaaattaaaaagtttaaaaaagaaattcataaggctgggtgaggtggctcatgtctgtaatcccagcactttgggaggctgaggcaggcggatcacctgaggtcaggagttcaacactagcctggccaacatggtgaaaccctgtctctactgaaaatacaaaaaattagctgggcatgctggcgcatgcctgtaatcccagctactcaggaggctgaggcaggaaaattgctggaacccaagaggcagaggttgcagtgagccgagatcacgccattgcactcccacctagacaacaagagtgaaactatggggaaagaaagaaagaaaaaggaaggaagggaaggggaggggagggggagggggagggaagggagggaaggaaaggaagggaggaaagggaaggaagggaaggaaggaaggaaaaggaaaggaatggaaaagaaagaaaggaaagaaagaaagagaaggaaagagagagaggaagagtgagagaaagaaagagaaaagaaaagaaaagaaaaaagaaattcatgattaattatcatgggaaggtaggtacatcctgaatcatacattctataggacacctatgatcatctctcattagagtcataataagatccctgagccagtcctaggctacttaacatgtctactaaacagctgtgcccacaggaattatatacatcccacattaccctgtattaattcatggcactacatagtttcattctacaaactatttttgttgtgatcttttaagaggccaaattaagatatgcttaatataaaattcccttatttctttgtgttaagaatcagatgacttcacgtgaaaaagtgaaaagcaacagacaaatgtacagtattatttctcttgctattaaatattagaaattccagccaggcatgatagtttcacacttgtaatcccagcactttgggcagccaagacggcagtcggcttgagttcagttcaagaccagcccaggcaacatagcaacaccatgtctgcattaaaaaggaaagaaaaagatggttggagttcgggttttcaggctctttctggtctaccttgtggcaatttgagagtccagcaacagtttctgctgggtttcaaagatccaggagaagctcagtgttgtgttgagacacaatggacccatcacaaaagtttaatccaaccctggtcccagtcttcaaaaatgctcactgaagaaaattcccaggacgattcaggggcctctcaaaacttctgctctgagatgttgataaagaaccttagtaacttgactatcaaccctagtaccaaattctcttcccctctaccagaaggctcaccccaacaacagtatacgggagcaatgatcctcagggaaatcagagatgacttgctttacaggagaagatttaagaacactcctgtctatgcagaaagaaaggatggcaaaattgagatacctgttactcggcagagttcctagacttgaacgagaactaacaaacactgggcttaagggagttcagaatgaatcaagaagtggacatttcagatgctgctgcagtttctgcatgtgtaacagatggggtacttttgagagtgctagaatagggaattacaacactgagccacttcagccataaaccttattcttgtacttttttttcttgctggtaattttatgtagcaggttgagaaagctaccttatgctacaatagactatatatcaaaaattttgataatgagttctaggatgtatttttcttgtatcttttcctttctaccatgatactagtgatgtataaggggtctgtgtagtttgaacgtatctgaataacttcagtatacttcagctctactgcttaatttgactcgaagccaagaggacataagcatccccatgtgttttagaagcccaaagccagtgagatgaaacccaacaccgagaatttgaagcaaagtcacttgtgggtaaagaaagcattgggtagtttggctacagcgtaataataagaaaaatttgggttgcaataagaggaaactttgtgctctttttacaatttttagtacaaataaaggtgtatataagagaatcaattttttaaaaaaaatcaaaaaaattagccaggcatgatggtgcacacctatagtaccagctacttaggaggctgagactggagcactgcttgagcccaggagttcgaggctgcagggagccatgataacgccactgtactctagcctgggtgacagagtgaggccttgtctcaaaataaataaataatattagagatttccaataatctacccaaaatagagaaggtagattagtcatttcttagccaacttggttctattaattctttactgactatattctgctaatccattcctttagagcacagattctcagagtgtggtccctgaccaccacaattacggtcaccggtgagctggttagaaatgtaaattctcaggtcccaaccaaaatctgctgaatcagaaacttggtaagttggaggcagaaatctgtcttgacaagcctgcagtgactctgctgaatattcaagtttgggaatcactgctttatagtatctgaccaaaatgatggctgactgagtactgggagctgatctaatttaaaacttttactccaggaacacctccagtcaaaaatcaaccccggggttttctgaccactttctaaaaaagacgaatattccaaaaactttattcaaaaaataagccctaatctgaccccctatgaagatggattaccatacaaactattttggtcacgtttcagatttgttagttaaaagaaagtacttaaaagatttctaaggtcacaaaaacaaattcttatcaaccttaaaatcagaatgcctccggaccccttgacccgaaattacaccttcctctttctaccagcttctggcttccttctgtcatctctgtgtcaagcaacatctctcaacacccgtagccaggaaagagagtgtctgtacggcttctaaatcctacctaaattggtcttttttgctttctttctagaggacaagtgtatgagttattttcagtagaaaacaagaacatgctcccctcataagacgaaatgttaagttttgctactgttgaaataaagaaattgttttttctttaaaaaactcttatcatgccttctatcacaaaagtaaacaaaagaaaaaaatagtaatatcatgtattgttaatattgccatgttgtcaacaagggtcatgtttttcctactgtaaatattttcagagtcacataaaattagaaatgagatggcagtgcacggtggctcatgcctgtaacctcagcactttgggaggctgaggtgggcagatcacctgaggtcaggagttcaaaaccagcctggccaacatggtgaaaccccgtctctactaaaaatacaaaaaattagccgggcgtggtggcgggcgcctgtaatcccagatactcaggaggctgaggcaggagaatcgcttgaacctgggaggcaggggttgcagtgagctgagatcatgccactgcattccagcctaggcaaaaagagcgaaactcccatctcaaaaaaaaaaaaaaaaaaaaaaaaaaaattaggaatgagaagagaaataatcacaaacatcaaaaatgacaaagaactgcacacatttttgcacagctttaagttaacaaattttaaagattagatgaaaagaattttctactaaaacagaaactgtaaaacttacgaaagaacaggctgcattgcattagtgttaacaggcctctggccagaccgtgtggatgcaagcctggttctgccactcactggcagcctccacttcttaatctgtaacatgtgacttgcctacctcctatcctttttttaaacaaagattaaaagttaagtatcttttagtttttctcaaaatcaaagcaaatttagactttactaaataaaaacgatactgacctaagagactactaaaagcctaaaagagccaatatttatagaaaatagcaataaagttgtcaaagattttttttttttttttgagtcagaatctcactctgttggtatgcttgattgtagtggtgtgatcatggctcactgcaactttgcactcctgggctcaagcaatccacctgcttcagcctcctgagtagctgagaccacagacatgtgccaccatgaccagctaattcttaaattttttttaaagatagggtctccctatgttcacaggctggtcttgaactcctgggctcaagcaatcctcccacctcagcctcctaaagtgttggaattacaggtgtgagccaccacgcccggcactattgtcaaagatcttcagtcacttcctagggaaaaaaaggcttcaggcccacatcactgtaagggtgaagtctctcaattcttcatgtaatagataattccaaatcgatttaaactgtttcacagaataaatatgaaagactttcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagactttcaaactctttttgaccaagttaacgtaacactgatataaaaattgacaaagcacaaaaagagctatggatcaatttcatcactgataaatgagaaacaaaattctaaatgaagcactagcaattaaaactcagcattaacttttgattttacaattacagagatggttcaatttgatattataaaacctacacagataatctgtcacataaataaatggaaagtgaaaaatcacaggttaatcaacataggtaggtatcaaaaagaaatttgataaaacctaacatttagatattatcatttattttatgacgaacagattatgccccaattttaaaagaaatatactactgactacaaaccaaagctcacattattcttaataacagaacactaaatacacttccatttaagtaggatacgagacagggatgcctaagagcataaacactggcaaaaaatattggcaaggagaaaataaaagtatcaataatgcaaaagatgactatctccttggaaaactcaagagaatctcctgaaaacgtattagaataattaagataaccccataaagcagccagattaccagagtagcgtatacataacatctttcctatattaaaatagccagttagataatgaaatataactcatcaccaacagcaacaaaaaccacgtaatacctccagaaataaacttagtaagaaagatttattacacagataaagaaaaccatactatgcttccaagcaacataagacccccagaaaagataatttatatgtataagaagactcaggaagtcacaaaactgttaaaatgtcacatccctcctaaaatgacttataaagttgtagtgaatcttataaatccaaaatcccaaagattttttgtttttaaaatttgaaaaaaagtcctaaatttatctaacacagtggggttctcaaccctggctgccatgaaagtcatctgaggaactacacactatacgaatgtttctaccatatcccccagattctaactcaattgctctgtagtggggttcaggcatcatatttttaaaaattctccagataaatctgataaagtgtagacagagttgagaaccacctgtgtgagaaataactagtgaggtcatatactaaaagtcatcacacagctaggttaataggtttctggcacaggaacaagcaaaggtcaatggaactaaagaaaaagagttcagaaattagacccaaatcctatatgtttgaaaagagaataaagtgtataccaaaaacagcatatcgtatcagtgggagaaaagatggattaccaatactaaataaatggtactaagatgattataacaagaaaaaatatatactgctggatctctgtgtctcactccttatgccaaaataaattgagttaaagattcaaggaggccagacacggtggctcacgcctgcaatcccagcagtttgggaggctgaggtgggtggatcgcttgagctcaggagttcaggaccagcctgggcaacatggcaaaaccccgtctccacaaaaaaatacaaaaattagtcagttgtggtgatgcgcgcctgtagtcccagctactggggaggctgaggcaggcggatcacctgagaccaggaggcagaggttgcagtgagctgagatcatgctactgcactctagcctgggcaacaaactgagaccctatctcaaaaaaaaaaaaaaaaaaaaaagtcatgtaataaggagaaaaatacaggaaaatatttcttaattttttaataggaaaagcacttctaaaatgtgacataaaacctaaaagccataaaggaaataaatggataaatgtgtttctatacaaactgaaaacatatacttggtaaaaacatattgtaaacctatgtgaccatattcctggtgaaacagactatggcaaataacaaaggggaaaaacatgttttaagagacttaagaatataaattaatgagaaaaaatgacaaacaattcaagagacaaatggacaaagattatgaacaatcagtaaaatacaactgcctatgaccttatgaaaagacacacttaacaaagaagacaacttgcttaacagaatgtcaagtaagtaaaaggatggtaatattcagtgttggtcaagatttggacagaggctcaatcactcttgatgaaggtgtaatttgcacaatatttctgaagagtatctgagattatctatgctgatttaaaatctcagtatcttttaattcagaaattgcatgtccaataaattatctagcagatatggtcactcagctgtacaaagatatatgtacaatgtgttcaaagcaaaactgtgaaaacagcaaaatactgggaataacctaaatgctcagcctacatggcacaagtccttaaattacgatatacccaaatcaggaattcctattgtacctatgaagaatgactgacagctacgcggagcatggaagaatttccaacttgtattgttaagtggtgggtggggaggggaacatctacactcacaagaaaacgctgtgtaatgctactctttatgtctggggagatagcacacacatacccacacccctctctctacgcctctatacgcatacatcatcactggcaggacagataagaaataatagttgcctttggtgagaatttgggagaaccaaaattcaagaattaagaattaactctctggttcttactcttaagagtatttttatggttgtttgtcgttaaaccatgtgcatgtttactttctaaaaacaaactttaaacaagtctgtgacccattaattctccttttcagaatctaatccatgacacatgtgtacaggcattgctgcactagcaaaaagtcagaaacaatccaaatgttcatcctcagaggatgagatcaataaattatgatgtatcatataatggaatactttgctatcagtaagaaaaaaaaatctctgtgcagtgtcacagaggccatctaaggtacactgccaagtaaaacagtaaggtgcttatgtagtctggtttcattatgtattttaaatctttatctgtaaggaggatgttgctcttttcctactattttaattatttcataggatatacttcctgtgtaatcgttcttaaaacaaaattatcttaaaaaaagcgccttttccctgtgcatcttaaaatctagttggctctgctatcgtaaggttctagagagggaatggtttaaaatggacttgtctctccctcttactttctgcccaccactacttggtctttcattccacccaaaggcaacgacacatctttaaaaaaatgcactctatccacctctagtgggctgctttgagatacctataggaaacaagagacaactgtccccagcacgctaacgaggctcactttccagtgacatccacgagttgctgttggaaagaaagaccactctgtataaaggaaccccaggatggaatgaaaagcctgggtggacagagaagcatgaagtgttacaggtgtaatcagcaaagtccaacttctggaagacactctccaggataaatagcagacaacaaccaaaacatgtttcttcagtaaattgtaaggatcccacagaccaacagagaacagattcttaagaggcatatcaactaactgaaatgtagattttgagtaaaaatctataaaaactacttataggccgggcgtggtggctcacgcctgtaatcccagcattttgggaggcagaggcaggtggctcgcttgaggtcaggagttcgagaccagcttggccaacatggtgaaactccgtctctaataaaaatataaaaagttagccgggagcagtggcacgcgcctgtaatcccagctactcaggaggctgaggcaggacaatcacttgaacccaggaggcggaggttgcagtgagcccagatggtgccactgcactccagacactgggcaacagtgaaactccatctcagaaaaaaaaaaaaaaaattacaacatatgagaccactggaaacgtgactattctgtggatactggctgacatgaagttactgttaaatctgttaacatgtgataatggctttgtgtttaggtgtacaaagtctaacttctacatacatgttatcaaaagctcttgaagtgcagtccagggtcccagacctttcagggggaccatgatgtcaaaactatttccataaaatcctaagatatgatttgccttttccctctgattctctcccaagaacacagtagatctagttttctagttactttgtgatgtgtgattccactgcactggacggatgatgaaatgtgtttcaatattctgttttactatttaatatagtaaatattgagaggtatactgcacatgttaaagaaatctctttggggtcctcagtaattgttaagattattcaggagtcttgagattaaaaaaaagtttgggaatcattgctttatactattatgtcgacttcatatgatttaaactctccagaatagacagagttttaaaagtaaggagtagagtgatgaatgaactgggaaaaggaacaaggatcaatctctccaggaaccataaacccatgagaaattccttctcaattgacacactcatacagactcttcttaaaatgccaggtacaagtaaaacttaagttcacgttcctctctactaacatttcaaaaaagacaaatgcaatttaaacattgagcattacttcatcttcatttcttaagttaaaaaaaaatcctctcgtttccgacattcacagggttttgcatccgtcacccaacgctctcatcaaccttctggggaaactgtgttctactcttattctccctcacccctacttgggactaaacaaatccaaagaacagcccaaactgattttctgttctgggatgtgctgaattccactgcctgaagacgtgcctggtggctgctgttgagaagcctctggccgcagagcatccacagtgtttgtcacttcagtgggaataggctgcccttccttctctgtgctcctgtcagtcctgggcttttccagctgtctcacatctatccaggcatctgccttcccccttctccaagtccagttcctactctagaaggcagctgcaaggctggtggctgcaaatcccagtccaggcctttccctagcagagctcttggccgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgatgtgcgtgaccttggagccacctggaggctgctgctttttttttttttttttttttttttccaagagacagggtttcgccacattgcccaggctggtctcaaactcctagagttgagctatccacccaccttggcctcccaaagtgctgggatcacaggcgtgagtcactgtgtccagcacccatctggaggcttcttaaagcccaggccccacgccgagcttctgagtcaataaagaagtctgcatttctaacaagcttctaggggatgctgctgctgctgctggtccaggggaccccacttgaagaaccactgcactggtgtttcctctgggacccgaatgcctgtgcttctccccggctctgccacctcttccttgttaacatagcagggagtgagctgacaaccctggaacacagctttctcattcagtgaaatggatactgtgccaacagatacttcactggatggccacagaggagcatacagaccagtgatcacctcctcagtgggcagtacacaggcagaaagcaacctctaccaggttcacggacacattaggccctgtactttccaactgcctgacctgcaagctgtcctacttctttaagaattctcattttaaagacagaaatggggcagagatctttatcctagaaagaaatctgtctcttccaagcatgagtggcacgtggagagcccaagaggaaaaacaggagtgggccacgtggtcccattttacgcattactcggagggaaagcccgcggttaggtaggaagtattgaaagtgcttcagttcacttaccttggccatgcctcctgcctgtgcggtgttcagtcccgcgtgaccagtcatttgcggggaaacctgcgttagggtctcagccagcacgctgctcgaggcgccctgcatggctggagtagggtacggcattccagctccccttcctctgccagcagccccaagagatccattcatgacttgcgcctgcccttgtgaagcctgattaattaagctatggccagagttactattgaggaggcctgggtgggtctggttaaagttagcattcatgcagataccaggtccagtctgtgacgtggcagggctgctagtcgccagccccacttgcttttgtgcttgcggattcagtgcttgggaggcagcgggggtgggcccagaggtgctggctgcctgtttaggcaggctgggggctgaagaatctccctggctcagagggctcttgcccatggcactgaggctggccatgttagcactgttcggctgcccttgagcctggccacccaggccctgctgcacggggctgctggcgctcacatttcctattcctgggttgatactagagccgctgcctcctcgtagaagctccgacagttgtttatgtttggaagcagcatctggaacaaggttcccactgtttaaaaggcctaattctcctccattgggtatcagctcatcaggaagatcattttccaagtcaaacaatgatccaaaatctagaaattaaacagaaatggaaatgagaaactaagcaacctttacagctctccaactgccacgtttctatgatcttaacctaatggggcattcagcacgaacactagcatgtcttaagagtcatgtcattagctgggtgtggtagcgcatgcctgtaatcccagctactcgggaggctaaggcaggagaatagcttgaacccgggaggtggaggatgcggtgagccaagatcacgccattgcactccagcctgggcaacaagaccgaaacaccgtctcaaaaaaaaaaaaaaaattaaaaaaaaaaaaaaaaaaagagtaatgtcaaaatgatttacaagtttgtttgggaaaataaagaaaaaatacccttcaaattctgaagacagaaaagttaaacagagatgagaaggacagccctactatatttatcatattctaaaacaataattaaatagtgtggtgttgagggcaaactcagatatacaaattaaaagaaaacaatgggaagactccaaattcactgaattataattttaaaatgcttttaagaatgtatgtgtggccgggcatggtggctcaagcctgtaatcccagcactttgggaggctgaggcaggcggatcacgaggtcaggagagcgagaccatcctggctaacacggtgaaaccccgtctctagtaaaaagacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaagacaaaacattagccgggcatggtggcgggcgcctgtaatcccagctactcaggaggcttaggcaggagaatggcgtgaacctgggaggcggagcttgcagtgagctgagatcgtgccactgcactccaacctgggcaacagcgagactccatctcaaaaaaaaaaaaaaaaaaaaaaaaaaaaaaaaaaaaaaaagaatgtatgtgtgtaacaaagtaactgggcattgacttagatgaacagcaatttgaggacagtaaagccaatcttaaatttgtttttttttttttttttttttttttgagacagagtctcgctctgcggcccaggctggatggagtgcagtggcgtgatctcggctcactgcaaggtccgcctcccgggttcacgccactgtcctgcctcagcctcccaagtagctgggattataggcgcccaccaccatgcccggctaattttttgtatttttagtagagacggggtttcaccgtattagccaggatggtctcgatctcctgacctcatgatccatgggaggcctcagcctcccaaagtgctgggattacaggtgtgagccaccgtgcccggccgattacattatttaaaagttaaaatacaagaagtaaactagctttaacgcaaaatgaaatcagtgatttcttaaaagtgttgaagctgcagcaaatgataataaagacatacacagaaactacaaagagttaaaaataagagcctaaaagtatttgtagtatatgaaaggggtaaatgtcaatcatacaggaagatgagaagcacagtgactcccgactataaatggacaaaagacataagcaggtcttcaccccaaagggaaataaaacactaaacaaaataatccgtctttcctgataaggaaacaaatgggaactaaaacaaccctttttctggtccctttcaaagtaacttttctctgaagcgtggtctacacatgtcatctctaccctctcatttcccacgcactctaacccacaacggccaggctattcatgtatgtgcaaggaagaagtatgtagaaatatgttcatcttagtattatctgtagcatccaaaaaaaaaaaaaaagcacaaaaaatacccagaggcagtttttcctagtggttacagactctatactggggctgcccacactggacaccagctctgcctccagctccctattcattagtgatgtgaccttggtaggttactcagcctttctttgcctcagtttcctcatctggaaactaggggtaacaatggcccctacacctcataacgctgttgtgaggaccaaatgaataagtaagtgtaaaacacgactgagaacaaacagtgcctatgggtggtaaatgctaagtactgtctattattattactgctatccataacaggaggtttaataagcggctgtataatactttaaaacatcaggccgggtgcggtggctcacgcctgtaatcccagcactttgggaggccaaggtaggcggatcacgaggtcaggagattgagaccatcctggctaacacggtgaaaccctgtctctactaaaaatataaaaaatcagccaggtgtggtggcaggcacctgtagtcccagctactctggaggctgaggcaggagaatggcgtgaacccaggaggcagagcttgcagtgagccaagattgcgccactgcactccagcctggatgacagcctgggaaacagagtgagactccatctcaaaaaaacaaacaaacaaaaaacaccatacatcggccaggcacggtagctcatgcctgtaatcccagcactttgggaggccaaggcaggcagacgatctgaggtcaggagttcaagaccagcctggctaatatggcgaagccctatctctactaaaaacacaaaaatgagctgggcgtggtggcaggcgcctgtaattgcagctactcgagaggctgaggcaggagagtcgcttgaacctgggaggtggaagttgcagtgaactgagatatcgccattgcactccagcctgggcaacaagagcgaaactccgtctcaaaaacaaacaaacaaacaaacaaacacacacacacacacacacacgaaaaagaaaagaaaattaaaaccttttttctgcatggtggcagaccctaatgtctgctcacccaatacccctggccccatgctgctggcaacacccacatgatctgaagtggctgcctgggaggttcctctgaggaacgttccctggccacaggagggagagtaaccagataagcccaccaccacgatcacgttcccctttgcaagtgacacaatctcagctaagggaatctgaaggtacactgaaccaggaccattgtggaaaaggtgttccttcctcacagcaatggatgctcagaaagaaatctccctcctcttcttcaccagatctcgtcatgggcaggtgacaatcaccctgtagccaggagagcagacaccacttgcatgctaaggatggctgtagccaaaaacataaacacctggggtggggagatcatctctgaactgctgagtgatgcaaccctagtacttccccaccttcaaacttcatgttatgtgagaaaatacacttactatcacttaagccattttagctggagtttaacctcaccctaaccctaacagacccatcatgtctatggaagaagttcaaacaccttctcatggcacgtgaggctatcttcttggccttcctttacaggacaacaccagatgccccctactttccagccacaacactgagagctggcacaggcattgggaatctttcttcttgaatctctcattctaaaactcacctcagttcccactcagattaaacacagcaactatgaagactttctttgggctgcccctgcagaacagaccagtccctcttgtcagtctagaaaaccacgtctaacacacacttgttatcttcccacctgtctgtaaggaatgagatgtgatttaggagtgtgtacatgcatgtaacagtttttgaagaaaaaccgagactgagagtaagttgcagacgaaataacactgttctcctaagtacttcagtacgtatctcctaacaacatcctcttacataatcacagtatgcatgtgcaactcaggaaatgtaacactgatacaatactgaatatactgcccttactcaaattttgctggttgtcccaataatgatctttatcacacatctgtctcttcaaaatgacatgtcctatagccatgagattacaagatccaagatctaattcaggatcatggtgcatttaattgtcatgtctttgtcaccttgtttaatcgaaaaaggatcaaaggttccctggcctttgtctttcgtaagtgacattttattcttatttgtttattagacagagtcttgctctgttgcccacgctagatggagtgcagtggcacgatccaggctcactgcaacctttgcctcccgggttcaagcaattctccaacctcagccagaatagctgggattacaggcgtgcaccaccgcacccggctaacgtttgtatttttagtagagacggggtttcgccacgttggccaggctggtttcgaacttctgacctcaggtgatccgcccgcctaagcctcccaaagtgctaggattacaggcgtgagccattgcacccggccataactgacatttttgaagaatagaggccagttgttattgtagaaggtccttcaatttggggtacctcctcatggttacagggcatgtcattttgaagagaaaggaatctgatcccggatacagcagacagttccatgagggcacagggcctgtacctggtgaaataggtctcaacatgcttctgagggttccaatccatagtttttacgctattttgctatcctaaatttggagattcactgaggtgtccagacacaaactgtacaatatttattaaatatgtattaaaaagtcctctctatcataactactgttttgtttgttgccctccaggctttgtccacctgcacacacaaatttactcggtactccttaataaatatttttgtccaacccaaatgataaacgtttgaggtggtagatatcctaattactatgatttgctcattatgcattgcatgcatgttacaaaatattctgtaaccccttaatatatacaatcacatgtcaactacaaataaaaggaaaaaagaaaatatgtacccccccaaataacaacattttattttttattttatgttttagagatagggtcttgctctgtcacctctgtgcaatggcacaatcacagctcactgtatcctcaaactcctggactcaaccaattctcccgcttcagccccctatagctgggaccacaggtgtgccccaccacaaacagctcattttttattttatttttaattaatgaattaattaaataattattttgacagggtcttgctccggcacccaggctggagtgcagtgaagttgcaggctcaatgcagcttccgccctgcaccaaaacacccacctgatttttgtactgttttggagagacagggtttcgccatgtttcccaggcttgccagctaattaaaaaaatttttttttgtagagatggggtcttgctatgttgcccaggctggtctcaaactcctggcctcaagaaatactcctacttcagtctcccaaagcactgggattacaggcatgagccactgcagcccaaaataactacttttaaaaatgcagtgttccttaactgatgagcatgaaaatgaaacttcatctaaaccaggaactggagccattaccattagagatcagctctccttcctttctgtccagggcgaggatgaagagaccgtgtcaagcactgtaacccagaagcaaacaagggccaaatattttatatttaagtttggaaaaatctgcaaaaggcgacctaactggctattttgaacatccctaagcactcttcctaggagagggaggccaggccacagaagagcagataaactcagagagtacttagtgaaacccagggcagggctggcctcagtgtagaacaatgggaacagaacagctggaagctgagcacaggagttgaaatcctgcatccttaggcaaactgcttcatctctgcatcttcataccctcacctgtaaaacaagggtaccaacgccccagagttaaaaacttcacccatcatcctgccactctcagagctatcagttttcatttatggtttattctagttcttatcaaattcacaggcaagtttcaaagttgtaagcagggcttatgtcctgggctagtgtttttgtttttcactggtctgctacactctgaccaccgtgaccactttttcatcctatttcagtccaaatacatataccagctgtttgggtgaaggcagagttagacaaattcttcttctgtaattcaccatatgaatatgtgtaaaaccaaatatacaggtgtggctttttaaaaggcaagatagggcgcacacgtagtcgtaccatcacccttctgtttaccactgtcaccacatttccatattccctagttcagcaaaactgacaaaggggagtgaaggaggcaggccaggatattgcaacacaacacagctttgctttctacacaccaaagtgtcccaacacatgggttaagcaagagcaatctgtatcatcggaagttcctaaggttcacgattgacagcgatccagtcccaggtaagccctcttctctctgaccgttaccagggggcccgggagaatgcaaagaaaaggagactgtgggcaccctgcacccagagcatttgcacctcaaggaaacttcaccagccgatatcaaatagcgaacactgcctgtcatacttccatagctagggaaaggaattttcccttttgcagcttcctggctgccaaccaggaggctacccctttcattaagctgaaatgagagaaaagagaggctacacatttccccatttctatcacactcatacgaggctgggaagacccagtgaggaatgaggaaaatagtagggacttaggaaggagaaagttacagccaaactcagccagcctcaggaaaggcaactgtttaccaagcaaggtacagaggacattcacttctatactaggaaacccaagccggtggtctgcatgcagactgttaggtggggatcactcctaaacactgaaagacaaatggtacctacatctgttccaggatccattcttaataatgatgatcagaaatcagcatttcaccttaagcaaggaatgaactactagaatcaaacaccaggtgggtggctaaatcaatctgtgcagccaataacatttgaaaacagcctcatctgaaaaaaatttcaaagccatcagccaaagtatccacaaaacacacctttcttcaggttttctacagcctcctcttccataataccttattttcttctttgaattccacttggagccccagattatttgtactgacaggactggtctatcacaccttctcctggaaataagaactcttttatgctcctacagacacaatgcgttaaaattatgctaacaatttcacgttataacgtgcgtggggctgtaagctccctgaaagcagggatcctgtcttgcttatctactcagtgcctagcataaaatgcttcgtatgtactaggcactcaataaacccacgtgctgaatgagtgctcacattatagaggatacacagtatcaacaagctgcttgtctagtcaaagatataaagcagtaatcttaatgtttactactactttctgaaaacagaaacaataacgaattctctagaaatattacactgggtcatctttctctttaagactttttcctattgccctctttaccttttaggggaccacccaagtatatttcactctttggctacaaactcagcatcaatgaaccccaaccctagaattgatacacagattaaatggcataatgtaggatgagcaacagtagtgtaagaaataagcatgtaagagttcagatgctgttttgtgatgtgttcatacttctctgctttccctcccacacatattttctcttcctcacccactcctaatttctctctcacatccctatttcctgtgaaaaaggtctcctttctttagatttttttttcatggtttctttagattgtcttttgcattacttttgtaatactgtgactatgtatttggtcttccaccctgtctcctggcatacaactcctaaaatccttggaatctccaaaatagaatttttattttttatttttttatttttatttttttttggctctgtcgcctaggctagagtgcagtggcacgatcttggctcactgcagcctctacttcccggattcaaacaattcttctgcctcagcctcccaagtagctgggattacaggcgcataccaccacacccggctaattttttgtattttcagcagagacggggtttcaccatgttggccagaatggtctagaactcccaacctcaggtgatccatccgcctcggcctcacaaattgctgggattataggtgtgagccaccacacccaaccagtaatgtcttttcgtatgctcacgaattgactgatggctggcagctcctaggtagcttcggacaggagctggtcaccaggaagaccaaggcatgactgattagaggactgggactttcagcccatccttaatttccagggaagggagagatactaaagcttaagttgatcaccaacggccaatggtttaatcaatcatgcctatgtaatgaagcctccataaaaactcacaagtacagggttcagagagcttccagatagctgaacacatggaggttcctgaagagtggcacacctggacggggcaaaaaggctacatggccctctcacacgccttgccctatcacctgatattcagtggtatccttcataatatcctttacaataaaaaaccagtaaacatgtttccttgagctctgtcaaccgctctagtaaattaattgaacccaaggaggggcttgtgggaaccccatttatagccagtcagaagcacaggtaaaacaacttggggcttgcaaatggtggggggcgggggcagtcttgaggactgagccctcaaccgtgggatctgacaccatctgcctgtcagctggcgtctgctgcagcaccgagtgcctactcggtgtgtgtgtgtggctgggggcatctccacaaatctggtcccagaggtgttctgtgtcgactgttgacactgagtataggaataaaggagtataggagaaacctgatttttccctacatcctcagacttgtactatagccctgactactcaaatgcttctattaaatctttcaaaagctaaacatttttattcacctatttacctaccctcgaaaaacttccaaaaggaattttttttaagagatggggtctgtgttgcccaggctggagtgcagtggccattcacaagtgtgatcatggctcactgtagcctcaaactcctaaactcctggactcaagcaatcctcctgcctcagcctcccaagtagccaagactgctggcatgtgccactgtggctccaaaaagaatttttaatttctaagttaacggacacaggaagaggtaatgcacatgttaattggctcaatttagccaatccacaatgtatagatatttcaaaacatcatgttgtatatgataaatacatacaatttttatttgttaattaaaacaaaatttgaaggaaaaaaactacatacaaaaaacttgatccagcaagggcaaagcatcctggaaaagttcactcctagagatgaggaatctagagagtggtggaaggattcacagtgttgttattattattgttaaatgacctggaggccacactacgctctcggtgtgtttactgatctattactaattagacactacggacacaggaagtgcagtctggtgtagtgagaagagtactcaaccaagccctggttcagatcacagctgtcaccacagctactgcctccctgtgtacccctccttagctctaaaatggaaggacagctgggtgcagtggctcatgcctgtaatcccagcactttgggaggcagacaggtgggtcacctatggtcaggagttcgaaaccagcctagccaacatggtgaaaccctgtctctactaaaaatactgaaaattacaaaaaattagctgggcgtggtggcaggtgcctataaccccagctactcgggaagctgaggcaggagaatcactgggaggttgcagtgagccgagatcgcgccattgcactccagcctgggcaacaagggcaaaactctgtcccaaaaaaataaataaataaaataaaataaaggacagtagcacctgcttcgcaggatcgttgatgaaagaattaaaccatacagcatttagcactgagcttggcatgcagtaaggactcaaaaaatattagtcattactatcactgtcccaatcccatctcccaaggcacctatgagggctgaaccagccaaagcctttaagaacctggcactccagggttggtacagagcaggcgctcaacagccgccacttatcaatggtagtgacttgctaataaactcatccctgctgatctgtggcaattctagtagaattaaaggttactttgctttgaaagttcttggggattatgcaaataaatataatggaacaactctctataccaaaaaaaaaaaaaaaaaagaaagagaaaagctgttttattaatatttatgccatcgtaagtaatttttatctaggcatttaaacaagttcccaaaagacatctaacttttttttttttttttacaatgactattaggaaataattaaagcaacctccttctaaaatcttccgtaattcaggcttcttttatgcagacacaccaatccctaattagaacagaacaatgaggttgtacttcattctgaacagtgatcttatcttgagtaagtcttgcccctcctcagaatcactgatctgctgaagagccagagagctcggccggcagcccccaccctctcctccccaggagaaggaagcgagtcactgctcaggggccctcactcggtgcaggaccggctgggtttgagatagaatagaagtcggcctccccagaggactgtactctaattgaggaagacagccaatggacaccaagccacaaacttaaattaacacgtatgtcatattttacagccaagtggaataaggcagtgaacaaaagtaggaaaggcttcaaataagaggctctgagcagaagtttagaggaaaaggacactgacaactccaaagaggcagggacagaagacagcaagacaggcaggcagagatggctgctctgctgtggggaacttcaagggaaaagctccaagatggcaggagccccagggtaggtacaagttccatacggtgggaagggcctcactacggtaggcaggcttgctctgtcgcccaggctggagtgcagtgacacaatctcgggttattaaatttgggtttaataaaccgaattgtcttaaaaccctcaacacagcacttacatttatactagagcttagaatttgggttttcttgttttcctgtcatatgctgtgttttgtatgatgaacgatatttaagtggacattaacaacgaccttccccaagaagtccattcttcatatacgacattctagtggggttcttcctactgtatcagatccacatacctaccaaagtgacgcccttcccactgtatcgaattcgtacctaccgaggggctcctgccatcttgaagtttttcccttgaagctccccacggcagagcagccagctttgcctgcctgccttgctgtcttccgtccctgcctctttggaactgtcttttctcagtgtcctttccctctgaagttctgctcagagtttgcctcttatttgaaagctaaattacaggacaaatattcttcatgtcacagaagggtccatccagggggactcttttacacggaaatgtgcttagtaagttcatttaacatggaaacatgatgaacttcaaagtttgaattaaggggaaataaatcaagctatggtatcaggttaaactaactgcaataaaaattacagaaccttagaaactgtaatgtgaatcagaagggaaatactgatttatcaaaatgcacttaatacaatattcaagagtgctacctggaaaaggtaaaatctacttttgcataattgattataaaattttagcttttttattcattctcaaatgcacttgatggctgtactctgtatcaggtatcaaaaaacatcctgcttcgctgaatgattactatttaccttccatttaaaaaacccaagcaagacagggccaggcacagtagctcatgcctgtaattccagtattttaggaagcccaggcaggaagatcacctgaggtcaggagatcaagacccgtctggccaacatggtgaaacctcatctctactaaaaatacaaaaattagctgagcgtggtggtgggtgcctgtaatcctagctacctaggagggtgacaccggagaattgctgaactcgggaggcagaggctaccgtgagccgagatcgcgccactgcactccagcctgggtgacagagcaagattctgtctcaaaacaaaaacaaaaacaaaaaaccctagacagtccttattcaaagttctttgtcacctgggaccctaaactgtcctggaaatgcagccaagtctatttttatttggtgcacttagcagtcacagggaagtgccattcccagacagccaagacaacgttagtttcctcaacatggtttgcgtgctgcttccctcagccctgaagggtggggacaagggtggaatggaaggtgcctgtcatagcagccagctgccaccagaacacagtaatgacccagcagcccctgcacgttagcccaatcatctgggacaggggagcaaaaacgggttgtttaccaccaccacagctgagaggggcaccagaccccggagaggtgctacagtcagctgcctatccaccctgcttacagggagaggattctccagccaagaacagtcctggaggaagaagaatgtgggggctgagctaggagctagcctttgcagaagcagccccagaccccagattcccagccacctcagattccccagccatattgtaagaacaagcaaacagacatccagagaccaggtcctttgccccaaatgctgtgagatgtagctggcaggcggcaacaagaagtcaagaaagggggaaagagcatattccagacgtgaaagcagacttggaagtgccagtccatgtacaacgcgtggaggcgtgtgggctatttgagagccacaaacagaaaatgaatgccttaagtccaaaaagtatgccagtaccaggtatgttggctcacacctataatcctggcactttgggaagccgaggcagggggactgcttgggtccagtagttcaagaccagcctgggcaacatagcgaaacccggtctctacaaaaaaaagtacaaaaattagccaggcatggtggcacatgcccatagtcctagctgctcaggaggctgaggtgggaggactgcttgagcccaggagatggaggctacagtgagtcaagatcacgtcactgcactccatcctgggtgacagagtgagaccctgactcaaaataataataaaaaggtacaccataaaatgagagaattcagaaacaactgagaagcacaacatgatggagaatcacaagctgaagaacaaccttagtgttactcatcatagactatgctgataaagaatatccgtggctgggcatggtggttcacacctgtaatcccagcactgtgggaggccaaggcaggcaggtcacctgaggtcaggcgttcgaggccagcctggccaacatggcaaaacccctcctttactaaaaatacaaaaattagcggggcatggtagtgcatgcctgtaatcccaggaggctgaggcaccagaatcacttgaatctgagaggtggaggctgcagtgagccaagatcgtgccaatgcactccagcctgggcgacaaagcaagactctgtctcaaaaaaaaaaagaatatctgcaacacatctagcaatgtatacctggagaatatatgtgctgcctttcacattttaagactctaccaacacacaggctcttgaaggaaaatttgctatgatcaaaactataaatgcatatgccttttaaccactaattctatttctatgaatctgttccatagatttgcctgtccgcataactttacaaggctattcattaaagcactgtttgtgagaagacaagactggaaataacctaaatgtccaccagtggggagaggattaaagcaattatggcacaggtcacataatggaatggtagacaactgtaagaagacaataaacgtatgcagctgtgtgtacactatgctacctcagttaagaagaaaaaggcaggaagggggaagagagaactaagagtcaacagcgtctgcctgaatacagataaaccctggaagacagcactacttccagtggttacctgggaggagctaggtggagggaggctctctctacaggttttgtcctctgagttttctgagccatgtgaatgaactactagtttaagtaattaaaggaactaattttttttttttttgagatggagtcttgatctgtcgcccaggctggaatgtagtggcgcgacctcagctcactgcaacctccaccttctgggttcaagcaattctcctgcctcagcctcctgagtggctgggactacaggtgcacgccatcacacccggctaatttttgtattttagtagagacggggtttcaccatgttggccaggacggtctcgatatcctgacctcatgatccatcaactcagccttccaaagtgcagggattacaggcgtgagcccaccgcgcccggccaagaaactgatttttttttaaggcacccccactggggatatactggcccaggtgattaacttcagcaccaggtggtaacacctggaatggttcccagtgctccagtttccagttagggtccttatgatttgaggataaaatgtgaaatgggttcactattagttcaaaatatatttagtgtacaaataagcttaaaaggctagaaaagaaaagggcactttaaagaagaacttttcgaaagtatttttttctaaagggatgtgacaatcgacatgtaacattttgtacccaacgctcacacagggaaatctgacattatttcaaaatactcaaaaattagttggctgtcatgtcttgtggcttctagcaaatcaatgaagaaacctctaatataaagatgatgttaaaaatggagcttgtgacaaagcaagtgatgatcagacgccacactaaaacacaatccattttcctatctctggatggcgcctcttaggggtaatttgtactttgttcaaataattctcattagaggtctaaaggttttgcaacaggaattaactaaaactttgcttctcaccatttaacagattctcttaatcacaaatataaaaataaaacaatacaaaaacatatatacccccaaaatgttttgttttgaatttttttaactagtttttcttttttcactatgaaagtaaatacatttatggttttttgctttgtttgaaaaaaaaccctcagaatataaaatgaaaaacagcccccaaaacatctctagctcaaccccgaaaaacaatttctagagattcccttctagaaatttcctacatacaccattagcatatctttctacccctaaaagagatctaattatcatttttgctctccatcctttgtttattgattctcagtcttttctcccctcctaagtacccatcactctccctcaactggatctgcaatgccagggaactcagctactcttctgaaggaacttcactgattttaccctttcttttctaaaggatttctgagtcatactcagtgttttacaatctctacattaattaactaaattaacgaaaaggtctggagttaatgaaaatgttcttagaagtcctacccatcaagaaactttatctgcttggtgttgaagtaggttgctaacctacagatatttctatttcaactattaaggtgggtaataaaaaccagaagttttaagaatctattccaggaattgagaaacaataaacacaacttctgtgtgagctggctgcatgacatgcattttgatgacagtagcaaaacctctaatattctttgagatgacatggaattaattttaaaaaaactttaagcctaggcaacatagcaagaccctgtctctacaaaaataataaaaaattatctgggcatggtggtgcgtgcctgtagtccaagctactgcggaggctgaagtgggaggatggcttgagcccaggagtttgaggctagagtgagctataatctcaccactgcacttcagcttaagtgacagagcaagactccgtctcaaacaaaaaacaagaaaacttcaattattcctatttatataacatagagaaaacattaaaattgttttgtgttatttatctaaatgcagcaccaaaacattttaccgttaaaaaagaagacttaattaattaaaagaaagcctgggccgagcatagtggctcacatctgtaatccctaaactttgggaggctgaggttgaaggactgcttgagcccaggagctcaagaccagcctaggcaacataggaagaccccgtatctctactaaaaaaaaaaaaaaaaaaaaaattagccaggcatagtggcatgcacctgtcatcctagctacttgggaggctgaggtgggattgcttgagcccagaaggtggacattgcagtgagctgtgatcaaataaatgcacaccagcctggcggacagagtgagaccctgtctcaaaataaataaaaataaatttaaaaaaatagaacaaagcctgcatttctaatactaacatttccaacagctctgagatatgtatcagtctgaaaggcactgatagtagagttacataaaatgggctacttagggcaaaaagagtaagaagagaccatatttgcctggctacgcacagtccatctctagaatacgtaagaaacagctaacactggttgcctatggggaggggaatgaccagtgaccccagaaacagacaggaggaagagttttcaccaattactctgcttttttggaattctgaaccatatgaatatattatctactcacaagaacttaaaaaaacttttaaaagaaaattgtttgtacaaaaatttactaacatcttaaataagaacactagttccagttcttaagctgcttttcatggggcccttttcctgccaaaaacggggctcaggaggggaaagcattgtctactctccctacagacctgaacttggatgaaaaaacacaccttgaaaaagctaatctagacttctggaaaataaatcacaggagctcccccaatcactctggacacgggttttttaaagcttaattttgttttataagccctaaaaaaaaataataacctggactcctaggtctgacattcaaggcccttggtgatgttatctcgccttcagatgcccaagctgatgctctactcaccctcaatgagctctggtgtccttcctccaacaagcctccctgaccacccagcctgaggcatccacttccttccagtcagacatcgagctgagtgtgaaatgctataggccacggtgggcaccacgggactgctcacccaccacaccacacaactcagagttccatgaggacagaagcagcttctgccactactgtcatcaccacagcccagcagggtgccccacacgtaaaatgtgcttaaatatttgctgaataaaagaatgaagtggtaggagtcaagactggatcccgggccgaccaacccccgcagggcagaaccacacctttagtctccaccatctcagaagcaaaaccatgaggcctcctaaattctggtagcccagtgaacataacccaaaaactgtcacaagagccagacctccaccctgctatgagtgctgttccctctgcctggaacagtactatctgccatctcctattcaccctcaggtgtcagtgctaacgtcacagcccccggggacttccaatacccttcaaaacaggctcagtccccatctggtgcctcagtcaatgcacagtatgtcccctccaaggtcacacctgactgcagttacctgtccagtatccatcaccacccatgagggcagagatggggcctgtcacatccccactggatcgccagggcctacatcacagcataacaaatattttctaaattagtgaataatcctgaacagtgtgacctaagccgtgaatatttttgaaggagtctttcatcatttttaatttggagtcttgcatctttaaaagatgatcgttttaaaggaactttgtcataaatatctaggtgatacgtatcttaaagaaaactctagacaaagaggataagtaaatgtacttacagttgtgctgtccaataccgtagtgactaactacatgtggctatcttcatttactcaaaccaggtaacatttaaaatttagttcctaagtcacactaatcacaattcaagtactcaacagccacacgtggctcgtggttccagtactgtgtcatatagacacagcgtagagccgccctcccaataacgaccactggacagcgctggcttggagggcatcccgagaacacaggcatccccaaacaaggaaacatctcaattcaccctcttcctcctgggaaagaatccgttctcccctaaagtttcagtgactgagaaagccatcagtgaaagcaaaacacttgattctcttgccatcattcaaatgattccctcagagacttctcaacagaagttcaactacgggcaggtgtgctcttcaaacaaaaaccgattcccacagtagtagaggaacaaccacaatgacacagaaaacctatcaatatgttatgtctttttgttattttcaataaaggtgacgttctgaatatgtaaatcagatttaagtaaagatatccacaaatcggggaaaaattttgtccaccacggggtaacttttacttataaaaaaaaaaaatcacaccaaatctaggagaacagaaaaacagtaatctccattaaaagaatttcctactatagaatctgcaggaggagaaaagtcacacagtacagcacagagctgaatctgttcctttcaagatctgtgtagctgagcccgagaggcaattgagtttcactggtattcctttcaaccaacctgactaaactggacagtgatcccaaggccattttcttcccaactctgttttcaataaaatactatatttataatttctctgcatttacttttcccttttctctaagtcctaatctaaatcaagcccttgttctgaagcaataactagaaacagagttccatttaattaagagttcaattttccaataaaaaacagttgaactgcaaacacagacggagtaaaatgagtcaaacgattacccattttgtaagattctcgaatcttagttcgttttcttacaaactggttcccaaactgcactagagctggcactgaaagccaaacaggcaggggcagaagcttcccatgtattcagtgagaagcctcctgattccgggtcaggctacatcatcttagtcctcactggcccaagaagtaggtgatggctaatattttcccatacaattaaacaataaaaacagctgcctcaacctgctatatgccaggcaccctagtagccccatgtaccaagataatcaaagtaagcagaagtagagccaggcacagtggctccatctcacacctgtaattccagctactcaggaggccgaggcaggattgctgaaggatgggagttcaagaccagcttgggcaagcaagaccccattggaaagaagaaaagtaatgtaaagaaggggaggggaaggggaaggggaaggaaggaaaagaaagaaagagaaaaaaagaaggaaggaaggaaggaaaagagaaagaaagaaagaaaaaagaaagaaagaagagagaagagaaagaaaagaaacaaatggaatactgcagggtaaaaagccccttttagagatctctctctctctctctctctcactcacacacacacacacacacacacacacacacacaccccaccctgcaaaactcaaatgtgatgtcaccagcccaagtcacagcgctgccgagctgggagctgggactcacagtctactctgagcaggagccagggctccctcctcagcaccacactgaccgcctccccgtataaaaagctgacatttccttcaactgtgactcacagttagaaggttctacttttaatcaggtgacaaatactcaaaatattttaatccaaagcaactgggtcaaactcgtagagtctataattgtctaagcaaaccctaattacctgataaatttctatagctcctgaatgtcctcattcagtttgtaatcaaatacccaaatctccttatttaaatgttgtacaagccttctctacatgttatcatacagaacagtgacttatttttctatttcactggttattttaaccataaagttaaaacatgtttaggtggtgcagttttaataagaaaaatccaaactagggggaggagaagcagcttgtgaattataaaaagatttgctttacaacagaattgtacaactccactacacaactactttttctccttaccacagattatgcaaattcgaaaggttgaattaggtgcaactggaaaatatacctactgtatacaatatagtacaggcatattagaaaggcaaattaagacattttcaaacaatagcagacagtacaactagaaatgggaaagtaaagtcagatttaatcatgtagaattattttccccattagattttactattcttagcaatggttcaactaaacagtcttttgattaatggaaatgaaacaccggggaaaatgtcacacgggataatatccaaatctttcttaagggtaagttttaaaaggaattcaacttttagagacagagctcaaaaatagccttgcttcctaaatttagaaccagaaaacaccctaaaggcagtattttaaatacagccacagtcaccgcctatattgtctaggaacttaataaaaaaaactttaaaaagagaggggccacttttgtttacttccatgcctttcacacagccttgcccaatttgatttgtgtgcccttgctcaaatctcttcaagtcacagctcaaatggcaaagacctgaccactccaggacgccccggggactctgctcgtggcctattgtagcacccctgtcagcagagcacggccccagggaaaggagaacaggcaaaagcccccacaggcactgctcccaaggcttacacttctgcatcaaagactcatgcaataggagaattttgccgaaagccaagtttgagcctgactgagaagagcagcatccttttccagttaaagcaaggagtgtatccggagggatgcactgcaaggaaaagacctcagagaggactaaagggaacgctgagcgcatgtgctaaaaagcagacggcacggccaggagcttcagagcctaggagagacgggacaaccagaagaggactcagatgtgagcaagccatgggcctacaacgataccccaggaaacaaactgtcatggtcagggtgcttttcccaacaaccaggaatgcatggaaaacaggcaggcttccccaactcctggctctgtgctggctcagcagaagagctgtcacaggagcccaaggctcctcaaccatcccagggcctgcctcccactggggcatgcggccctggacttctgcacacggggacactcaggaaacaggggagggagtaaatgaagccttattcagatcaccctttctggttccagagtttttgcacttgactgcatttctgtaccctttccttaagttttgcctcgaggtttcatcttctcaagatggttctaagtactcacaggcatctatcagaatcctgtgtacactgctaatgcttaacaggtacctcaagataaattatacacagtaaacaaacagaatcacatacttgtctgctgcttaaacagtccatgaaatatgcttcaaaattatcaataattttcagtgtacatcctgatttgatttaaaagaaaaaataattcagaacacacaccatttaagttttcgtaattttaagctttcatggccatcacgttcctatttttaaaaatacaataaaaaatggagacagagtcaatggtatagatgacagaattcccggctatgtatctgctgaggtgctacactatcacacgcgtgcctgcacactggtttctgtggatacgagcacacatggcttctgtcctttccagaactgctgagaaacaggtcttgctccaatcagactagcactcccagtaagtcctaggacttacaaggtacgacaacgtccctggttaacgctagtgtcagttcccattgggcggatatgccagacacacatcatctcaggctaccctcataaccaccctgagatgggaattgttattatctccatgttacagatgaggaaactctgagctcagagagctgatgtaacttgccccaaacatgctctggcctcagcactcctaaggccagctggtttggtggccgggtgggagcccatgggtacggaactcggaagcaaataacagacccaattagaagataggtggcaatctgcttgaaagtaaaaccttaacaagaaaatgataagaactttaagggacaaatactatataattctttcactaattccctcaaatatttcctgagggcctactatgtgtcaggcactgcccctggggagggaagtgctgggaagagggccgtggaaaggctctggagttcttactgacgctcaccttctggtgtcacaggaaggggagcaagcctagagcctgagatgacaaagacggacgagaaatgccatgtgggccactggggtcaacaaaaagcaaaagaacaaagaaaaatgcaaccggtcaccaggctttctgataaattcgtctgattttaaatcaagtcatccatataactgttacagaggaacaaaaaagacagagagagagggccctgctaagctctgaagtgctccaagacaggagacccaagctagcctgctgctcacctgggctctcccgggctccacatcatgcagctcagaaaacttgccctgctgctgttttccttaaagctgtctgtgcagccgtggtaggccagtgctccccaacgggtgctcagagaatgaagtcccacgttatatcagtcaccaaattgcagcccatgggcgaagtcctcagatgccagtctttacaactagagttttactggaacacagccaggcccactcgcctatggctactttcttgctgaaatggcagccttgagtagttgcaacaagagaccatatggctcagaaagccaaatgcgtgctctctggccctttgcagaggaagtctgcggacccataataggctaaaaagagttctagcgtcaaacaggattgagagtggtccaactgtagcccctctctcacagtgcccaatcaggacaccaaggctctgggaaagtctgcagtcaaattcctcagctacaagcaacagcatctgagcacaaaccatttgttgagaaatacctcttagcatgccctctagtttcttggaatacatgtgaagagctggtttgagtaaggtaaagaggggtgccctcactaatgggaccccaaaaactaaactgacaagcttttgcaatcttcagaaactcacaataaggtacatttcatcttaactaaggtaagacacactttggcaaaatcattttcctaactgttttcaaatacatcaagtaaaaacacaagtcagcaattatggaccccccaggtaatcacatactttgccacacaattacaacacactacttagaagctgtgaaaacacaggcgactaatctaagcatcaacttccaactgcaggactcagtctctttgtaagttatgttcaattctgtttacagaatcaaatctgaatgttcagccaggagcgactttccatcttctgaaggccctctaaggcgccctgcacatgacttgtccttgcctaccttcatccctgacgacctttgaatggggccaccgctctcacccctctcagttattcaaaaacgaagcacggtcatgaaatgtcctagtcctaaaagtctctatgacaacttttattcctacttagccagaactcactgatggggtaacataaccgtttctcattctccctgaggtaaacaggaacacgagcccacacacgtcacgctgaggataacaccagaaccagagggaaaagggggacgccctaacccaggaggaagaatacactcctggctgcccccaccacaggtggttacaaacctcccccttagtgatctcattcatgtgcgggaaggccgctactgaaactcactaagcttggcaggttcctgggtcgattcaagtaaatgcattgtttacagatagagacttagaaaataaatatatagagctacggactttaacaatctagtttggatctggttttgaccctgtatcacctctcaagtccagttcctcacctagaaaatagcagtaacagcatcttcccttcctcacaggacgctgtaaggatcaaactgaggtgacgtggagaaaagcactctgatacataaagtaccagacatacataacagaccatttggttgacaaccatattcgccaccagctttctttaaataagcttccctattgcatttaaaaggattcacgtcataaaatgtaatcacaactgcttagagccacttatacagcacaggatgaaacacagctatgttcaatcttcagaatgtagtttttcttttcctttttcccccagagacagggtctcactctgtcacccaggccagagtgcagtggcatgatcacagctcactgcagcctcgacctcctgggctcaagcgatcctcctgccacagcctcctgaatagctgggattacaggattgtactattacacccaactaattaaaaaaattttttgtttagatggggtctcactatgttgtccaggctggtctccaactgctggcctcaagcaatcctcctgtctcagtctccctaagcactgggattataggcatgagccaccaccctggcctgcaatttcaaaaaactttataaacagtctgttgtgtgcaaattttgcaataaagctgaccaaaaaaaaaaaaaaaaaaaaaaaaaaacaacccagaaaacaaaaaacaaaagtctactgcttgcctggatatttgtcttatactgttaaatcatgaatctctgatgttgaaagacacaatatgctattttaacttggacatattaaataaagaagtttccaaaacacccaactaactatataccggtaatataaagtccccacttattgtaagggtgccaagtaaaggaagacctcatgtatgagaaagtgtaaaggcttctacataatacaagaaaatgctactttaacatctgaggccatcaaattctgtgcctctccagggctgctgcttcagtggggtgaaaggtaccgtttctctcttgctaccctcattcgcagcacattccgtatttctgcatcatctctgcataagcttcccaggcttcggcaacttgtttgtcatcagtggcagtgacattcatcactctgaggtgctgcatgaccttcgggagtgctgtttgcaacatccatgcccccagatgagcagcaccctggctgagcagctccccaatgtcgggtgcatttttctctcagctcactgccacccttcacagacacatctaagtgacactggtggccccacaggccagtctctacagacatgcactgcagtccaagtagatcctgtttctcaggctgccaagggctcctcctcctttcaacccctcagctcctagacagaggtcccctccctcaaatttgatcacatgcaccgggcacacaccctgctccactaggcccaattttcccctgggagcctcagagacacatcccgtcactaaaataagattgagttcctcaagaatgttattctcaggtctgtcccacctaaccaaatgccttcagtttttgaatgtatttaatgtaaaaactcaagccatttatttgtttaaaatacatccctaagatctctgtccatctcattactcaatttcttagtggagcagttacaacagacaaagtgtccctcgtttcttttggagacagcgtctcactccattacccaggctggagtgcagtggcgcgatcttggctcactgcaacctctgcctcccgagttcaagcaattgtcatgcctcagcctctcaagtagctggaattacaggtgcatgtcaccatgcctggctatgtttttgtattttgagtacagatggggtttccccatgttggccaggctggtcttgaactcctgacctgaagttgatccaccagcctccgcctcccaaagtgctgggattacaggcatgagccatggcgcccagcagccccttgtttaatgtgcttgataatgagcccttccttggtcccccatactaacagaccctttcacaatagtgtgatggtgatgaatgtgtaacacatgacccaacttaagtatgatgttgactttctactttggattaaatcggagccatttaaagctgacttttggtcccacgaaagagcccctgtgccttacaaggatcaaaattgtaaaggaagggggaaaaggtggttaagtgtggaaaatcctttctgatcaacttattaagcatctgatcatccaataatggacactactatggaaaaagctaacctttgggctccatcttggaaacagctggatgtacatataaggacatgcctttttgttaagtcttgtgttactaattgtccccctttttaagacaaaatctacaacaaattcattcaacaacagcaaagctacaaagccatccaggttaccagtttcagaagacaagcttcaaagctgaactcgccacgtatgacctacgtctcacagaactgaagactactcaaacacagcaagattaatgaagcaacggagatctgttttgcagtacaacggcatttaaactactgtttccaaatttctcacttcaataagttcattttataagattaacgtcaaactcaacttttatcagctaaaaagaaaagcattagtgatttttatataccatgagcatcatttactcctccccactgtttaacaaattttaactagataagaatctccttatgattgatctttaaaaatcgcttttcacttctacattaatattaaacgtcgcttatcataacttgattccaggaattgtattcaaacttaagccacaaaattcaggttttgtttcaacagcaatagcagttttttttaatatgctagtggtcggtcacagaactatttccacaagttgaacagctgtgtctagtgcaaatctgaaggcagcgatgtaattcaatttggactcattcattagaaactgattttcagatgctaccactgcaagactactggagaaatgcaagctgcgctggagatggaattgttcgcagcggcacacaagtttttgcggcaaaggagagagctctaaaagaggaaatacaactagttcatgttaccatgaaccagcgcagtgggacccagaattactgaattaatagaaaactaaatacttctcttaagcagctatgataacttaagaaagtttccagggaagccgtttaatgaaaggaaacaaacaaaaagatgatttattcagtatcctgctccatttttttgaaaaattggaattcctacattccttaattctttgtacatctacactgtgaaagcaacacaaactcaaatggagattgcagcccaaatgaacttaaacctgctgtttaactttcttttgaagttatacatggaaatgaaacacaccacagcaactttcatgacatcttgctaacgaagtttgggttttgaaaaatggaatgactagttgactaaaaacacacacgcgcgcacacacacacacacacacacacacacaaaacaaggagttttgaaaataagcactaagcatctttccaaggaactcactcattccaagaaacttcggttctaactcgcaagctggcggctgctgtgagtgtcctctgaatgcagcctggtcaatgtgtcgccaatccagaaaacacactgccctacctttggccgcgatcttgctttctctaagcatcaaaggtaccctccgctgtcattcctctggacggccacgcgtgtggacacggccgcggatggatgcgtaggacattaccaaacaaacccacacgctgcactttacttcttccctcctggagtgccactagggtccccgcgaggagggctgatcgggtgcggggaggccgagtgcaccgggcgtgtgctgaccaactcgggcccagtgacagtcctgcgacgaacttccaccctcccgcgcggggcgaggggaacgggctgcggggcctgctccgagctcccggctcgatcggtatccgcgaccacgacccccggacgctctctttcaggtgggggtgacagcgcgccccgggcccccgccgccccggaccccctcctcacctgtgctgtcattcgccgagaaaccgggcgagctgagtttggctcttttggggttgggcggtccgtccagcaagttctcagccattttcacctgctcgcgaaaacagccccgggcacgggcggccgggccggcgagggcccggacgggggtcgggggccctgccggctgcgagggagaggagcgagcgcgggccgcgagcgggcgggcgggcgccgagggagagggagggcgcaggccgggtgggggaggcggcggccaaatctcagccacagcaacagcgccccgcagcgctcaccgcccgcccccggccgccgccgccgccgccggccgcggccccctcatcccctgcccgcctcccgagcgcgacactccgcggtgggggcgccccggcggcccggccgcccccccgggcccggctggcagcgacggcgcccggccgggcggctcaggcagtccccgagaacatggtgccgccgccgccgccgcctcgctccccccccgcgccccacttaatgaattcgctcgcggcccgacgacgagggggctccgggctccgctcccggcccgcggcccgccgccgccgccgccgtgaggaaaaacaatgcgccgagcggggtcgccgccgccgccgcggcccccccaccccccgttccgccgccgccgccgccgctgccgccgccgccgccgccgggctccgggaggccgagccgagaggcgagcggggccgccggggcgggcgccgagggccgggcggagcgggccggccgggcggagcggggtgcgcgggcggttgtggggcccgggaccggcggggccgagtagatcgcgctcgaagccccggtcgggtccgcgacaagatggcggctgttgattcctcaattaaaaaaaaaagaaagttttttttcttctctttccagagcctgaacggggagggggtgggggcggggcacgccggtgcgtcacccccccgcggcgtcaccacgcacggcccccgccccgccccctccacctgcgccggccgtggcggaaagagccgagcgtgctcgggccgaagggctgaaggcgcggccgccaagcgtagggaagctggcggcccggcgcgggccaggcctgcggggcgcctgggctccgggctgagccacagcttttgttctgatggcgaccaggcgtagagggccggggctccgggccccagcgggctccgggagcggcggcctggccgcgggctgggctctcgggcgcggattcgacgccagcccgggcccgcccgtcccgctggggcggcgctgcgtgttcccagctcctcgcgtccccttccccagaccctcctaggtggcgtcggtcgggaacggtcggggcgaccccagcccaggccgcgccactagccttcgccgccggccagggaagtggaatggcctctgcaggttacagaccgcccttgggtcctgccgacgaggtgggcggatggggaaactgaggcggggggcgagcaactgctccaaagtggtcgaggcaggaagtggcagggccgggattcgggtcccgccctacctcgtgacactagggagtgagggggcctcacgcctgttcgcatcccaaggcggcagggcagacaccctcacctgtgagagcggggtggcgagggccggcctgggcggagaagggcccgcgcatcggggcttaagcctggacgctcaggccgcactccccgccccaggcaacttgcctggcgcctcgcaggtgccccagacaggggtgcgggcctggggagtcccccacgcgagaccacagcccgcgggacacttctacgaatacccgaggtgttcccatcccagttagttatctgcccctccaaacttgcccggcttcctcataaaggtatcagcagctccactgtttcctaagccagaaacccgtgagtcagcgcggactcctccctctcacccgccacgcgcccctctacccacggtctttacctgggagactgctcctcccgcactgtcccggtggctatggtggcagctactcacttaagtgttctttgctctccacgttgctccccacgcagcaccagagttaacatcccgaaaagagagggagaaaatctgtttaaaacaactccctggccaggcgcggtggcagatcacctgaggtcaggagttcaagaccagcctggccaacatggtgaaaccccatctctaccaaaaatacaaacattagctgggcgtggcggcgtgcgcctgtaatcccagctactcgggaggctgagatgcgagaatcacttgaactggggaggccagtaagccgggatctcgccattgcactccatcctgggcgacaagagtgaaactccgtctcaaaaacaaaacaaaacaaaacaaaatcccagacatagaaaaagaaaacactacatagtctttctttaaaaaagaacacgtatgaattctcttaaaaacataggtgtatgtacatatggtgactgtccttgagtgtcaagattgagtgatcgttctgcttttctctgtttacctgtactgctcaaaatcttgggccgtgataccgctcttgaatctgtctcttctactttacatggctcacttcaccatcatcatcctacacccacttggccagtaggcagttcacatcattcaggctttttttttttttttttcaaatgctggtccctgtgctgagaagacatgcctggcaaattctaactcatcctccagaacccagttcaaatgtcacctactccaggaagccctcctagcccactcctcggctcccatatcacttctgggctctgtgagagaacacataacacatcctgccccatcttccccgcctccactgcccccgaattagttcatgtttttacttatgcatcaaatagctcttgagaatcccaagggcattgagactgtgctaatccccttggccaaacataaagagatccccatatattcaaggagttaaaatagcacaccctggaagccataaatggaagtattcaagaagtcagtttgcacaggaatggcaagaagtgtatcagtggcacagggcaggccacaccctgtatctgaatgctctgggtgtccgtctcaccaagggtctgtgagctccttcggggcaaagatggtgtcttagtcacagaaacagtgctctgcaagaagaagtaggtttgtaaaactgaatgagtgatgagctgtgtcaggtgctctgagtcctagaggccttcaggccactgaaaagggtgggccccagcctgaggtggctccaggccactcttcaaacgggacaaggtgtccagccacctagaggtcttagggcctgccttggggcagtggagacaccatgcagccccccaggggtccattggtgagtggtttacacagaagtgggcacaggagcttgagccattccctgacaggtttccattttacagaggaaagcaagggaactcagtcgcaaggactcagaagtaaataacccggacatggcaagtctgggcctggaacccatgtcctcactctccaaagaccctagtcttcctgtctcaccatgttccaccctcaaaatataccggctctgcagtccctttttctgtctcattgttctcacctgtatcattttgatcaattctggtattcactgatacctgttttttctttcctttcgatttcttctcccttcagtctgactcaaagaaccctgagctcagacactgatgggggaatagcaaggagggaagcgtggctcctgcctgcactcacttagctggggatcaccttcaacaagtgagtgccttagggataccaggccgctctgccatgcctcccatggatagcacttcctacaatcctggaaggaaaaattgtcctcatttcacagatgaagaaataaggcacaaaggaggacaagccacccagccacgaaggggcttcactccggtgcacacctaaggcttcctgctctttccacaaacctcaccctctccagtctcagataccacattaaaaaacaatcaaaggactgggcatgatggctcatgcctgtaatcccggcactttaggaggccgaggtggaaggatctctagagcccaggagtttgagaccagcctgggcaacagtgagaccctcatctctacaacaaaatgttaaaaagtgaactgggcgtggtggcatgcacctgtagtcccagctgcctgggagaccaaggcaataggatcactggagctcaggaggttgaggctgcagtgagctatgatcaaaccactgcactccagtctgggcaacagtgagatactgtctaaaaaaaaagaaaagaaaagaaaagaaagagaaagaaatggaattggaattgttggctggatgcggcggctcacgcctgtaatcctagcactttgggaggctaaggtgagtggatcacttgaggtcaggagttcgagaccagcctggccaataaggtgaaaccctatctctactaaaagtacaaataaatggctgggcatggtgggggggcacctgtaatcccagctacttgggaggctgaggcagaattgcttgaacccgggaggcggaggttgcagtgagccaagatcgcactccagcctgggcaacaagaatgaaacttcgtctcacaaaaaaaaaaaaaaaaaaaaaaagaaatggaattgttgcaatttgatattgattgtccctttctaggcttaaatagattaaaagatagcatcaggtttggactttgccttcaagcgatgcagaacagcattggggagaaaaacacaaacaggacacacattgaaaagataagcagagaatccaagtcagaatagcacaaaatcataataactgatcccccaggggtgggagtcccggggttggggggcagaggcctgggggagtagtcccaggaaggcaggattccagccagttcctggtggacagaaggcagaatgtggtctggtggtgtggagggatccagacagagctaggttcaagtcccaaacctactgctttttcttagctgttttgaaaacaaatacctcggccaggtgtggtggctcacacctgtaatcccagcactttaggaggccaaggcgggcagatcacctgaggttgggagttcgagacctgcctgaccaacatggagaaactccatctctactaaaaatacaaaattagccggccttggaggtgcatgcctgtaatcccagctactcgggaggctgaggcaggataattgcctgaacccaggaggcggaggttgtggtgagccaagattgcaccattgcactctagcctcggtaacaggagcaaaactccatctcaaaaaaacaaaaaaagaaaaaaaaaaacaaatacctcctcacctgctgagacagttgaggtgcggtggagatgagatggagggtgcacagggtccctggcacaccaaggcaccatatagctgctatttggggcagtgggaagcaggcgctcaagggtgagaggcccctctcctctctctgccgtccacatgggaggctgcacccgcccctctcgtgggggacttgctgttgcttttttttttttttaattatactttaagtgttagggtacatgtgcacaatgtgcaggttagttacatatctatacatgtgccatgctggtgtgctgcacccatttactcgtcatttagcgttaggtatatctcctaatgctatccctcccccctcctcccaccccacaacagtccccagagtgtgatgttccccttcctgtgtccttgtgttctcattgttcaattcccacctatgagtgagaatatgcggcgtttggttttttgttcttgcgatagtttactgagaatgatgatttccaatttcatccatgtccctacaaaggacatgaactcatcattttttatggctgcatagtattccatggtgtatatgtgccacattttcttaatccagtgtatcattgttggacatttgggttggttccaagtctttgctgttgtgaataaagccgcagtaaacatatgtgtgcatgtgtctttatagcagcatgatttatagtcctttgggtgtatacccagtaatgggatggctgggtcaaatggtatttctagttctagatccctgaggaatggccacactgacttccacaatggttgaactagtttacagtcccaccaacagtgtaaaagcattcctatttctccacatcctctccagcgcctgttgtttcctgactttttaatgatcgccattctaactggtgtgagatggtatctcattgtggttttgatttgcatttctctgatggccggtgatggtgcgcatttttcatgtgttttttggctgcataaatgtcttcttttgagaagtgtctgttcatgtccttcgcccactttttgatggggttgtttgtttttttcttgtaaatttatttgagttcattgtagattctggatattagccctttgtcagatgagtaggttgcaaaaattttctcccattttgtaggttgcctgttcactgtgatggtagtttctttagaaaaccccattgtctcagcccaaaatctccttaagctaataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaacaactgctcagtgaaataaaagatgatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatccgttccttacaccttatacaaaaattaattcaagatggattaaagacttaaacgttagacctaaaaccataaaaatcctagaagaaaacctaggcattaccattcaggacataggcatgggcaaggacttcatgtctaaaacaccaaaagcaatggcaacaaaagccaaaattgacaattgggatctaattaaactaaagagcttctgctgttgctttttaccatcactgcccctgaatcttttctcccttacttaccccagtacctccttttccttaaacacattggcagtcagcttcagcttcagccctgattccaccctgtctcttccattcctagctaaggaaacttgaacagggtgtctacaaaggctgggctcatttcctcttctcccatgccctgtgtttatttttattttatgttattttatcattattattttgagacggagtctcactctgtccccctggctggagtgcagtggcacgatctcagttcgccacaacctctgcctcctgagttcaagtgattctcctgcctcagcctcccaaatagctgggactacaggcacccgccactatgcccagctaatttttgtatttttagtagagttgggggtttcaccatgttggccaggctggtctcgagctcctgaactcaggtgatctgcccgcctcggcctcccaaagtgctgggattacaggcgtgaaccatcgtgcccagcctatttttatttttgagacatggtcttgctctgtcacccaggctggagtgcagtggtacagtcatggctcaatgcagccttgacctctcctgctcaagtgatcctcctgcctcagcctcccaagtaactgagactacaggtgtgcaccaccatgcccagctaattttttttggagtcttgctgtattggccaggctgatcttgagttcctggcttcaagtgatcctcctacctcaacttcccaaagtgttgggtttacaggtatgagccaccgtgcccatagagaatttccttccttatgaacgatgaatattccatcgtatggatggaccacagtttgcttatccattcatctgttgacggatacggaactgcttccaccatgcagctatcatgattaatgctgtggtgaacgtggatgtatttcttttcttcccaaccctgctttcaattcttttttttgtttgtgtttagatggagtcttgctctgtcaccaggatggagtacagtgacgcgatctcagctcactgcaacctctgcttctggggttcaagcgattcccctgcctcagcctcccgagtagctgggactacaggtgcccgccatcatgcccggctaatttttgtattttagtagagatggggttttgccatgttacacaggctggtctcaaactcctgggctcaagtgatcctcccacctcagcctcccaaagtgctgggattacaggcgtgagccaccgcacccggcctgctttcagttcttttgggtatatacccagaagtgggataattgctgtctcatatggtaattctacttttgattctataaggaactcccatactgttttccatagcagctgcatcattttacattcctgccagcagtgtacaagggttccaatttctccacttcctcaccaacacttatgctgttttgttcttttcttttctgataatagtcatcccgatgagtgctatctttcagttcattccttttagccgctgtcttgtattctactgcaggaacaaagcacattttattgatctattctcctcctaagggactggtagattgtttccacttttttcctgttacaaacggggctgcaattaatgttcttgtacaggtttccttgtgcacctaagagcatcaccagatgaacactgagaagtggatttcctgggtttaaggttatagcaggcagagcccccgtagaatcagccagcttatggaaggtttcatagaggaactgcgtacacagttagggcgggttgcaaggaaaccataagggatagggcagcaacctagggcttgtagcagctgagctgttactgccacaaggcccaaagggacacagaagggaaagcttcccagacccggaaagaaaataattgtgtagagatggtcatcttgagaggggtgatcttttgcagagggactcagctgacttgaggtgaccaaataccgtgaccactctttctttttttctcccttccctttccctttcccttccttttcccttcccttccccttccttccttctctcctttcttcttctctttccttcccctcccctcccttccccctccccctcccctccctccctccctccctccctccctccctcccttccttccttccttccttccttccttccttccttccttccttcctttcgatggagtctcgttctgttgtccaggctggagtgcagtggcgtgatcttggctcactgtaacccccaccttttgggttcaagcgattcttctgtctcagcctcctgagtaactgacattacaagcacatgccgccatgcctggctaatttttgtatttttagtcgagacagggtttcaccatgttggccagactggtctcaaactcccggcctcaggtgatctgcccaacctcgcctcccaaagtgcagggattacaggtgtgagccaccgcacctggccagtttccttttttaaaatttttttaaaaatttttttgtagagataggtcatgctttgttgcccaggctgatcttgaactcctgggctcaagcaatccccttgcctctgcctcccaagatgttgggattacaggcgtgagtcccatgcctggctttccttcttccttctttcctgtctgtcttcctctctctctctctctctttctctttctctctctctttctttctaacagggtctcagggtggagtgcagtggcacgatcacagctccctgcagccttgaccacccaggctcaagcagttctcccacctcagcccaccgagtagctgggactacaggcatgtgccaccacaccggctatttttttttttttttttactttctgtagcgacagggtctcatgttgcccaggctggtctcaaactccggggctcgagcaatcctcccactgcagctgcccaaagtgcagagatgataggtgtgagccaatgcgcccagcctttccttccttctgatctcccgccagggtgcccactaggaacccaagcccaaggcatggtagcctgtccaagtcagcctcctgaggccagggcaacgtggaaaggggtgaagggatcgattcgagggctatccagaagatgtctggcacatagagtatagccatcctcaactgtagggggaatttccaatttgcatttatttaattatttatttagttagtgagtgagttagttagtttttgagacagagtcttgctttgtcgcccaggctggagtgcagtggcgcgatcttggctaactgcaagctctgcctcctgggttcacgccattctcttgcctcagcctcctgagtagctgggagtacaggcgcccgccaccacgcccggctaattttttgcatttttagtggagacagggtttcaccgtgttagccaggatggtctcgatctcctgacctcgtgatctgcccacctcggcctcccaaagtgctgggactacaggcatgagccactgcacccggcctatttattttttttgagacatagtctcattttgtcacccaggctagagcacaatggtgccatcttggctcactgcaacctctgcctgcctggtacaagtgattctcctgcctcagcctcccgagtagctgggattacaggcgtgcacccccatgcccagctaatttttttgtatttttagtagagatggagtttcgccatgttggccaggctgttcttgaactcctgacctcaggtgatccgccttcctcggcctctcaaagtgctggcattacaggcgtgagccaccgcgcccagcccaatttgctttccaaaatgattttatccatttacattcccactagcaacttatgctatctatatacccacatctttgccaacattagctgttatttaccagacttaattttcattaatttgagttttttcccagccttcggggatgaaatggtgcctcttaattttagtatgctcttccctaattactaatgaggctattttcacatacttatttgtttaggggaggttttatgtactatggattgccttatcctttgctcttttgctgttgggttttttatctttctcagattcattaatcactttctttttaaattttggatgctaatccttcataaataaattgtctaactgtttggtccggcgtggtggcccacccctgtaatcctggcattttgggaggccgaggcaggaggattgcttgagcccaggagtttcagatgcacttgggcaacacagtgagaccccatctctgcaaaaaaaaaaaaaaaaaaaaaaaagttaaaaattggctgggcataatggcacgcacctgtaggcccagcctctcaggaggcggaggtgggaggatctcttgagtccaggacctggaggctgcagtgagctataatggcaccactgcactccagtatgagcaacacagtgagaccccatctcaaaataaaaaacttgtagctattctttcctgtctgtgacttatcttttcccttgcagtattttttgttatacagaacttctatattttttttttgagacagggtcctgctttgttgcccaggctggagtgcagtggtgcgatcttggctcgctgcaatccccgtcccgggttcaagcgattttcgttcctcagcctcccaagtagctgggattataggtgcttgctaccacgcccaggtaatttttgtatttttagtagagatggggtttcaccatgttggccaggctggtcttgaactcctgacctcaggtgatccccctgccttggcctccttaagtgctggcattataggcttgagccaccacacctggctggatgtttacattttcatctcttcaaattgattactcttgcccttcatggtatgtatctgtggcttagatctccttccctactctgatgtcataaaaatggtttcccatgttttcttctagaaatttgagttttgctttttcacatttgggtgttcagagcattctgggactgtgcatgtgagcatacacatgtgtgtggtttgaggtagagatttacttctttttccttacagatagctggttccctttatgaaatactccatctttgtgctttgatttctaatgtcaactcttttattatactaagatcctctttcttgctctgtttttcctctttctttcctttttttttctttcccttctttccttccctccctccctcccttcctccctccttccttcctcccttccttccttctttccttccttgcttttttttcttctatttctccctcatctctccctcccttcctcatccttttcctttcccgttccatttccttttccctttcccttttctttctttcgaggcagggtcttgctctgttgcccaggctacagtacaatggcacaatcttgactcactgcaacctccgtttcctgtgttcaagcgatactcctgcttcagcctcctgagtagctcggattacaagcacgtgccaccacacccagctaatttttgtatttttagtagatataggatttcatcatgttggccaggatggtctcaaactcactcctgacttcaagtgatctgcctgcctcggcctccctaagtgctagaattacaggcgtcagaccccgagcctggccccaacatcctctttcttctgtcagttggcctatttgtatcccactgcaccaatattacaatgtttaaaatctttccaagtaagggtaactcctggtctctggagaggagagtttcccccacccctcttccctttcaaagttgtctttactactcttgactcttttggtcttccatgtgaatttcaatttttcaaggagtgtgaagaaaaagttgggcttttcattggaattgctttgaatttgtaaattaacttgaggaaaattgccatttaaaaaatcgtgtgtcttggccagctgtggtggctcacacctgtaatcccagcactttggaaggccaaggtgggtagatcactggaggtcaggagttcgaggctagcctggccaatatggtgaaaccccgtctctactaaaattacaaaaattagccaggtgtggcggtgggcgcctgtagtcccagctacttaggagactgaggcaggagaatcgcttgaacccgggaggcagagggtgcagtgtgccgagatcatggcactgcactgcagcctgggtgacagagtgagactccatctcaaaaaaaaaaaaattgaaataatgactgatatggaatgatactaagaagttaccattaattttttattttattttaatttttgtagagggtggggtcttgctatattgcccaggctggtcttgaactcctggactcaagcaatccgcctgccttggcctcccaaattgctgggattacaggtgtgcgccactgcccccagccagttatttaaagtgtgatggtaacattgtgattatgtattttaaaatagtccttaactttagagacataggctgaaatatttataatctataaacattacagtataacatatatagatgtatataaaatacagtatgataataggatgcctgggagtaggtgggataatagatgaaacaagattgggcaggaatagatagttattgaaactgagtgatgggtacctgagaattcattactttattctgcatacttttgtgtatttcaaaaattcctataataataaaagtttttaaaatatgagggccaggtggctcctgcctgtaatctcagcactttgggaggctggggtgggaggattgcttgaggctaggaagtcaaggccagcctgggcaacacagcaaaaccccatctcaacaaaaaatttaaaaattagccaggcatggtgatatgcacctgtagtctcagctacttgggaggctgaggcaggaggatcacttgagccaaggagtttgaggctgcagtgagctgtgattgtgccattttactccagcctgggcaacagagtgattattattaaacagtgtattattatacagtatattattatagtataatagtataatagattagccttatagtataacaatacaaatatggaaatattgagtctttccatccacagacatgatatagctattcttttatttacattttcttctgtcttgcaataaagttttatatttttctccataagggcctgcccatcttttagctgatccaacagatttgccagactcttctattagttccaatcatattaatatttttttctccagaatgtcttgtattttttgtgtaggcctttgaatcatatgttaaaaaataaaataaaggccggatgaggtggctcacccctataatcccagcactttgggaggctgaagcaggaggatcacttgaggtcaggagtccgagtccagcctggccaacgtggtaaaacccgtctctattaaaaataggaaaattagccaggtgtggtggtgggtgcctgtaatcccagctactcaggaggctgaggcacaagagtttcttgaactcagggggtggaggttgcagtgagccgagatcgtgtgacgacactctagcctgggtgacaaagcgagtctccatctcaaaaaaacaaaacaaaaccaaacaaaactgtagttttgtatgtttactgtaccttttctatgtttagacatgtttagatacataaatacttaccacggggttacaactgcccacagtactcagtgcagtaacaagctgcacaggtttgtagcccagggaacaatgggctgtaccatgtatcctgggtgtatggtaggctgtaccgtctaggactgtgtaagggcaccctgtgatgttcacacaatgatgattccattgcctaacgatgcatttctcagaacataactctgttgctaagtgacacttggctccattgctaagtgcagtgacaagtgtccgtataagaaggcagagggatatttgacacagaaagaggagacagacacacagagaagaaaatatgcagacagaggcagagatttaagtgatgcagccacaagccaaggaatgctggcagccaccaaaaaccagaggcaagtgacagattcctcctccagagtcttcaggttgagcatggatctgatgacaccttaatttcagacttccagcctccagaactgttagataatagacttttgttgtttggtttgtttgttgtttttgttgttgtttgagagtcttgctctgttgctcaggctggagtgcagtggcacacaatctcagctcactgtaatctctgcctcccaggttcaagcgattcttgtgcctcagcctcctgagtagctgggattacaggcatgcacccccatgcctggctcatttttgtatttttagtagagacagggtttcaccatgttggccaggccggtctcaaactcctgacatctagtgatccgcctgcctcggcctcccaaagtgctgggatcacaggcatgagccaccacacctggcctgatttttgttgtttgaagccaccaagtttgtggcaatttcttgcagcagcttcagctagcgaatacatgattaaactagaaaaatcttataatcatctcctgatgaaaaacacccatctgacaaaattcaacctattcataattttttaaaaagagataaagagaaaaaaaaactctcagtaaactaaaatagaaggggtcttctttgacctgataacaggcatctatagaaaacctacaacaaaagtgcaatacatttttaaaaattgatcacttggggccaggcgcggcggctcatgcctgtaatcccagcactttgggaggccaaggccggtggatcatgtgaggtcagaagttcgagatcagcctgactaatacggtgaaatcctgtctctactaaaaatacaaaaattagccaggtgtggtggtacatgcctgcaatcccagctacttgggaggctgaggcaggagaatcgcttgaacctaggagacggaagttgcagtgagccgacatcacgccactgcactccagcctgggcgacaagagcaaaactccatctcaaaaaaaaaaaaaaaaattgatcaattggacctcatcaaaatgcaaatcttctgttcttcaaaagataccatttaaggccgggcgtggtggctcacgcctgtaatcccagcactttgggaggccgaggcgggcagatcacgaggtcaggagatggagactgtcctggctaacactgtgaaaccctgtctctactaaaagtacaaaaattagccggcacagtggcaggcatctgtaattgcagttcctggggaggctgacgcacaagaattgcttgaacccaggaggcagaggttgcagtgagccaagattatgccactgcactccagcctgggtaacagaatgagactgtctcaaaaaaaaaaaaaaaaaaagggagaagaaaagaacctcaaaattattgatcatttatttggaaagtgcaatttgaaaccacaatgaggtaattttttttttttttttgagacggagtttcattcttgtcgcccaggctggagggcaatggcatgatctcggctcaccacaacctccgcctcctgggttcaagcgattctcctgcctcagcctcctgagtagctgggattacaggtggctgccaccacacccggctaatttttgtatttttagtagagacggggtttcaccatgttggccaggctggtctccaactcctgacctcaggtgatctgcccacattggcctcccaaagtgttgggattacaggcataagccaccacgcccagccgagataatatttaacaaccaccaggaatggctacaataaaaataaataaataaataaagtaattaattaaattaaaataacaagtgttggcgaggagaaacaaaatcactcatacattgctggtgggtgtgtaaaatggtgctcttcggaacaaatagtttagcaattctttaagaagtttaatgcggccgggcatggtggctcatgcctgtaatcctagcactttgggaggccgaggcgggcggatcacaaggtcaggagttcgagaccagcctgaccaacatggtgaagccctgtctctactaaaaatacaaaaattcactgggcgtggtggtgtgcacctgtaatctcagctacttgggaggctgaggcgggagcattgcttgaacccaggaggtggaggttgtggtgagctgagatcgtgccattgcactccagcctgggcaataagagtgaaattccatctcaaaaaaaaaaaaaaaaaaaaagtttaatgtacccaagtgcatgcctgaagcctcagttacttgggaggctaagtcaggaggatcccttgagcccaggagagcaagaccagcctagtcaacacagcaagacttcatctccataaataaataaataaatacatacatgtttaatatattcttaggtatgacaccagaagtacagggcaacaaaagaaaaaaaaagataaattgtgctgggcgctgtggcttacgcctgtaatcccagcactttgggagtccgaggctggtggaacacttgatgtcaggagttcgagaccagcctggccaacatggtgaaaccccgtctctactaaaaatacaaaaattagctgggcctggtggtacgtggctgtaatcccagctactcgggaggcagaagcaggagaatcacttgaacccaggaggcggaggttgcagtgagctgagatcgtgccaatgcactccagcctgggtgacagagtgagactctgtctcaaaaatacacacacacacaaaacccacagtgagataccacttcacacccaccaagatggctgttataaaaaaaccagaaaataacaaatgtacattgcaggtgggaacataaaacagcacagttgctgtagaaacaatatggtggttcctcaaacataacataaaattaccatatgattcagcaaccccatatcaaggcgaatgccttaaagaagtcaaagcagagatgtgttcacagcggcattattcacaatcgccaaaatgtggaagccacccaggtgttcttccatgggtgaatggagaaacaaactatggtccatccgtacaatgcgctatgattagccttcaacaggaatagccttcaacaggaagtgcgttctgacacttgccacaacgtggacgacatggctggaccttgaagacttgctaataagccaaatgcaaaagggccagtattgcatgattccacttacatgatgtacctcgtaccagtggaagagtcaaagggaataggtgaattcagaggccaggtgcggtggatcatgcctgtaatcccagcactttgggcggctaaggcgggtggatcacttgaggtcaggagtttgagaccagcctggccaacatggtgaagccccatctctaccaaaaaattaaaaaattagccgggcatggtggcacgtgcctgtagccccagctactcgagaggctgaagcaggagaatcacttgaacccgggaggcagaggttgcgagagccgagatcacaccgctgctctccagcctgggtgacagagcaatactctatctcaaaaaaaaaaaaaaaaaaaaaaaaaaaaaaaagttgagttcggatacaaaaacttgaatagtggttacagtagctgggaggaggggaaaatggcaagttcatgtttaatggggataataattattcagtttaggaagatgaaaaagttctggagaaaaatagctgtgatggtcacacaacagtgtgaatacggttaatgccactgaactgcatgcttaaagaatggttaagattggccaggcatggtgcctcacacctgtaatgtcaggactttgggaggccaaggtgggtggatcacttgaggtcaggagtttgagaccagcctggccaacatggtgaaaccccctctctaccaaaaaattaaaaaattagctggacgtggtggtgcgtacctgtagccccagctactcgggagggtgaggcaggagaatcacttgaacctgggaggtggaggttgcagtgagctgagattgcggcattgcattccagcctgggtgacagtcagactccgtctcaaacaaaaaccaaaaccaaaacccaaattttcagacgtaacaccaaaaacacaagcagcaaaaaataaataaataaataaaagaatttgacttcatcaaaatttaaaacttttgtatttcaaaggcactgtcaagaaagtgaaaataatggggaaaatatttgtaagtcatatgtctgtcagagaactgtatttagaatatataaataactcttacaagtcaataataaaaagacggccaggcgtggtggctcacgcctgtaaccccaacactttgggaaaccgaggcgggtggatcacctgagatcaacagttcgagaccagcctggccaacatggcaaaaccccatctctactgaaaatactaaaaatttgccaggcatggtagcgggcgcctgtaatcccagctactcgggaggctgaggcagaagaatttcttcaacctgggaggtggaggttgcagtgagccgagatcgcgccattgcactccagctgggcaacaagagcaaaactccgtttcaataataataataataataataagaagaagaagaagacaaataacccagttaaaaatgaacaaaagggccaggcgtggtggctcaagcctgtaatcccagcactttgggaggccaagacgggtacatcacctggggtccggagttcaaaaccagcatggccaaagaggtgaaaagaaaccccacctctactaaaaatacaaaagttagccgggcgtggtaccacgcgcctgtaatcccagctattcgagaggctgaggcaggagaatcgcttgagcccgggaggcagagggtgcagtgaactgagatcaggccactgcactccagcctgggtgacagagcgagactccgtctcaaaaacaaaaaaacagaaacaaaaacaaaaacaggacaaaatatctaaatgggcatttttctgaagaaagtatacaaatggtcaaaaagcccacaaaaacatataaacatcattagttaccagggaaaggcaaatcaaaaccacagtgagataccacttcacacccactagggtcactataattaaaaaaaaagaagagaaaaagtaataggtgtcggcaaggatgtagagaaattataacccttgtggactgctgatggaaatgtaaaatgctgtagcctctgttgaaaacggtctggcagttcctcaaaatattaaacatttgatccacaaattctactcctagatatataccgaagagaaataaaaacctatgtctacaaaaaacttgtacacaaacgttcttaccaatgtcagtcatgatggtcaaaaggcggaaacatatcacatgtccattaactaatgaatagatgaagaaaatgtgatctatccatgcagtgcagtattatccaaccatagaaaggaattgagtattgatacatactacaacatggaagaaccttgaaaacattctgttaggagaaaaaaaccaaacataaaagccacatgttacatgattccattgatataaaatgtccataataggcaaatccatagaaacagaaagtagatcagtgttgcttagggtggagggtgaggataagggtagggggaaagggaattgatagttaaagggtataaggacttctttttgctataatgaaaatgttcaacaattgattgtggcaatggtgcacaactctgtcagtatatcaaaaccattcaattgtcaaaaaaaaaaaaaagttaaaaaaatttaccggccgggcgcggtggctcacgcctgtaatcccagcactttgggaggccgaggcaggaggatcaccaggtcaggagatcgagaccacggtgaaaccccgtctctactaaaaatacaaaaaaattagccaggtgcggtggcaggggcctgtagtcccagcttcaggaggctgaggctggagaatggtgtgaacccaggaggtggagcttgcagtgagattgcgccactgtactccagcctggggcgacagagcgagactccgtctcaaaaaaaaaaaaaaaaaaaaattaccatatgacacagaaattaggtatctacacaagaaaaatgaagcatatatctgcacacagacttgcacacaaagttctgagcatcattcttcttctttttgagacagaatctcactctgtcacccagcatggagtacactcgcatgatcacagctcactgctccctcccgggttcaagcaatcctcttgcctcagcctcccaagtagttgggaccaaaggtgcagcctccatctctgaggctcaaaccattctcccgcctcagcctcctgagtgtctggaactacaggcatgtgccaccacgcttggaaaatttattttttaaatttttttaattttagtagagacaaggtctcattatttcgtccaggctggtctcaaactcctggcctcaagggatcctcccgcctcagcctcccaaagtgctgggattacagatgtgggccactgtgcctggccagttttgttattcttttttttgttgtttaagttctgttgcccaggctgcagtgcaatggtgcagtcttggctcactgcaatctccgccttctgggctcaagcaatcctcttgcctcagccccccaagtagttgggaccaaaggcgtgcaccactacacctagctatttgcctagctacatatttacttttttttttgtttttgagacaatctcactctgtcgcccaggctggagtacagtggtgcaatcttggctcactgcaatctctgcctcccgggttcaagtgattctcatgcctcagtctcctgagtagctgggactacaggcatgcgccacaatgcccagatatatatatatacatgtatatatatgtgtgtgtgtatatatatatatgtgtgtgtatatatatatacgtatatatacgtgtatatatacatgtatgtgtatatatacatgtatatatacatgtatgtgtatatatatacatgtatatatacatatatatatatagagagagagagagagagagagagagacagtcactctgtcacccaggctggagtgcagtggcatgatcgtggcatgatcatggctcactgcagcctcaacctttcagtctcaggcgatcctcccacctcagcttctagagtagctgggactacaggcacttgccaccacactcagctaatttttgtattttttatagagatggggttttgccatgttgcccaggctagtctcgaatccttgagctcaagtgatcctcccatcttggcctcccagagtgctaggattacagacatgagccactgcacccagctagcccagctaatttttgtatttttcgtagagacaggtttcgccatcttggccaagctggaatcgaactcctgggctcaagcgatccatccgcctcggcctccaaaagtgctggcattaacccgctttttgaacaaggggccctgcattttcattttgcactggcccctgcaaatgatatcaccaggcctgaggccatgagcaggtgccgcttcagacaccccggcttcagggtttcaaatgacaaaatccaaacttggcttctctccacacctcagacttggcctcctttcattggcttcaatctcagtcctcctgcagaggcaggacagagacagtagctccagaaccagcagcagcagtaacagctaaagtctttcctgcaaaccccagcaagccctcctccttgagtttcaaggagcctcgtgcccttcctggatctattgctcctattgggagtgcgatgccggaatgggtttcgtcctgattcatgtactcagcctcatctgagctgagactagaggagatgtggacctggaagtgaaaagcaggggacagtagccagagatgagcaaaggagaacttgggcaatgacagcaatgcctatgccttcctggatgcccagtagccacaaatcccctccttccttactcacagccacagaaacacatctgcacacactgaccatgcatttacttcctccttggggggagcaaactcagtttttctttcttttttctttttttttttttgagacagagtctcactctgtcacccaggctgaagtgcaatggcacaatctcggcggctcactgcaacctccgcctccaagattcaaccgattctcctgcttcagcctcctgagtagctgggactataggcatgcgttaccattgcctggctaatttttgtatttttagtagagatggggttggtcttgaaccaggctggtcttgaactcctgacctcaaatggtccacctgtctgggcctcccaaagtgctgggattacaggcatgagccactgtacccagccccaacccagttttatccagccactgtttcccactctaggactggaatctgtttttttgtttgtttgtttgtttttgttttgagacagagtctcactctgtcacccaggctggagtgcagtggtgtgatctcggctcacggcaacctcagcctcccatgttcaagtgattctcctgcctcagcctcccgagtagctgggatcacaggcatgtgccaccacacctggctaatttttttttgtatttttggtagagatggggtttcaccatgttggccagactggtctcgaactcctgatctcagcctcctgtcttagcctcctaaatctaggactggtatctttgataacttggcatttctgctaagtctgggatgtgggtcctcatagtctggccacctatggctgaatgaggaatttgaccaacccagcccatgaagggggtaattctagaaagagacctataaaaccatccaaaacccaggccaggtatggtggctcatgcctgtaatcccagcactttgggaggccaaggcgggtggatcacttgaggccaggagttcaagaccagcttggccaatgtggtaaaagcctgtctctactaaaaatacaaaaagtagccaggcatggtggtgggcgcctgtaatcccagctactctggaggctgaggcaggagaatggcttgaacctgggaggtggagactgcagtgaactgagattgtgccactgcattccagcctgggcgacagaacaagactccgtctcaggaaaaaaaaaaaaaaaaaaaaaaaaaaaaaaaaaaacagagctgggcgcggtggctcacacctgtaatcccagcactttgggaggccaaggcggtcggatcacgacgtcaggagatcgagactgtcctggctaacacggtgaaaccctgtctctactaaaaatacaaaaaattagccgggtgcaatggcgggtggctgtagtcccagctactcgggaggctgaggcaggagaatggcttgaacccaggaggcggaggttgcagtgagccgagattgtgccattgcactccagcctgggcaacaaaagtgaaattctgtctcaaaaaaaaaaaaaaaaagtaattaaaaatttaaaatagagacaaggtctcactatgttgcccagcctagtctcaaactcctggccttaagcgattctagtgctcttctggacagttccacaggtgagagtaactgaagccaaacattggtcaagtcagggtctctggatagaaactgtgccatgggaattcctgttcttatcaacaggtctctggcttgcctctgctgccagcgccacaccatggctaccctctgagtctgtgctgccatcttggccaccacccccctggggtttctgccctcaggctgcatgccagctacgctttacaaaagaaaagagaggctttgcacagaccagtgctgagatcaatcatgaaccaagaggtgaatcactcaatgcttgctccctggggtcaaaaaacagacagaggaaaaaaaaaagactaaaagcaaacaaattaattaattcatgtatcacttgcaaaagttttcaaaatttaaagttttcaaattatatatatatatatatatatatatatatatatatatatatgattttattttaggttctgggatacacgtgcaggacgtgcaggtttgttacacaggtaaacatgtgccatggtggtttgctgcagctatagacccatcacctagatattaagccccacatgcattagctatttattctgatgctcttccttcccccgccacctccaaaattaagtttttaaaaaattgtgagaaaaactcaaggaccaaaggaaaaaaaaaagacaaatttaacttcatgaaaaaactttttttttttttttgagacagggtccctctccgtcatccaggctagaacgaggtggcacaatcatggctcactgcagcctttatctacctggctcaactggtcctactgcctcagccccccaagtagctggggctacaggtgcacgccaccacatctggctaattttttaattttttattgagacagggtcttgctatgttgcccaggatggtctcaacctcctggcctcaagtgatccttctgcctcagctcctaaagtactgggattacaggggtgagccaccatgctcagctgttcatgaaaaaatttaaaatttgtgctaaaagacactatcaacagagtaaagaaacaacccacagaatgggagaaatatttgcaaatcatatatctgatgagagattgacatccagaatatatacacacctcctaaaactagacaacaaaaaacaaacaacctgattcaaatatgggcaaaggacttgaatagacgcttatccaaagaaggcatacaaagaaccaaaagcacatgaaaagatgttcaacatccctaatcattagggaaatgcaagtcaaaaccacaatgagataccatctgacaccccttaggatggctactatccaaaacccagaaaataacgagtgtaggtgaggatgtgagaaatcggaatccttgtgcactgctggtaggaatgtacgccggtgcaatcactttggaaaatggtatggcaattctttaaaaaattaaaaatagaattaccatatgatcagcaattccatttctggctacatacccagaagaaccaaaagcagggtctggaagaaatatttgtacaccgatgtccatagcagcatttttcacaatagccaaaatgtagaagcaaccagactgtccaatgacagataaacagctaaactaaatccaggccaagcatgcaatggaatactattcagccttgaaaaggatggaaattctgacacatgccacaacatggataaaccttatgctaagtgaaataagccagacacaaaaagacagatactattaatatgttattccacttatataaggtacctagaggagtcaaattcatagagaaagaaagtagaatggcaggctgggcacagtagctcacacttgtaatgtcagtgctttgggaggccgaggcaggaagatcacgtgagtccaggaggtcgagaccagcttgggcatcatagagagacccccgtctctacaaaaaataaaaaaattaggtggctatctatggtgacatgtgcctgtagtcccagctatgtgggagactgagttgagaggatcgcttgagctcaggagatcaaggctacagttagctatgattgtgccactgcactcaagcctgggcaactgagtgagaccctgttttgttttaaaaaacaaaacaacaacaacaaaaaaactcagctgggtacagtggctcgtgactgtaatcccagcactttgggaggctgaggcaagaggactgcttgcgcccaggagtttgagactgcagtgagctatgatggtgacactgcacttgtactcagcctgggcagcacagcaagaccccatccaaaaaaaaaaacccacaatgcttaaggaggaaaaaatataaatgactaagatgatcaattttatgttacatgtattttaccacaataaaaaaagtagtaaagtagtttaaaaaaaagaccatgagaggctgggcgctgtggctcatgcctgtaatcccagcactttgggaggccgaggcgggcagatcatgaggtcaggagttcgagaccagcctggccaacatggtgaaaccctgtctctaccaaaactacaaaaattagcctggcatgatagtgcacgcctgtagtcccagctactggggaggctgcagcaggagaatcgcttgaacctgggaggtggaggttgcagtgagtcgagatcggaccactgcactccagcctgggagacacagcgagactccatctaaaaaaaaaaaaaaaattgtgagaacaatccagggactagaggaaccattttcaattaaggatcaaaaggcatcaccagttttaaggaggagccaagggagttgcctggatgcctgcaggtgactgacaggtgactggggtgtgggcagggcctgcagagggctgagtgagtccccagttccctcagagccatcagcagaagcccaggggacagagtgctttctcttatggaggttgagagtggaaaaccacaccacaggagggagactgagtggcgagaaccgagatgttggcaaacacatctccaacaaggtctgccctacctgtcctgggcaacatcatggaacacagcaatcaggcatctgcggcaagcttgtgcaaaggcccctcccccccccccttttttttttttgagacagagtctcgctctgttgcccaggctggagtgcagcggcaggatcttggctcactgcaatctccgccccccgggttcacgccattctcctgcctcagcctcccaagtagctgggacttacaggcgcccgccaccatgcccggctaattttttttgtatctttagtagagacagggtttcaccacgttagccaggatggtcccgatctcctgaccttgtgatccgcctgcgtcggcctcccaaagtgctgggattagaggcgtgagccaccacgcccggccatgtattttttttagtagagactgggtttcaacatgttaaccaggatggtctcgatctcctgaccttgtgatccgcccgccttggcctcccaaagtgctggaattacaggcgtgagccaccacatccggctttttttttttttttttggagacggagcctcactctgtagcccaagctggagtgcagttgggtgatctcagctcactgcaacctctgcctcctaggttcaagcaattctcctgcctcagcctcccgaggagctgggactacaggtgcgcaccaccacacctggctaatttttgtatttttagtagagacggagtttcaccatgttggccggggtggtctggaactcctgacctcaggtgatcctccttcttcagcctctcaaagtgctgggattacaggtgtgagccactgcgcctagcattttttttttttttaagactgggtctggctgtgttgcccaggctgaagagcagtggtatgatcacggctcactgcaacctctgcctcctgggctcaagcgatcctcccgcctcagcctcctgagtagcggggactacagatgcatgccactgtgcctatggaggccccacttaagtccctgcaataatagcccagtgtgactcaggtctggcctcccccagaccctcacagggatacccacgaatggcgaggtgcttcacgcagaccactgggctggaacaagccacatggtggatgctgagttccaggtgacacttggatcggggccaggcagccctcttcccccgaagcaggggatccctctgcccactgttggcataaaagtaatcggggctgtacggacagtgtgatgaccctccgccctcccttctggactgaatgacttgggctccgactgctggaatgtcctgcgaattgcccgtgactgaggagagttgcctcattcaaggtcaaggtcaagttcacatcccctttctgggttctacttggaggtggctgaggcagggggagaatctcagcctgttccctgaacccaggtctgaagtggaggttgggtgaggccgtgctccggcctgtggcacagcccagcgtctcccgggcatgtccagcttctgcacttccccacgcgagctgacaagggcacctgagtaatctctgcatgctcctctccatctcagagtgttcgtcctagggagccctgtctttggcagtagccgcccttgtattctttttttcttttcttttcttttctttcttttttttttttttctgagacatagtcttgctctgttgcccaggctagagtgcaggggtaccatctcggttcacagtaacctctgcctcccgggttcaggtgattctcctgcctcagcctgctgaggagcgtgccactacacctggctagtttttgtatttttagcagagacagggtttcaccatgttggccaggctggttttgaactcctgacctcaggtgatccacccaccccagccttccaaattgctgggattataggtgtgagccactgtgcctggccgccttgtattcttttttgcagctgccaaaacaaatgaccacaaactgggtggcttaatccacagaaatttattcttatacagttctggagggctgaggtccaaaatcaaggtgtgagcaggccacgccgcctgcagaggctctagaggagggtctgtcctgcctctcccagctccaggccttcctgggcttgtggctgcatctctccagtctgcctccgtcttcacatggccttctcctcggagtctctgtatctgtccttctcttctaaggacttgtcatagggcccactgtaatccaggatgatctcatcgcgagagcctcagcttaatcacatctgcaaagatccttactccaataggatcgcatcctggaggttccaggtggacgtatcttttaggggaggccgcaactgagccctcggccgcagtccaggcttctgtttctatggcaacactaagagcaaccggtgagctccaggaagggcggggtcttggttgcatttgtctctgggcctccaggagttcctcagaaagggtggcaacatgaatagtcccatctgccaccgccgtgaactgtcctctcttgatggtgctgagagcaacatgcagtgtgcagggaagacgcagaccccacccccacaccagcacccccagtgctgcagccaaaggagtttccagctcggccctgcccctctagggtgagcaggtgagcaggccagcttaggagagaaaggaggcctgatggcttggttggatgtcttttgaaacttttctttttttaagacagagtcttgctctcttgctcaggctggattgtagtggctcaatcacggctcactgaagcttcaaccttctaggctcaagcaatcctcccacatcagcctcctagtggctgggactagaggcatgcaccaccacatctggctaattaaaaacaaacaaacaaacaaacaaacaaacaaaaaaaccctgtagagatggggtctcactgtgatgcccaggctggtctcaaactcctgggctcaagtgatcctccagccttgacctcccaaagcactgggattacagttgtgagctaccacatctggcggtcttttgaaactttctaccgaggataaagagtaactattttccaccagggaagctgtcaaggttgaagttttaagggcttctgtgtgggccaagccagtcacaggtaccttcccaggaatgtagggccctgagatatcaactgggagacaacatgtatgagtcagtattctccagagaaacagagccaatgggatgtgtatagatacacagaaagaggttgagtatgaggaactggctcacatggttacggaggcagagaagtcccaagattttccatctgcacgctggaggtgtggttccaatccaaactcaaatgactgggaattgcggggcccatgggttaagtccttgtctgagtccaaaggcctgagaaccagaagcgccaatgtcagagagcaggaaaagaaggatgtcccagttggagccgaaagaattcacccctcctcagcctttttgtgctattcaggattgtacctgcccacctgcattggtgagggtgatcttctatattgagtctgctccaattcaaatgctaagctctgccggactcagtggctcacacctgtaatcccagccctttgggaggcggagttgggcagatcacttgaggccaggagtttgagaccagtccagccgacatggtgaaactccatttctactaaaaatacaaaaattaggtgggcatggtggcatgtgcctgtggtccagctatccaggaggctgaggcacaagaatcacttgagcctgggaggcagaggttgcagcgagatgagattgtgccactgcactccagcctgggtgacagagcaagactctgtctcaaaaaaaaaaaaaaaaaaaacatttagctggatgtgatggctcacacttgtagtcccagctacttgggaggctgaagttggaggatcacttgagctcgggaggtcgaggctgcagtgagctgtgattgcatcactgcactcaagcctcggcaacagatcaagactctgtctctcaagtcaaatcaggctgggtgcggcggctcatgcctgtaatcccagcactttgggaggtggaggtgggcagatcacctcaggtcaggagttcaagaccagcctggccaacatggtgaaaccccatctctccaaaaatacaaaacttagctggacgtggtgctgagtgcctataatcccaactacttgggaggctgaagcaggagaatcacttgaacccaggagggggaggttacagtgagccaagatcacacatgtgacagagcaagattccgtctcaaaaaacaaaagtcaaaccaaatcaaatcaaaaggcagcaactgagaaagacattcatcttcaaggaagatgcaggtggctgctgagagagaggcgggtttcggcacgtggccatgtgtgcctactcatggaagttccccagaagacctttgttcgtggaagtgatgaggctgtgattccatttgtgtggcgctttctctctttgccccatgcccccctctcccctctgtgatgtccatgggcaacggggggccttggaagaacctgggaatgaggctgagtcccagcctggagcctgcatctcattgcctgtagagcgaggccgctctcgtcacctcctgccagttgtcatgaggctcagatgaggtgatggggagagaggatgcagcacagcaaactgggctttcgacccgggaggggccacgtggctcatctacaggctttgccaccactagcaggcaactctgggcaagctgggttctcagaacctggatttcctcttgctaagaagtcgtgagcatctaaggagcgtaggcgctgcccaccgaatggtggttaccagatcatggaaagcaatgagctcagtgcctagtgcataatgggggccctgcgtgtgaatcctttcccttccttagggccactcggtggtacatgaagaagccatgagagcagggatgaggctgcctttgagtgtcctgggctgggtggccatagggtagactgcagggggcccaggtggggaccggcatccatgaactgtgtcttggtcaccaactcactgtgaatgtatggcttctactaactctgaggcacatggatgtttaatgacttgcccaagcccagccccagctgaaactgcagcgtcctgtctaccgtgggctctaaatgatgatgaaatcatgtttggtccacaagactcatgacccttagaatcccttaaactgcagcatgcatgattttgtgcatccatgcacagatgcgtggactgtctaacagttctctttttgggataattttttttttttttttgagacagagtctcgttctgtcacccaggctggagtgcagtggcgcaatctcagctcactgcaacctctacctttcaggctcacgcgattcttgggcctcagcctcctgagtagctgggactacagacatgcaccaccatgcccagataatttttgtgcttttttttttttttaagtagagatgtggttttgccatgttggtcaggctggtcttgaacatctggcctcaagtgattcacctgcctcagcctctcccaaagtgcttggattacaggcgtgagccactgtgcctggcctgcaataatatttaaaaaaaaaaaaaaaagtaagactagtcaattgcagcagtaagaattttttttttttttttttttttttttttttttttgagatggagtctcactctgtcgcccaggctggagtgcagcggcatgatctcagctcactgcaagctccgcctcccaggttcatgccattctcctgcctcagcctcctgggtagctgggactacaggtgcccgccaccatgcccagctaatgttttgtatttttagtagagacggggtttcaccatgttagccaggatgatctcgatctcctgacctcgtgatctgcctgcctcggcctcccaaagtactgggattacaggcatgagccaccgcacccagtcttttttttttttttttttttttttgagacggagttttgctcttgtctccaagactggagtacagtggcatgatcccagctcactgcaacctccgcctcctggattcaagcgattctcctgcctcatcctcccgagtagctgggattacaggcgcgtgccgccatgcccagctaatttttgtatttttagtagagacagggttttgctatgttggccagggtgatctcgaactccagacctcaggtgatccacccgccttagcctcccaaattcctgggattacaggcatgagccactgtgcccagccaagatttttatttatttatttgattttttttagagacagagtttctctcggtcatccagcctggggtacagtggcaagaccatagctcactgcagccttgaatccctgggctcaagcaatcctcctgccttagcttcctgagtagctgtgactatacatgtggaccaccacgcccgggcagttctaactttttctcatagagactgggcactaagttgcccaggatggtctcgaacttacaggctcaagcaatcctcccacctcttctttccaaagtgctgggatgacaggcgtgacccactgtgcctgaccaagataaatactgaatgcttagcgccaaatagcagatgaataaggagggctgatgtctgcagggtttaccccattgcgttgtacaacaggccttggcagccctaaaacaagcagacgggttgtttgtcaccgggatcaggagacagcagagctttgtcaagctgccttgctggggtgagctgcagtgggagttggactctcccacgacacagagacggatgcaagatccaggactcgcgcctccttggtgctctcctgctacctggtggcctcttctttcctttagtcctctgtccctcttccacttctctctgcctcctccacccgttcctgcaggcgtctggccatcaccttcgatgggtgcttctgttcatctttaccactctgaaccctccaaaatagcccccatgcaaaccaggacgtatatgacctcccacgggcaacaacaacagcggagtttacctacttcaattgcaagacgctccttggagggtagaaacagttctgggacaaacgcatttgatgtgaatgggccccactctctcctgatccacaaagcttcctgtcctgccctcttgagggccctgacctcatccttccctctcagtccagcctctctcgggagtttgacttgtatggtgcaaattgaaggcccacatagagtaagaatggatcttgatggggtcacagcacacctggactgatggcgagaagtccagccctgtagaagtagtcctagggccacaccatgacaattaatgtgcaaaacgtggccacccctctgaatggtgacaatggtgacaatagttggaccatcctccaacagcagacacccactgagtgcttaccctaccgggagggctgagtcaagctctctctacgcatgatcttgttgactcctcacaaccgctctgggaagtagatgcccctattccccttttacgaatggatcaccctaagctcaggaacatatccaaggacagcaggacaccaaggcccatccgatctcacagtgacagcattgagtcccacaccgcacagagggcggggctggcacactccccacagcgtggggaatctgcacttaattgcatagcagggagtgatcacacaagttctgtcacataccaacactgcacgcccctctggctcttccaccacgaagcacgtcctggtgatggacgcagggcagggagaggaggagagaggagacctcgggttctgccttccccagcccctctctgctgggcacatggagatccacctggcagttggcccctctgggccttgagccagtctggcacaggcaatgtaccgttcggtggcatctggacccatgtttgtgccttaagcatgacaggtggccctggctcaaacttcctgggctccttctccctgtttcctgatgggggaaaccctagttttgggcccaggctgggacctgggatggactcagatgctttggaaatgtatgttgggctggtgggtcgggcctcaccagaagcttgtgcacaggccaaggagcttccaggaaatcactcacccgtggaagggaggagccaggcccagtgagctgacctggaatagttagttacatggcctatcacataccaacaccgcacacccctctggctcttcagaccctgtggcatacgtagccagggagcaggaggaacctgggggtgcatatacgccataagtaaagatgagctgatttaccctataaaacagggcacagacactgctttggtgatgatagtagccaccagtagtccagagagagcagatgcagcctggtgaagccgtagcagccaatttgtttgagtgcacacatagacacagccttcagtgacatcttctcaggggctgtagcaaggtcagggtgagagctggccgggttatgactgccttcttcccatgagggcagcatgcaccagagaaaggacatgggctctggggagcttggttctttttttttttttttttttttttttgagacagagtcttactcccatcacccagatcacctaggcaggagtgcagtagcacaatcatggctcattgcagccttgacctcctggtatcaagtgatcttcctgtctcattttttttatttttggtagagacaaggtctaactatgttacccaggatggtttcaaacgcttggactcgagtgatcctcctgcctcagcctcccaaagtgctgagatgacaggcatgagccactacacctggccgggagctggattctaatctcattcgcaccacttccttgtgtgtgatctggggcaagttaattaaagactcttaaactgggatgtgaatgccgctgcctgctgtggtttaaaatatatccacaacaaactctttgatattcctccctttaagaggtggagcctcatcccctgccgttgaatgtgggatggaattagtggatcacttctaaatgataaggcaggggtgacactgtgtgaccttggggactggtcataaaaggcctgtgggttcctactttttccctcccttgctctcagatccctcctctggggaaaaccagctgctatgtcattaaaacagcactgtgttggccactggtgaagaccaaaccctccagccagcagccacaagaaggcgccatcttggaggtggctcctccagccccagttgagccttcagatgatagcagccccagccgacatcgtaaatgcaacctcacaagagaccccgagccagaaccacctggattaaaacgaccatgatgttcctgaattcctgactacagaaactgtgagataatgaatttttgttgttttaagctaatatgttttggggggtaacttgttacacagcaatcgataactgatagactcatctgcaggtacgtgccaggatttactgagccaacatacacaaggcgccagatgtccactggaccctcagtctgatcagctccttgccacactgaggtctcagcagccccttcctcatggcggcaaggtttggactgtggttatgcccactcagggtccggccctccagccaggttcctggctgccccctccttttccccaggcttgcctttcccctggccttgcccacgagagaccctgtcacactggggaggcctgtgctctcttctaaacaaaggatcaaagaaatcggtttgtatgctgttaaacatttaaaaaaattttttttaaagagatggggctcttactatgttgcttgggctggactcgaacttctggccttgagcaatcctcccacagcagcctcccaactacctgggacaacaggcacaccactgtgcctagatcatatcactttttgcacaaaacccttccatggtttccctttacccttacagtaaaaatcccaacccgtggccgggcgtggtggctcacgcctgtaatcccagcactttgggaggccaagacaggaggatcacgaggtcaggagatcaagaccatcctggctaacatggtgaaaccccatctctactaaaaatacaaaaaattagccaggcgttgttgcaggaagtcagggaccccaaatggagggactggctgaagccatggaagaagaaggtggattgtgaagatttcatggacatttattagttccccaaattaatacttttataatttcttatgcctgtctttactgcaatctctaaacataaattgtaaagatttcatggacacttatgacttccccaatcaatacccttgtgatttcctatgcctgtctttactttaatctcttaatcctgtcagctgaggaggatgtatgtcacttcaggaccctgtaataattgcattaactgcacaaattgtacagcatgtgtgtttgagcaatatgaaatctgggcaccttgaaaaaaaaacaggataacagcaattgttcaaggaataagagagataaccttaaactctgaccacccggtgagccgggcagaacagagcaatatttctcttctttcaaaaacaaatgggagaaatatcgctgaattctttttctcagcaagaaacatccctgagaaagagaatacacacctggaggtataggcctatgaacggtcccccaggtgcgcctgtcttttatggtcgagactgcaggggtgaaatagaccccagtctcccatagcgctctcaggcttattaggaagaggaaattcccgcctaataaattttggtcagacggttgatctcaaaaccctgtctcctgataagatgttatcaatgacaatggtgcccaaaacttcattagcaattttaatttcaccccgatcctgtagtcctgtgatctcgccctgcctccacttgccttgtgatattctattaccttgtaaagtatttgatgtctgtgacccacacctattcgcacactccctccccttttgaaaatccctaataaaaacttgctggtttttgcggcttgtggggcatcacggaacctactgaaaatatgatgtctcccccggacgcccagctttaaaatttctctcttttgtactctgtccctttacttctcaagccggccaacgcttaaggaaaatagaaaagaacctacgtgaatatcggggcatgttccccaatatctggcacccacgtggtctttcttttttcctaagtgcttgagggaacccgattccctttggtaggcgcggtgcaacgtcaattggcttggtccacagataacgcgtgttcgactccctgatgagtggtgagtagtctgtgtaaggtctgggttaactgcaggtcatgcatagtctaagctcgaacccgggaggcggagcttgcagtgaaccgagattgcaccactgcactccagcctgggcttcagagccagactccgtctcaaaaaaaaaaaatcccaacccgtgaccatggctacaagactcctataatataccccaaaccccatgatgtgaccattcatgatgttcttctctgtgccctgcaaactcaccagatcaccacactttgtttctctgatgcaaaccgttcttctacccgatcgtcacggctgccttctttcccgttgttctcatctttacttagtgtcaccttctcagagcatgccccaccccaggtcctcttgaccacaacacctcatcatttttagcaccagctaaaatatcctgtgtgcatgattattgtttgaagccagcccttgcacggaaactccttcagagcagagctctgctgtgcttgctccagggtctgggagagacacacagcagagatttgtgagctaataaatgtgtgagacacacaacagacacttgacaaatgtttgtgggctggagagctttttgatatcaatcacattcccttttaaaagctttggaggtgctccaggttccagaagagccatctggaaaacccttccatgaaggaagttaatcactttcagcccttcttccagagcaaagtgcttacaacctttcttagttgcatcatgatcattttaatccaggaaagttcttattaggggtttgcaaatgctggtgttctaaggggagctacatctttccctgatttagttccgggtaacacacatggactggaacaccatgattttttcccttgggtaggttttcatgtggggtctgtcaggccagctggccctctgtgcggaacaaggatccagtgactgcacggttgtaggccgcaaaccttttccccaggactgctgtggatttggggtcagtccaaggtatataggacaggcacagctggaaacacctatgggggacaccctggaggagcctttgacccaagggagccggtgggacttgaacaccaagtaggactctgagcaggggaaggcatgggctgagccacccagcagggatcccaccgccacggtggagctgggtcccaaaggctgccctgttaccggctggctgcagggaagtccaggggtccctggggtaggggatggaatggcagggaggcctctggggcctagccacattggagtattcacagatttcaacacctaaactagctgaaccggggctcgccagaccctgccttggcctccccactggccaaagacccggccgtcctctgcctgcttctccatgtccagccgcgctggcctccaatccactcctcgaagacactgtgctccctcggggcttcacacacactggctgttttccctaggagctgcccgacctgaaaacatccccctcttccttctgcaggcagttcctcgttccattcctctaggcggctttccctgacccctagactggtccagggaccctgctccccactcttgggtctagccttcctagcacatgcccagttgattgttttgttttgttttgttttgttttgtttgagacagggttatgctctgtggcccaggctggagtgtagtggtgagatctcagctcactgtaacctctgcctcctgggttcaagtgagtctcctgcctcagcctcccgagtagctgggattacagatgtgcaccaccgtgcccacctcatttttgtatttttagtagagatggggtttcaccatgttgcccaggctggtctcgaactcctgagctcaattgatctgcccacctctgcccgcctcggcttctgcctcccaaagtgctgaatgtgtccatttcataatcccacagtgaggacgtttcccactcaaccgactccagaattatttttctcactattctctcaccaacttctcattaaacagttgccgaatgaacattcgaatgaatggacagacccaaaattcacggcctcttgtgtatcccgtgaatccttctctggctatgcctcctggtagggagtttaccactcttgggggtctagaaaaacaggttctgtgtggatgctgggacctcaggcgtccttcccagggtagcaccgagagcccacgtgggctggctgtactggacaggagattctgccagagaacattaggggccaaaccgcaaagccccagtgtggaggtcccggctgttgcaggggaaagttgcccaagagacgcttggtgagctgatgagaccttttctcccagcgataagacctccttcggctcacctgcacctgtcttgcagcacagacgtgagagctacatctgtgaaacattgttggcgttgcctttacccaaacaatcaacctgctttgtctctccatccttttgattgttctaccaggattttttcccctatagaaagatttcatctttcctgagtggctggaaaggtggtaaaacaaacaaagtgttaaaaggcgtttaatgggccgggcgtggtggctcactcatgtaatcccagaactttgggaggccaaggcgggtggctcacctgaggtcaggagttcgcgaccagcctggccaacatggcgaaaccctgtctgtactaaaaataacaaaaattagctgggcgtggtggtgggcccctgtaatcccagcaacccgggaggctgaggctggagaatcgcttgaacccaggaggcagaagttgcagtgagccgagatcccgccattgcactccagcctgggcaacaagagcaaaaaaaaaaggcgtttaatgaaagagaatacactaaataataagtttgtgctatttcgtccttttcttagagccacggtaagaggtataggggagaggaaggagaagtggtcttttcttactcaattcttcaaatcgcctaaactgggaaggtattggccagatagtttccagaaggaactctcccgcagctgaaggcaattctcccagccttggcagctgcttggagtaacacgcacaccttcttggtgttaacctcctttgacatcgtgcaaatggccgatacttacctggttgcagtggggcccctgccacgcactgtcccgggcggagaggcatctttggcttgccgggtccgtgagctgccaatcatcatgcaggaaaccaactcgctggccagacctcctgcataaatgccctggagcagccaccagagcccagaagttggacagggcagggaggaagccgctggcagaatgaggaaaacctgttctgagatgggaggtgggaggtgggaggtgttgcgctgggaagggaaactccgtggaggggttgggtggtcctggctcatcttgacccttgcctgtctggaagggggatttttaaaaaactggatggaaattggacaagatgtacttgtttaatggggaaagatgaggtgagtgattttaagtgttagagaacaatctgggaaacctgccccttaaggaaaacctgatatgggggaaaattcccacaaagctgagaggaagcaggtgccagtctcgctgatgcagactggggagcatctttctctctgcagaatgtgctcaggggttcacccccagtctgtaattgagggtgaggcagggaagctgaaagcagcagcagcagaagtccgcccaaaggtggctgtgattccagcccggtcaagaacggcggatccactccttggcagggaactgcaagtcaaacccacagtgaggctgggctcgggggctcacgcctgtaatcccagcactttgggaggccgaggtgggtggatcacccctaaagtcagaagttcgagaccagcctggccaacatggtgaaaccccgtctctactaaaattacaaaaattagctgggggtggtggtgggcccctgtaatcccagctacccgggaggttgaggcaggagaatcgcttgaacccgggaggcggaggttgcagtgagccaagatcacaccagtgcactccagcctgggcgaaagagtgagactctgtctcaaaacaaacaaacaaacaaaaaacaaaaccacaatgagacaccaccttatgtccacgaggatgccacagtcaaaaccatggagaatgagaagtgatggcagggacgtgaagacatggcaacctttatgcacctttgatgggaatgtaaaatgacgcagccattgtgcaaaatagcatggccattccccaaaagtttaaacacagggttaccagcaactccactcctatgtatatacccgggagaaatgaaaactgccatccacacaaaaacgtgtgcaggcatgctcacaccagcattgcctttaatagcccaaagtggaaacaacccagatgtccgcaaactgatgaatagataaacaaaatgtggtctatccatacaatggaatattattcaaccataaatatgactgaagtcaggcacagtggctcatgcctgtaatcctagcactttgggaggctgaggcgggtggatcacctgaggtcaggagttcgaaaccagcctggccagcagggtgaaacccagtctctattaaaaatacaaaaattagctgggcgtggtggtgggcgcctgtaatcccagctactagggaggctgaggcaggagaatcacttgaacctggtaggcagaggtggcagtgagctgagatcatgccactgcacactagcctgggcaacagaggaagactctgtctccaaaaaaaaaaaaagcaggaagtagaagatgtatggttgtctggagttaggattggggaatggcaggattagggaagtgatagttaagagataatggtgtttctttttgggataatgaaaatgtcctaaagtggattgtggtgatggttgtacaactctatgaatatatgaaaagttattgaattgtatacttaaaagggtgaatcaggccaagcgcagtggctcatgtctgtaattctagcattttgggaggtcaagatgggaggatcacttgagcccaggaatttgagatcagcctgggcaacatggtgagaccccatctctataaaaataaaaactaaaaaaaaatagtgaatcatatggtatgtgaattatatctcagcaaaactgtttaaagaaaaagaggccgggcacggtggctcacgcttgtaatcccagcactttgggaggccgaggtgggcggatcacgacgtcaggagatcgagaccacggtgaaaccccgtctctactaaaaatacaaaaaattagccaggcgtggtggcaggtgcctgtagtcccagccactcggagaggctgaggcaggagaatggcgtgaacccgggaggcggaggttgcagtgagccgagatcgcgccactgtactccagcctgggcaatagaacgagactctgtctcaaaataaataaataaataaataaataaataaaagaaaagaaaaagaattttgggtcagggagtctgtttttagtctgtgtggtaggatctcctataatccctccagctgtctgtgaaatgattgacctggactggatagggctaacaataaaggaatttcttgttatagtaagtgcataagataagggtacaaattctactctgaggcacccatgaaaagtgagggctaggaaaaaaaatatcaccctgaacattcagactaaaaacaatcaatacataattgattgtgcaacaatctgcagtaatataagagacagcttaaaaagaaactgcaatagagaagaaattgaatcagtaattaataactttccaaaacagaaagtgccaggtccagatgggctcactggtgaattctactaaacactttaggaagaaattataccaattctctacaatctctttcagaagagagaaactgagggtatacttcctaactcattctacgaggctagcatcacgtttcctaacttattctatgaggctagcatcaccttaaccagacatcaccagaaagaaaaactacaaggcagggtacaatggctcttgcctgtaatcccagcactttgggaggctgacgcagaggactgcttgagctcagggagtttaaaaccagcctgggcaacatagtgagagctcgtctctactgaaatttaaaaaaaaaaaaaaggttgggtatggtggctcatgcctgtaatcccagcactttgggaggccgaggcaggcagatcacctgaggtcaggagttcaaaaccagcctggccaacatggtgaaaccccatctgtacaaaaaatacaaaaattagctggtcgtggtggctcaggcctgtaatcccagctactcaggaggctgaggcacaagaatcccttgaacccaggaggtggaggttgcagtgagccgagattgcaccactgcacgccagcctaggtgacagagtgagactcagtctaaaaaaaaaaaagaaaagaaaaattagccaagagtggtggggcacacccatagtcccagctattcggggggttgaggcaggaggattatttgagcctgggaggttgaggctgcagtgagccctgattgtgccactgcactccagcctaggcaacagagtgagaccctgtcttaatttaagaaagaaagaaaaagaaaagaaaactacagaccaatatatcttatgaacatagatgcagaaattcccaacaaaatattagcaaacagaatccaacaatgtataaatagaagtatacaccactaccaagtgggatttgtcctaggtatgcaagcctgattcaacatttggaaatcaattaatgtaatccatcacatcgacaggctaaggaagaaaaatcacacgaccatatcaacagatgttgttacacccttcacacaaattaacgcaaaatggatcccagaccatttgagttaatgcagtactataaaactcctagaagataacataggagaaaatccagatgaccttgggcatggcagtgacttttagaaaacaacaaaaaagatacaatccatgaaagaaataactgataagctggatttcattaaaatcaagaatgtctgctctgtgaaagacactttcaagagaatgaaaagacaagctacagacttggagaaaatatttgaaaaagacttatctgataaaggactgttatctaagatatacaaagaattcttaaaactcaacaataagaaaatgaacagatggattgaaaaaatgggcagaagatctaaacagacgcctcaccagagaagagatacagatggcaaataagcatatgaaaagatgctccgtatcatatgtcattagggaaatacaaattaaaacaacaatgagctgggtgcggtggctcacgcctgtaatcccagcactttgggaggccgaggtgggaggatcacgaggtcaggagatcgagaccatcctggctaaggtggtgaaaaccccgtctctactaaaaatacaaaaaattagccaggcatggtggcacgtgcctgtagtcccagctactctggaggctgaggcaagagaactgcttgaacctgggaggcggaggttgcagtgagcggagatcgtgccactgcactccagcctgggcaacagaacgagactacatctcaaaacggtgtcgcagtttcttacaaagctaaacatacccttaccataagatccagcaatcacactccttcttatttacccagatgagttgaaaatttcagtcaacacaaggatctgcacatagatgtttatagcagcgttattcataattgttaaaacttggacacacccaagatgttcttcagtaggtgaagggataattaaaccttggcatatccagacaacggaatattattcagtactaaaaagaaattcaatggactattattcagtgctaaaaagttatcaagtcatgaaaagacatggaggaactttttttttaatacaaattttaactgtattaaaatagagatggagtcttaccatgttgcccaggctggtctcgaactcctgggttcaggcaatcctccagcctcagcctcctaaagtgctaagattatagatgcaagccaccacacccagccattttatttatttatttatttatttatttatttatttatttatttatggagatggagtctcactctgttgctcaggctggagtgcagtggcacgatctctgctcactacaacctctgcttccccagttcaagtgattctcctgcctcagccttctgagtagctgggattacaggtatgtgccaccatgtctggctaatttttgtattttagtagagatggggtttcaccgtgtaggtcgggctggtctcgaactcctgacctcaggtgatctgcccgccttggcctcccaaagggcagggattacaggcgtgagccacagcgcccagccattgacgaaccataaacgcatgttactaagtgaaagacaccaatctgaaaaggccacatagtatatgattccaactatacaacattctggaaaaggcaaagctatgcagatatggagacagtaaaaggatcactagtttctaggcgttaaaggagagagagggatgaataggtgatgcacagaggatttttagggcagtgaaactactctgtatgatacggtagtgatggattcatatcattatatatttgtccaaacccataggatgtacaacaccaagagtgaaccctaatgttaactgtggacttcatgaaggtgtgtcaatgtagactgattctatctacctacctacctacctacctacaaggtctcgctctgttgcccagggtggtcttgaattcctgggttcaagcaatcctcttgccttggccttccaaagtgctgtccagtgtaggtttattgactgtaacaaatatgccactcagggcaggatattgattgtcagggaggttgtatgtatgcggggaaatgggtatgtgagaattctctctactttctgctcaattttgctgtgaacctaaaacaacaacaaaaaggaagggaaggaaagggagagggaagggagagggaagggagagggaggggcaggccgggcatggtggctcatgcttgcaatcccagcacttttgggaggccaaggcaggtggatcacttgaggtcaggagttcgagaccagcctggccaacatagtgaaaccctgtctctactaaaaatacaaacaaattagctgggcatggtggtgggcacctgtaatcccagctacttggcaggctgaggcaggcgaattggttgaacctgagaggtggaggttgcagtaagccgaggtcgcaccactgcactccagcctgggccacagagtaagactccgtctcaaaaaaaaaaaaaaaattagccaggcatggtggcgcgtgcctgtaatcctagtgctcaggaggctggggcaggagaatcacctgaacccaggaggtggtgtgagcccagattgtgccaccgcactccagcctgggggacagagcaagactctgtctcaaaaaaaaaaaaaaaaagaaaaaagaaaaaagaaaaaaaagtgcaacttttgctcacttttcaacagcaacaatggaagctagaagtagtagaataatctcttcaatctgttggaaagaaaactaaacaacacaacaacagcaaacttgccaaactagaattttactcagtggaaaagttcttcagtaaagagaagtctagggtgttcttcaggcagaaggaaaaattgtcccagagaggaggttggggatagaggaaggaatgaaaagggataaaaatgtctcactctgttgcccacagtggcacgatcttggctcacttcaaattctgcctcctgggttcaaatgatcctcccacctcagcctcccaagtagctgggattacaagcatgtgccaccatgcccgactaatttttatatttttagtagagacagggcttcaccatgttggccgggctggtcttgaactcctgacctcaagtgatctgcccgtctcggcctcctaaagtgctagaattataggtgtgagccaccacgcccagccgcttattgtaatttttagaataattgctaaaaatggtaaaaaaccagaatagctctcaaactaacacaggaacaaaatgaaaatgtaaaaatgcaaccaaactaaacaaagccaaaaatgagataaaagaacagagaaggccaggagcagtggctcatgcctgtaatcccagcaatttgggcggctgaggcaagtggatcacttgagatcaggagttcgagaccagcctggccaacatggtgaaaccacatctctactaaacatacaaaaattagccaggcgtggtgacgggtgtctgtgatcccagctactcaggaagctgaggcaggagaactgcttgaacccagaggcagacgttgcagtgagctgagattgcaccattgcgctccagtctgagcaacagagtgagacgctgtctcaaaaaaaaaaaaaaaaagaaaaaaaaaaataggacagagaataggtgatgaatagaaagcccattcatggcaaactgcatatcagtaattacatgaatggtaagtgggttaaatgctccagctaaaagacaaagattgtcatactggatagacaccaaatccaacaaatattaaatacaagaaacacgtgtaatacttagagataaagcaagactgaaaggaaaataataaagaagtatacactattgaaatactattaggacagccagtgtagtaaattccaatgtcaagcaaatgtactttaaaatgaaaaaaaaaaaaaaaagcgtctctagaattaaggagggtcaccctataataataaaagattattttaaatttgtatgtacctaattacatgatacatagagcaatgtgaacagaattatatggagaaacagacaagtccatattcatagtgggatgtttgacacagctttttcagtaatcaatggaacaggcagacaataaatcaataacactgtagaagatttgagacatcataatgaacaatcttgttgtatgaacatatggagaactgtgcacccaacaagtgaaaaatatgttattttcaaaaagatatcatccattttaaaatacgatgatctgctgggccaaaacgcaagtttcaacacatttcaaaggattaaaatacagcagataatgttatcctaacatattgcaaatagtttaagaatcgataataaaaatattaaaaagtccctgtacctttgaaaactatactttcgagtaacgtgcttctaaaatatacttctaaataatgcatgggtttcagaacaaataaaaacggaaatttgaaattactttgaactatactatatgtaatgaaaaacaaaatacaacaaaacttatggagtaaagctaatgcagtgtttggggggaaatttatagccttaattgcatattttagggaagaagaaagacttaaaatataatgagctaagcacattcattttaagatgtcaggaaaagaacaactaaagaaacccaacaaaaatagacaggaggaaatgatttaaatatataataaagtagacaggaggaaatgatttcaatgtataataagtataaaaacaaacacacaacggagagaatcaacaaagccaaaactgaaaccactaataaaattggttaatccctaaagagaatgattaaaaggaaacaatttgacagttttcacaaaaggcatctgtgaaaagaaaaagaaaatagaaaaggaaaaggctgggcgtggtggctcacgcctgtaatcccagcactttgggaggctgaggcgggcggatcacctgaaatcaggagtttggcaccagcctggctaacatggtgaaaccccatttctactaaaaatacaaaaaattagctgggcgtggtgatgggtgcctataatcccagccactcaggaggctgaggcaggagaatcgcttgaacccgggaggcagaggtttcagtgagctgagatcgcgccattgcactccagcttgggcgacaagagtgaaactctatctcataaaaaagaaaaggaaaaaaaaaaaagaaaagaaggcacaaataacaaatacaagaaataaaaaagggacttcaccacaaaataagagtatattatcgaaaactttaagccaacaaacttgaaaatttggtgaaatgaacagattcacagaaaaatacaacctaactgacacaataagaaatagaaaaccttagtccttgggcaggtgcagtggctcacacctgtaatcccagcactttgggaggccgaggcgggcggatcgcctgaggtcaggagttcaagactagcctggccaacatgatgaaaccccatctctactgaaaataacaaaaattagctgggcgtggtggcgggcccctgtaatcccagcaacttgggaggctgaggcaggagaatcgcttgaactcaggaggcgcaggttgcaggagcagagatcacaccattgcactccagcctgggggacaagagcgagacaaaaaagaaaatcttagtcctgtaactatcagagaaattaaactgtaatttaaaaaaatcctatgataaaactcagagcctaaattccttcattagggaatactactaaacactgaagaaagaaataaagctaagttataacatactttttccagaaaggagaaaaagaatcatggactaattttgggagactagcataacctttatactaacagccaacgagaacagttaaaaaaaaaaaaaaagaaagaaaaatacagattaatttcactcattaactgcaaaaatcctagacaaaatattagcaagtcaaatcaagcaatatataaaaggattatacataatgaccatattggatttattccaggaatgcagctttggtgtaacattaggaaatcaatggacagaattcaccatgttaatagattgaaggaggaaattcagccggtgtggtggctcatgcctgtactttgagaagccaaagtgaagccaagtgttttgagaggccacactgtgaggacagcttgaggccaggagtttggaaagagcctgggcaacatagtgagaccctgtttctacaaaaaattagctgggtatcatgatgcatgcctatagtcccagctactcaggagggtgaggcgggaggatcgtttgagcccaggagttcaagtttacaataagctatgattgtaccactgcactccagcctgggtaacaaaagaagaccctgtctcttaaaaaaaaaaaaaaaaaaagggtataaagggttaggaagttgggaaaaaaattaccaaaagagtctttttttttttctttaagacagagttttgcttttgttgcccaggctggagtacaagggcaagatctcagctcactgcaacctctacttcccaggttcaagcaattctcctgcctcagcctcccaagtagctgggattacaggcgtctgccaccacgcccagctaatttttttttttttttttttttttgagacggagttttgctctgtcacccaggctggagtacagtggcacgatcttggctcactgcaagctccacctcccaggttcgcgccattctcctgcctcagtctcccgagtagctgggactacaggtgcccaccaccacacccagctaatttttttgtatttttagtagagacggggtttcactgtgttagccaggtctcaatctcctgaccttgtgatccacctgcctcagcctcccaaagtgctgggattacaggtgtgagccactgtgcccggctaatttttatatttttagtacagacagggtttcaccgtgttgatcaggctggatggtcttgaactcctgacctcaggcgatccacctgccttggcctcccaaagtcctgggattataggcgtgagccactgcacctggcccagagtcattattcttatatactgattctatatgaagaaaatccaaaagaatctactgataaacattacagttaaaatattttagcaaggttaatggatatagagtcaatatacaaaaatcaagagcattccaatactaaacagaaaaatacatttaaaacagatttgatctacaatacctttaaaatatgtcattgcctaggactaaaactagcaaaagatgtgcaaagacctctaaataggaaataaaaaattaagttattacaagaaatttaaaaagacctcaaaaaatggagagatataataaaacatccattgataagaagactcaataatgaaagtacatcaattttcggactgatctatagatccagtgcaaccccagtgagcatcccaatagttcttttaaaaaaatacaactgggcaaactgactcccaaaaacataaacaatcaaaaagtccaggctgggtgcggtggctcacatctgtaatcccagcactttgggggcctgaggcaggaggattgcttgagcccaggagtttgagaccagcctgggtaatataggaagacctcgtctctacaaaaaatttaaaaattggctgggcttggtggcacacacctgtggtaccagttactcaggaggctgaggtgggatgatggcatgagcctgggaggtttgagtctacagtgagccgtgaccacgccactgcactccagcctgggtgacagagtgatacactgcctcaaaaaaaaaaaaaaaaaagaaaaaaaaaaaaaggaccagatcagttatctgttttgccattttctaactctgtgaccttggataagatacttaacaactctgagcttgactggcacgatccccaggcataaagggggatatagttttatctcacagagttttggaatgagtacggtggagaaacagtaataacatgggactaggccagccatggtggctcacacctataatcccagcaccttgggaggccaaggcaggcaggttgctagagtccaggagttcgagaccagcctgggcaacacagtgagacacccatctctacaacaaaattaaaaaatcatctgggcatgctggcgtgcacctcagctacttgggaggctgaggtgggaggactgcttgagcccaggaggtccaggctacagtgagcagtgattatgccactgcgctccagcctgggtgacagagccagatcctgtctcagaaaacagaaacaaaacaccaaaaatacatgagattaactagattgtgatatgtttgtaccatggaatacataaagcggttaaaatgataggataactacctcaaaaataaaaagttctcactctgtcgcccaggctggagtgcagtagcaccatctcagctcactgcagcctctgcctcctgggttcaagtgattctcctgcctcagcctcccagcctgggattacaggcacccgtcaccaggcctggctaatttttgtactttttcagtagagatgggattttaccatgttggccaggctggtcttgaactcccgacctcaggcaatctgcccacctcggccgcccaaagtgctgagattacaggtgtaaggcaccatgccaggcctcaaaaataaagtttttaaaaatgatagtgtggatctgtatatccgcatataaggaaggaactccatgacacataagggaatgaacaaagcgaatcccaattcagtatcagtgtgcctcaatcctcatgcatcagaatccctgtgtgattcgcgtctcattgttctccagtgagacccaggcactggcatttaaaaacaaactaaaaacaaacaaagaaagcaaacaacagttattgtcatatgcagccctgcgctgagaacccgtggtaataaaaacagctacagctattattttggacttacaatgtagccgacatggttctgaacactttgtttacagcaactcactgaatccttacaacaactccaggaggaaggttcgattctcaccacccccccattcacagataagaaaaatgaggctcagagagtttacgcagcttgtttataatcacgcagctagtggatggtgggggtggcacttacgggatccaggcagagcggctctaaaaatctagcagaattccatgcagtggtagggagggaagaggagagtagaatttagggattttcaatgtgagtcggcaggggaggggcccaggaatctaatgatccccagatctggaaacctggggcattgactcccaactccctgataataactgcctggggcattctttaactgtaggattccagggcatcttggagattctgcttcctggatctgaggcagggcctgggaaccgtcatgcttagcaagggtcccacgggggcccagcttcacagacctgggcagccacagacagctcaccctgaaggggccatgcttgcttcaaacctctgctgtcgacagcctgaaattctttttttttttttttttttttttttttgagacagattctcattctgttgcccaggctgaagtgcagtggtgcgatcttgactcactgcaacttgtgcctcccaggttcaagcgactctcgtgcctcagcctcccgagtaactgggactataggcatgcaccaccatcgcgggctaatttttgtatttttagtagagatggggtttcaccgtgttcgccaggctggcctcacactcctgacctcaagtgatccgccccacttggcctcccaaagtgctggattacaggtgtgagccaccatgctgggctgaaattcttaataatgtaatcttcgaatgtgtgttttgtaagtgatgggacagtgtgatgtgcaccaggggcttggggcctaagtacctgtgatctcagcccctaccctctctctgcctccctgggaaggctctccctggcagtccccccacacctggatgccccaggcttggttcccctacctgcccctgccttgtgcactgccatgttctgccctttatcctttgtccccagagggcctgggcacaagtgtgggaaggactggactcaggtgtgctgcctgcaaccttgtggggttgtggccattcctgccccaggctggcagcgcccagcacatatgtcttggtggggttggtgagccccgcgcatcttggcacagatgtttaaaaatccctgggggtccctgtctgcaatgcaatggggcagtgagcatataggagaagagatgcctggctcgacctccgcagagggtccccacacaccctgcctgagctccatgcctgggggaccccctcttcctccttccaccctctctgagttaggcctgcatgggtctcttccagtgtacccaaggacaaaagcacaacacaaatggtgtaatttctgtgattctgcacgcaagttaaatgctctcatatttgcacttaaaactggcattgcacgatatatggatgaacagtaaagttcatgctgataatttacaattttatttttctttacgtagaacgacattaaataagaataaaaaaatacaccatgatgagtcaagggagagagaccacagaaaaaaggaaaaaagtttacacgttaatatctttcacagcacttcgttctaacttaaaaaaatttttttttcagatggcatctccttctgtcgctcaggctagagtgaggtggcatgatcatagctcactgcagcctcaactgcccaggctcaagggatcctcccacctcagccttccaagtagctgggactacaggcatgcaccactatgcctggctaatttaaaaattttttgtagagacgggggtctccctgtgttgcccaggctggtctcgaactcctgggctcaagcaatcctcctgcctcatcctcccgaagtgctaggattataggtgtgagccactacacctagcctgttccaactttttgaacaaggagtccttcatttttgttttgccctgggccccaaaaattatgcaactggctccaatctcagggattcttattgtcagggaagttcaagaagctgttcaggaatacggccgggcacggtggctcacgcctgtaatcccagcacttttgttggccgaggtggacagaccccttgaagagctcaggagttcgagaccagcctggccaacatggtgaggcagaaaatacaaaaaattagctgggtgtagtggtgtacatccgtagtcttagtcccagctgcttgagcggctgaagcgggaggatggcttgagcccaggaggcagaggtggcagtgagctgagttcgcttcattgagctccaacctgggtgacaaagccagactctgtttcaaaaaaaaaaaaaaaagaaactagaggaatatggattggagaagactctaaatttgtgtctgtgtgttatgctgagcattttagttaaggacactactgtagcatctcagcttccttgggctccccagctacaagggcatatccaggaagacaccacaggctccaaccgccttccttatggtcaataggcagcaagccaggctctggagatggagctggggtggaggcgtctcaggctagtgggcaagtactctcgaagggccagccaggggtgctcagtatttggcttgggtggacactggcctggggagaagggtagctgcaggccctggataaaaggcactgggcaatttttagccagctgtattatttacatatgtataaatggatagacatagatgtaattttgcctgaaaaaatacagtgtaccctatttaattaattaattaatttttttttgaggtggactatcattctgtcatccaggctggagtgcagtggtacgatcttggctcacagcaacctctacctcccaggttcaagcgattctcctgcctcagcctcccaagtagctgggatcacaagcacatgccaccatgaccggttaatttttgtatttttagtagagatgggggtttcaccatgttggccaggctggtctcgaactcctgacctcaggtgatcctcccgcctcggcctcccaaagtgctgggattacaggcgtgggccactgcacccggcctaaatttgaatttcaaatgtcaaattttttttttttagtgtaagtatatcccaactcatgcactatttgggatatacttatactacaaaaattattcattgttgatctcaccctcatagttacatatacaccctgtatttttatttgctaaatctggcaacatccactggacaggaaattcaaagatccagattctagtcctggctttgcgctaacgaggagttggagcaaagagggtactgcttctcaggcctctggttaaaagaagcccctctccacctccctcactgcctccaccatccagggtgagagaggtaccgtcagacacgccagagctagaccccaagcggatgctttctagggcaaggtgagattttgcaggaaaggagtgcataggcgtgcacaggggacgcgcgctaagcgtaaggcggcgttctcaatgcttagcagtgcattgggatcgcctggtgaacgggaacgatactgacggccagcgcccccactcccaattcgactggtctaaagtggggcccagatacttgtcttttttttttttttaaagttccacagtgactccgctgtgacctgcacagttaagaaactgcaggagtccgggcggtttccaaggatgggtcaggggctgaaggcggtctgtgcaattggccccgggcttgccgagctggaagagcccctgagtggcactggagccacttccgcctgcatgaagaaaggggtgccgggaggactgaggagggactaggaccccatccctgttcctgagccagcgcccgtcccacctctggcacggtgcctccagaaacccaacagggggagcgcctggaccccaggcaggacgccgcgtgggggacgctggctgtggacccctgtcccgagggcggccagaggctggctctgaatcccaggatgcccaggccacgctcgctcagtcccggagcttgggacttctgaagacgcggggcctcgtttggggtcgcaagtctgagcgctccggctctggttggcgctaggtggcgcccgagagcgcgccaggctcaccctggggagacctggggccagccggggtctccctgctctggcgcaggcagatcatcgacccctgcgtggcgcagttacaggatccttgggcggtgccatgcaatgccttctcaaggcccagcacttcgcccgatccctgggagggatggacagtcgtgcgccccatagaggtttgggtcaacagcctgcatataggaccgtggtcccataagattttcacggagctgaaaaattcttaacattcttatggcctagagacttcataggggaacgcattcctcacgagtttgtggtgatgctggtgtaaaccaacctacagtgctgtcagtcatataaaagtctagcacatgtaattatgcaccgtacataatactcggtaatgataataaacaactgtgttactggcttaggtatttactacactatacttttttcatttcattttgttttgtttttatagagacagggtctcactctgttgcctaggctggagtacagtggtgtgaccatagctcgctgcaggcttggcctccggagctcaaacaatccttctgcctcagcctcctgagtagctgagactacaggtgtgcgccagcactcctggctattttttaaaaatttttagtagagacaaggtttgacgaagttgcccaggctggccttgaactcttgagctcaagcgatcctctgaccttggcctcccagagtgctgggattacaggcctgagccatggtgcctggtccttattgttccttagagtgcactcatatttttttacagttacccgtaaaacagcctcgggcaggcctttcaggaggtattctagaagaaagcattattatcacaggagatgacagtctgcatacacattgcctctgaagaccttccagtgggacgagatgtggaggtggaagacagtgacattcatgatcgtgaccctgggtaggcctaggctaatgtgtatgtgtgtcttagtttttaataaaaaagtttaaaaagtttaaaaaaaattaatagaaaaggctgtccaggcacagtggctcctgcctgtaatcccagcactttgggaggccaaggcgggcagatcacctgaggtcaggagtttgagaccagcctggccaacatggtgaaaccccatctccactaaaaaatacaaaaattagccgggcatcgtggtgggcgcctgtaatcccagctacttgggaggctgaggcagggagaattaattgcttgaactcaggagacggaggttgcggtgagccgagatcgcgccacagcactccagcctgggcaacagaatgagactccgtctagaagaagaagaaaaaagttaatagggccaggtgcagtggctcacacctgtaatcccagcactttgggaggcagaagtgggtggactgcttgagctcaggagtttgagaccagcctgggtaaggtggcgaaaccctgtctctacaaaaaatacaaaaattagccgggagtggtgatgtgcatctgtagtcccagctatttgagaggctgaggttggaagatcgcttgagcctgggagatgaagcctgcagtgagccaagactgtgccactgcactccagcctggatgacagagtgagaccctatctcaaaaaaaaaaaaaaaaaaagctaatagaataaagacataacgaaaataaatatctttgtacaatgtgtttgatgtgtttgtgttttaagctgtgttttacttttttacaaaaaagtaaaaaagttaaaaaaattaaaaagtttataaagtaaaaaagttctagtaagctaaggttaatttattactgaagagaaagaaccaaattttattttattttattttattttatttttttgagatggagtcttgctctgttgcccaggttggagtgcagtggcgagatctcggctcactgcaagctctgcctcccaggttcacaccattctcctgcctcagcctcccgagtagctgagactacaggcgcccgccaccacaactggctaattttttgtatttttagtagagacggggtttcaccgtgttagccaggatggtctcgatctcctgacctcgtgatccacctgccttggcctcccaaagtgctgggattacaggcgtgagccactgtgcccagccaaaagatcaaatttgaaataaacttagtgtggtctaagtatacagtgtctatagcgtctacagtggtggacagtcatgtctgaggccttcacattcactcaccacccacccactaaccaagagcaacttccagtcctgcaagctccatttatggtaagtgccctatacgggtgtgccatttttaatctttatttttttaagatggagtctcactctgttgcccaggctggggtgcagtggcgcaatctcggctcaccacaaactctgcctcccaggttcaagcggttctcctgcctcagcctcctgagtagctgggattacaggtgcccaccaccatgcccagctaatttttgtatttttagtagagacagagtttcactatgttggccaggctggtctcgaactcctgacctcaggtgatccacctgccttggcctcccaagtttctggtattacaggcgtgagccactgtgcggcccatttttaatcttttatactgtatttgtgctgtgcattttttatgtttagaagtgtttggtcatcagagaaatgcaaatgaaaaccacaatgagataccatctcacaccagttagaatggcgatcattaaaaagtcaggaaacaacagatgctggagaggatgtggagaaataggaatgcttttacactgttggtgggagtgtaaactagttcaaccattgtagaagacagtgtggcgattcctcaaggatctagaactagaaataccacttgacccagccatcccattactgggtatatacccaaaggattataaatcatgctactataaagacacatgcacacgtatgtttattgcggcactattcacaatagcaaaaactcggaaccaacccaaatatccattaatgatagactggattaagaaaatgtggcacatacacaccatggaatactatacagccataaaaaaggaggacgtcatgtcctttgcagggacatggatgaagctggaaaccatcattctgagcaaactaacacaaggacagaaaaccaaacactgcatgttctcactcataggtgggaattgaacaatgagaacacttggacacagggcagataacatcacacactggggtctgtcatggggtggggggaggggggagggatagcattaggagaaatacctaatgtaaatgacgagttaatgggtacagcaaaccaacatggcacatgtatacttacgtaacaaacctgcacattgtgcacatgtaccctagaacttaaggtataataataatgataaagaagtgtttagatacacaatcacttaccattttgttacagttgcctacagtattcagtggggtaacaagctgtacaggttggtagcgtaggagcaataggttacaccatgtggcctaggtgtgtggtaggctgtgccatctaggtctgtgtaagtgcaccctgtgatgttcacacaatgacggaattgccttatgtcgactttctcaggtgtcaataagcaacacacaggctgggcacggtggttcacgcctgtaatcccagcacttcgggagtgcgagttgggcggatcacttgaggtcaggagttcaagaccagcctggccaacatagtgaaaccccgtccctgctaaaaatacaaaattagccaggcgtggtggcacacacctgtaatcccagctacttgggaggctgaggcaggagaatcacttgaacccaggaggcggaggttgcagtgagatgagattgtaccactgcactccagcttgggtaacagagcgagactccacctcaaaataaaaaaaaaaaaaataaagcaacccacatctgtaattgatctgtattacctcccttccattctgtctgctcttgaaagggtccaaatggcacatctatcttgtcaggtcatgcacatctgcgttaggcaaatctggaagattcttcaaagttttcctgtttctccctgtcagttggcaacaaaaatcacatattttaaaaaacaggaaatttatcagaacagactcaaataagtgtattttctatgttaatgttgatgcagggcaggtgagcccccaaattggggcttagcctgggagggttcttggcttcacccaggaaagaattcaagggcgagccggtggtgttagacagcaacttatattggagcggcagtgtccagcagcagcagagggactgctccctgccacacagggctactccataggcagtgtgcccagagtagcagctcagaggcagtgctgccatcatatttatacccacttttaattacatgcaaattaaggggcagattatccagactctaggaaaagggaggtaacttctgggtgctgggtcattgccatggaaaggggtggtaactcccagatgttgccatggccgcggtaaaccgacccggtgcactggtgggcgtgttttgtgaaaatctgcttccacccagtccctgttttagctggtcgtcaatttggtctgcatcaggaatcaagtcccacttcctatctcaatgtgatgggagaggagacccccaatgaggactttgagacattacaaaatgttggctaggcgcggtggctcacacctgtaatcccagcactttgggaggctgaggcaggtggatcacttgaggtcgggagtttgagaccagcctgggcaacatggtgaaaccccgtctttactaaaaatacaaaattagacaggcgtgggggcataggcctcaagtcccagctactcgggaggctgaggcaggagaatcacttgaacctgggaggtggaggttgcagtgagctgagattgtaccactgcactccagcctgggcaacagagcgaaactccatctcaggaaaaaaaaaaaattaatcaagaagaatccaggctgggggcggtggctcatgcctgtaatcccaacactttgggaggctgaagcggacagatcacctgaggtcgggagtttgagaccagcctggccaacatggtgaaatcccgtctctactaaaaaataaaaaattagttgggcatgttggtgcacacctatactcccagctactcgggaggctgaggtaggagaaccacttgaacctgggaggcggaggttgcagtgagctgagatcataccattgcacccacagcctgggagacaagagtgaaactccatctgaaaaaaaaaagaagaagaagaagaagaagaagaagaagaagaagaagaagaagaagaagaagaagaagaagaagaagaagaagaagaagaagaagaagaatccaattttcttcaacattatcttcatttagagttctttaattattttttaaaaaatagaacaagggatccattcctcatgcttctactgatggcagctctccctaaagcaggacattccaaaaacaaacaaaaaagcaacagccaaacatacatggaagtaagatggtctctcaaagctctgagaattggaaaggtttcctttcaagaaacttgagttagcttttggaaaacgatcttttgtatgttactagatatttcttttttttcctctccccattttacttaaataacttattcaattaacatctatttgccaggcttcaaagtcagatcctggaagaaatacaaaaaagcagcaaataatgggaaaccatcccggcctgtaggaaactcactaactcggtagaaaggcaggcttgtaaatgacaccaatacagcgtgcttgggatttcatgggatcacatgtattttggtgtttggaagcacagaggagcaagtattaattttttaaacttagtataatgaaaaatttcaaatataaaccaaaataatagtataatgaatcctgttacccatcacccaacttacaaaataattatcctattgccaactgtttcatctcggccttactaccttgcaggttacttttttatttttacaatgttttttagatatagttacatatagtaaaattcacccactctcaatgtataaccaatgccttttagtaaatttgtagagtcatgtaaccaacatgatccaatttttagaacatctccaccatcctaaaaattttactctcaacttgtgacagttctcctcccttgccccagcaaccgttgatctttctgtctctatagatttgccttttctggacatttcatatttctttttttttttttttgagacggagtctcactctgtcgcccaggctggagtacagtggcaccatgtcggctcactgcaacctccccctcctgggttcaagcgattctcctgcttcagcctcccgagtagctgagactacaggcacctgccaccacgcccgactaatttttgtatttttagtagagatggggtttcaccatgttgtccaggctggtctcgaactcctgacctcaggtgatccacccaattcagcctcccaaaagtgctgggattataggtgtgggccactgtgcctggcctctttttttcttttttttttttttggagtgcagcgtcacaaacatggctcactgaagcctcaacttcctgggctcaagtgatcctcctacctcagactgctgagtagctggggctacaggcacacgatgccctgcctggctaattttttagtttttgtagagatggggtctcactgtgttgcccaggctggtctcaaacttctgggctcaagggatcttcccatctcagcctcctaaagtgctgggattacaggcatgagctactgtgcccagactcaccttaatttttaaaaatgttcatggtggaggaaggggcaggaacatccaccagcaccagccagggttctctgaaaaaggcgctgaatattttgctcagctctgtgcttctgtgctcgagccaaccacacgtatacttgaacacgaaggaatgtgcttgagcattaaggaatgtaagccacaggctcatgcctggctgccttccaaggagtcataatagtcacggatatctgcttccagaggcagatgcggcttgagccctccccgagaagtggggtgtgggaagaggaccctgtttctgatgcaagttctggaactgaggtggattctctatcaaggcacagagaggaaagaaaccttagtctaattcccaggttggccgtcactccctctgtgccttacatatgcctgagcctttatatgccttcctggaaaatgggattccttgcattttactgaattttagaacattttattagaattaatatactggttgctgaggggttgttggaaccccaggaatccatcacagtgagatttattccttccggttctagcacattttgatttaatgagtattgcctggtgcttgagatcaggtctggtgctggagtcgtaggggccacttgtgtctctggatggaggaggcgccaggaccaggagctgcggtaggaggagcacggcccaggcccttggggacacccctgcagcaggggaggcagtgcagacgcagggaggccgagctgcagtctccgctcggggtgcagcgcctacaggaatctttggaggctcggcacaggtcgaggtcaccccagccagagtccccaaagccctaagtccgtgtaaagaaacccaggagggcttccaagccagcacggacggccgaagatcctccagggcttgcggccactgcggttccatctgcctgtgcggctcccacctctaactgtggccaccgtcttcccagtgccccatagtttgctcatggggagattcctggtgatcataggtcctctgcagctatctgaagggtgagttgatgaatgaacagacaggtgaatggaggatgaccacgacagtttctggagggccacaggttgggctgggctgggcgccttgagaacacgtgggttcttgtttctcccggaggtctggcattccctggtagcatccagaaggccgaatgcacctgagtgtgctctgccttccctcttagtctaagccttattatttgtttaattattaattattattattattatatgttttttaaagacaggctctcactctgtcacccaggctggagtgtagtggcgccctcatggctcacttcagcctccaactcccaggctcaagtgatcctctcacctcagcctcgaactcccaggctcaagtgatcctctcacctcagcctcctgagcagctgggactacaggtgagcaacaccatgcctggctaatttttttttttttttttttaatatacagatggaatctcactgttgctcaagctggtcctgaactcctgggcttaagcgattctccggcattagcttcccaaaatgttggaattacatgtgtgagcctccacgctgggccccatagcctaagtttttttaaatgtaattttttttgttgttgtttattgagacagtctcgctctgctgcccaggctggagtgcagtggtgtgatctgggctcactgcaacctctggctcctcccaggctcaagcgattctcctgcctcagcctcctgagtagctgggattacaggcactcgccaccacgcccagctaatttttgtatttttagtagagacggggtttcaccatgttggccaggctggtctcaaactcctgacttcaagtgatccacctgcctcagacttccaaaatgctgggattacaggcatgagccacctcgcccatcctcaatatatatttttcactgagatctaaatcacataccatagaattttaatgtgtacagttcagtggtttttagtcttttcacaataaattgagtttttgagtagacaatgcattcatatggcttaaaattcaacgattaccaaggaatatacacggaaacatcttccttccccgcatcccgcatacatagatcatattatctatttcttgactatactcatagatattttatgcaaatacaagcaaatgtattccgtccctttttaatctacatggtggagaactatatgtactgttcagcatcttgcttttttacttaacttggaggtcctgctggtaccgagctttctcattccttctggtggctgcctggtattctagtctatggatggataaatatttattgatggatatttaggttgttgctacacctcagcttttgcaaacaaatgctgcaaagaagaacctggtgcatgagacattttgcatgttcgggcagatctgtagaagtaattcccagaagggcgcatgttttttacattttgacagttcttgctaaatggccctttatagaggttacaccagttttaattcccatcagaatttatttccaaacctatcatgagatacgccagcactgacaagaatcctcactgcggcattgttcatcgcgccccaaactggaaacagctcaatcgatcctcagcggaacggagaaatcatggcctcttcacgcgatgaaatattatgctgcaatgaaaagaaacaaaattctgctgcacacggcagggaggaatctcctaggcggattgatgagtgaaagaagccagacacagaacggtccttactgcatgatttctgtgatatgactcaaccccgaagtcaaaaggaagacgcaatctaggatgacagtgatggaaacagaggtgacccttgggcggcaaagggagtctgctgagcgtctagaaacgtcgtatatcttgttcggagtgatagctgtatgggtgcatcagtgtgtgaaaactcaccgagctacgtgcactttactgatggaagttgcaccccaacaaaaacttaaagggtttaaaaatattgcccacactgacgcgcaaacaacacgaccgccccagcaggcagactcctccgatgcaaaagcttaggtgacaggctgtctttcttttgtccagtcctgagccagatgtgggttctgggccaaggaggtgaagcacgaggctccctctgctgcctccagagctgtccagggttcccctctgcgcccccaaaagcgcagggtcacaccagtcggggaggaaggaccagagcgactctgcgccctcaccccaccgcctccttctctgtttgctctctgaccggtgccgtttcattgttcccttcctggacgccatcccctcgtccagacaattccctgcaccagctgccaagcagctgcctggctatttatagcctctgtcatcagccccttcctcccgcccttggccctactcctgggaccactctccctacccccacccactttccaagggtccggctgtgtccagccaaccaggagaagagtggggacagtagaggctgagttcgttgacaaatatcatacaacacaatttttaaaatgtttctggaacattccaggacccgttgttgtggggaggggcctgcccttgctgagctggtcccttggtctcctgaggtgatctcaactgtgtccatggcttttggacaaggtgagacgaacttaattctttttttttttttttttttttttgagacagagtctcgctctgtcgcccaggctggagtacagtggcgtgatctcagctcactgcaacctctgcctcctgggttcaagcgattcctgtgcctcagcctcctgactagctgggattacaggtgtgtgccaccacaccctgcctgtttttgtatttttcagtagaggcaggatttcaccatgttggccaggctggtcttgaactcctgacctcaagtccacgccccttggcctcccaaagtgctgggattacagatgtgtgccaccgcgcccggcctgtaatcctactggccgtcaaatccactttaaaagcagtaaaggcatttgactccttcctgtttctcgttccttctcacccccactcaggccatctcccctcgccccaccacttcctccctgcacctacctttcttccttcctttctcggtgaagtgaagggtcacctctcattgtggaagaaggactagtaaagccagctttaaatgaacattactgggttggcctatgccaggcaggcgcgaggtctctattccccatgtgacaatcaagctgggtgcgttcacgcccaggatgctggggttgtcccacctctaggtttggagtgggacgacgaggagaagcaatttgttcaggagcagagaaagttcgcttggctgtgactcatcgcctctccattgagagtctccggcgggtccgtgatcatcggacacgatcatgatccgtcctcaggccccgcctgtgcagagtgcgcggaggccaaggagttattggcagaaaagcaagagcggaatgagcttgcgtacttgaagtctgtggccgtctgccaacatctccttcaaatatgaacattcttattttcgctctggaagtttttgtcaggtttattgcaaatgcaagggtggtgagcagacagaaagaaaatggtatttactgagctggaaggactgttttctcaaccgtttctcaagagcacgcaaggagacgtgcactttcctgggtgacatcaggttctccgtggggattttaatccaaatcagatatggccttgttttacgagggatcctcttgggtctcagggtgtgaggattcataataagtacacgtccatccagtacatggcgaagaccattgtaagccacccctggaaacacatacaagacagatgggcacgcagttcacaggatagcgcagaattctaatgaatttcattggcatcaaatgttatgttcctgtaaactgagagccatgaaattagaatgagtgcctcacaatagttcaaaagtgactcacttcattgaaaaaacgtctcggaaacataaattggtaaatcaaaactaaaactagtaccctttaaaaaaaactgagaatgatgtccctaagtttttttttttttttttttgagacggagttgcgctcttgttgcccaggctggagtgcaatggcgtgatctcggctcactgcaacctccgcctcttgggttcaagtgattgtcctgcctcagcctcccgagtcactgggattacaggcacccaccaccactcccagctaatttttgttatttttagtaaagagggggtttcaccatgttggccaggctggtctcaaactcctggcctcaagcagtcctcctgccttggcttcccaaagtgctgggattacaggcatgagccaccgtgcccggctgggatgactattttaatctcaagagagccatctgggttccttccagggcacaattctatttaaggatatactttcttatttttacacaagtttgataactggataaaaaaaagacgaacttttttttttttttttttgcatggaccaaaaaatgtagccataagagcatttgttaatacgcacgtctaacatcctccttcccacctccctgtgcagcacaaagtggtaaagacagcaagaattttctttctaaacagttgggctgaaattaaacaacaacaacaacaaaaacccaaatgcccattctcctcccagcggaagtacaacctctctttgtatcatgttactcatccgctgcacacacctgttcatccaacaacagctaacaaaagtcagactccgagttaagcgatgtacacatcacagtttgtgctggaaatctgatccaagcacatggacagaactttctatggttctcggctcctaagcttggcagcttgttttcagcgtattcttaaaaacctaggaaactggcaatcatacttctaagttaaaagattgggaaatcaggccagtgaataaatacttactttggatctgcactattgatgaaaaataaaaaatcactggaaaaaaatgagcccctttcttctatttttgctcaaagcagtccaaagaaaacaagttttggttcactgctgtctgtgagctcagtgttgaacaaattccagcaaaatcacagagaaagttggaaccagatttgcagcgctctatctcatacatgtttcttcttcttctttttttttaagagacagggtctcgctctggtgcccaggctggagtgcaatggcacaatcacagttcactgcagctttgaactcctggattcaagcgatcctcctgcctcaggcttctgaatagctgggaccacaggcacgcaccaccacccccaggtgccttttatatcatttgtagagatggggtctcactatgttgcccagggtggagtgcagtggcatgatcatagctcactgcagcctccaacccctgttgccaaggctggttccaaactcctgggctcaagtgatcctcccactgtggtctcctaaagcactgggattatagacgtgaaccaccacagctaccccgtggttcttaaaaaggggtctccttaaaaaggaagcttcaccttcctttttggtgtgagggagacagaccgtcagggagagggcactttgttcttctaattgcctttctgcagaggttcctgctcaaggaacgggacgcctaaacctcaaatccccagtggcattcaaggctgctcgcaggcacagggcgtgttctggccaatcctgttcgagcaaggggagctgacattggcccagcacaggcaggctgcacagagctgcagcccattcttcctggaagcgcctgcatcagagccaaggacaggccacctagtagcagtgtccctggagcctggtgcttggctcagtacattaaaatgcaacaaccaggccgggtacagcagttcatgcctgtaatcccagcattttgggaggctgaggtgggcggatcacttgaggtcaggagttcgagaccagcctggccaacatggcgaaatcccatctctactaaaaatacaaaaattagctgggcgtggtggcctgtgcctatagtcccagctacttgggaggctgaggcaggagaatcacttgaacctgggaggcagaggttgcagtgagccgagatcgcgccactacactccagcctgggcgacagagcggggctccatctcaaaaaatatatacgtatttcacagatacagtccttcctcgttttggtaattgacagagcataagcagtttttaattttttcaaatttacaattaggctcctgcacggcaactctcttcctgtgaactgaagggaaacttggagtctccctctccacagggttctcgtcttctggaaaagagaagatgggaaaatgcggataagaagagggttagaggggaggaaagaaataaaaaccgagcaatttctagaaaacatgatgattaaaaaaaaaccatccacgcttttggaatggacggattctttaacacctgtggatttccttattctgtgactagcaagctcccaagcccacaggtaggaagcttcagccagtgtgtgtggaaaaaacgccggttttgggatacgacggacaagtcagaagcctgcttgaaccgccgtcacccctttgcagccatccaacaccacgaacagcaaaaacatcaggttctggcaacctgtggggacaaagtgaccatcagcacggggaggtcgctgtcagagccgcgtcacagctcttacgcctcccagaatggtttttggtgtgaggattgctgcatggattgagaaggtggaatttgattggaataactggatcatctcacggatggctgaatcctaaaatgcctacaaagcgtgaaactgactcaggatttcacagaggatggtaaggctctgatttttccacttggcactcatctgggtgttatcattagcactttggtttaatgctgcagggtgaggaggatgtacccagaggccccactgacgcaccccgtccagtggcttctgacatgcagagctgcaggacgggcgtcgctgagctggccggggcaggctgggagctgagctttgcagacactgggtcctggtgaacgacgatgcttcgacatccactcttctgggcattcccagcctgtcctctgctctgtccctgccctcccctaattccaattggtgggattgggtggggctctctgggccccacactggtctgagagcctggcgtgctgctgctgggccagcccaggagcgaatggatgaagttcctctttctgagccgggatcaggcccagaactcccagctcgcagctcgggcagctgcctggtgctgaaaccagaagggacctccgggacttagtggcagcttacagggaatggctaggagtgtctccctctgggccagtgagtagggtccagaccaggaaaagcgtcagaaacggaacacgaggttcaccaagaagccaagggggccggctgagggccagcatcgcacgttgatgctgggaggttgctgctttgcaggagtaagggaaggaagaggccatctcagagcagccgcaacactggagtccacacaggggagctcttggcagagccatccacagcgatgattactgtggacacagatggggaggccctgtgtgtgaggcagtgacagagccattggttgggaacacagccaactcttttggagttttgttaactatcccgaggtagaggctgagggggacacgcctacatgtcatgccacaaacttagcgtactagaacatgctagattttctctcaaagcacgcaggtctgagcctgtcatcattctgccagtataacagacaggtgaatgaagagacgggggaacttggaaatgaggggctgaaaagaagagaaagtggaccctggtactggctgtgtaagaaaagtaaatagtgacccagaagaatttgggtcacggtctgattcatacaataaattcattttgtctcatttgaaatattttaggaaaaaggcatgcttttatccaaaattacgtcaaaaattgcctcaaatgtctctcattaaaaaaaaaaaagtagttggaccaggcgaggtggctcacgcctgtcatcccagcactttgggaggtggaggagagaggaccacctgaggccaggagtttaggactagcctgagcaacatagtgagacctcatctctataaaataaatacataaaacagttgcaccttatcttcttagctcttaattgaattaatgtcctgaaagttcacataaatgacattcttcaatattcaaaaagaagccaaaacaaaacccagtctccaggcatcaggttggatgaggactttagaagtctacggatgtccttcatttaggtttgtttgtttgtttgtttgttttagacggagtcttgctctgttgcccaggctggagtgcagtggcgcgatctcagggctcactgcaacctctgcctcccagaggttccaagcacttttcctgtctcagcctccagagtaactgggattataggcgcatgccaccacgcccagctaatttttttgtatttttagtagagatggggtttcaccatattggccaggctggtctcaaactcctgaccctgtgattcacctgcctcagcctcccaaagtgctgggattacaggggtgagccaccacacctggccaaaatttaggtttttttaaagcttaaaaaaaatgttttggggtcttgctctgttgcctaggctggagtgcagtagtgagatcatagctcactgcagcttcacctcctgcgctcaagcgatcctcccaacgcagcctcccaagtagctgggatcatatgtgtacaccaccgtgcctggctaattttgaaaaatttttcgtagaaaaaatttctacaagattttttgtagaaaaatttgtagaaacgaggtctcactatgttgcccaggtctcaaacttctgggctcaagtgatcttcccgtctcaaccccacaaagtgctgggattacaggaatgagcaactgcacccaggcaaagtcatattttttttcacctgagagctccaattgccacgaaaatctcaaattatattctatgataattcaagttaaatgggcaagtaatatttcttttctttccttctaagtgcctgaaatactagaaatacacaataatggcttttaaaaaactacctaacacaataaaaaattgtgatagaatttattgtgtaatcaacaagttagggaaaactgattttgcattaaaggaacatcttctgtttctgttaaacagcaggaaggacaagacaccagcgcaatgagctttttttttttttttggggggggatggagtctccctctgtctcccaggctggagtgcagtggcatgatcttggctcactgaaacctctgtctcccaggttcaagcgattctcctgcctcagcctcccaagtagctgggattacaggtgcatgccaccacacctggctaatttttttttttttttctagtagaagctggatttcaccatgttggccaggctggactcgaactgctgacctcaagtgatccgcccgccttggcctcccaaagtgctgagactacaggcgtgagccaccgtgcccggccagcaatctgtcttttctatggaggcacaaatgtgcagcaaaccttgcctctcccctatgaccatttggataatttggttactctgtagacaccgagttgaggattttcagagatcaggcttatttgagcaattaaacatttctccattctaagcatacactagataataaatattccacacataatttaagcaatgaatcttatgaaaagagcgacggagggagaagggggaaaatacatttttcctcgtggtcactttctgaactactgtctaagcctgacattaaactcacaccctccccctccatctgggttcttcgttctttccttgaaaaggaggaggaaggaaaagaaaccgtttggctgtaataccgcgctctgtttctggctgttaccagcaaaaacactgtggccaatgatgcccagttagaacctgggctttctaacctgataaacagaaaagccttctgccaacacttcaatggggcatcctgaggccagaggaggctccaggggttttcagctcgttggcagaaaagcatagcataacagcagactatcttccaggtagaggcatatttgcgtatgtgaaaacagaatttactggcggaaaagtcattctcttgaagtcaaagcagtgcctggtgatcttgttgctgaaggtttatctacagtcctagagtcagggagggggagggtgatggcggaatgggggtggaggccacaggcggagtgcagaaccgtggcatcctggggcttgaggaaggcaggtgtgtccttggagaagaataaatgtcctagagacgcagaaccaaagctggagctgggctgagctgagacccgagggttcccacaggccagttctggaggagatagagaaggctagaaagccgtggagaatacgggatgggggtcctgggagggcagggctagggggcggttcaggtgcgtcttggcacaagcatgtctgtgcccccgggcgtcctgagcagagcggggtgtcagggcggggcgcgggcatttcgctcctctctccctgaaccctttcacatccttcccgatcctgttttgcgttatcccaggatcacacgcacaaatccaaacaaacttttctggtcccgttcatctccctctcatcctagagggcacggattttgtttgatgagaaaataaagaaggtcagagggagacaggacacagaaacagcagctctcgggagggcagctggaggccgggctagggctgcctccactgtgccagggctgggggggattggcagagacgtctgggtccccaaccatcggctcttccctcaaagagcagcgggggctctgcgggaggatacactaccctgaaagactctcaccagccaacccaagccagtgtttgttctgcctggctctgggaccctcccgccaggaccccaaacactgccgagggaggaattttaaaaataaaatggatgggccgggcacggtagctcacgcctgtaaccccagcactctggtagcctgaggcgggcagatcacctgagatcaggagttcaagaccagcccagccatggtgaaactccatctctactaaaaatacaaaaaattagccgggtgtggtggtgtgcacctgtaatcccaactactggggaggctgaggcagaagaatcacttgaacctgggaggtggaggttgcagtgagccgagatcgcgccattgcacttccagcctgggcaacaagagtgaaactccgtctcaaaaaaaaaaaaaaaaaaaaagaaaaacaaaaaaagatgatcttatgggcagcagctgccatgagctccttcatcaaggaaccaacacagaagtggtgcagttgttttctctgaatctttctcgtcggttacttttttttttttttttttgagagaatcttgctctgtcgcccaggctggagtgcagtggtgcaatcctggctcactgcaacctctgcctcctgggttcaagcgattctcgtgccttagcctccaagtagctgagaccacaggcacccaccactacgcctggctgatttgatttttgtatttttagtagagacagggtttcaccatgttggccaggctagtcttgactcctgacctcaggtgatcctcccgcctcggcctcccaaagtgctgggaccacaggcgggagccaccatgccctgcctcggttgctttttattcagaggttgaactctccataaagccatggacaaaaaaatcatcttgcatgcgttagggttgacgttaacagccctatttaaaaatgttggccaggcacggtggctcacatctgtaatcccagcactttgggaggctgaggtggatggatcacttgagcccaggaatttgagaccagcctgagcaacatggtgaaaccccatctccacaaaaaatacaaaaaccagcagggcgtagtggcacgcacttgtagtccttgctacttaggaggcagagacaggaggatggcttgaggccagggaggttgaggttgcagtgagctgtgattgagccactgcattccagcttggatgacagagtgagactcttatctcaaaaaaaaaaaaaaaaaaaatgtccgtacttgattcctcatatctggaaagtcccttcagtttataagtggaattcacagtggtaaagccactgggacaagcacagcttctaatcacagctgtttctcaaatgctctcatgtattgcagaaaatttaacaacctaggtaaattaaaaaacctaagtaaagggagtttagggcattatatggcacacagtagtcgcttgacaaatactggctggatgttacttatctgttggaaataattcaactaacatatttgtgtactgaaacgttttttaagcagctcttcaaatatatttagataactcacacattaaattctaaaatataattttgattaaaaatgcatgtatcaacgctgggcacagtggctcatggctgtaatcctagcactctgtgaggccaaggcaggtggatcacctgaagtcaggagttcgagaccagcctggccaacatggtgaaaccctatctctattaaaaatccaaaatttagctaggcgtggtggcgcatgcctgtaatcccagctactcaggaggctgaggcaggagaattgtttgaacccaggaggtggaggttgtggtgagctgagatcgtgccactgcactctagcctgggcaacagagtgagactctgtctcaaaaaaaataaataaataaaataaaaacgcatgtaacaatgagtagcattaacatgccaaatcaggtttccagcggagagtccagaaacgctaggaaacctcatctgcagagagttggaatgaaaagtcatctctcctctggttaccgtggatcaggggcactctatttgcattcgtggactcctgaaattatatataaaatcaaaagatttggccgggcacggtggctcacttctgtaatcccagcacttagggaggctgaggcaagtggatcacctgaggtctggagtttgagaccagcctggccaacgtggtgaaactctgtctctactaaaaatacaaaagttagccaggcatggtggcacgagcacctgtaatcccagctactcaggtaactgaggcagaagaatcacttgaacctgggaggcggaggttgcagtgagctgagatcgcaccactgcactccagcctgggcgagagagccagactctgtctcaaaaaaaccaagcaacgaaacaacaacaacaaaaaatcaaaagttgtttttatgtgcattttttctggacaaagtaaccataaccttcatcaaactatcaaagcctttgcgagccaaacctgtccccaccccggaaaaaaaacaatgaagaatccccgctgttgactgagactctaacaggcacgcggattacttaactcacatctccttcagactttcagggccagcagggatacgagaattccctaagcttaaattactctaatattcattaacaactctttagagtcatgatatttaaaaaaacaatttttaaaaaggaactgtataaaaatagacacttgggaagattttaaatgtacatgtccattgcgtgcaagtgtgtactttttcttaatcgcttcctcttggctttctccggttagtttcactttcccagtacgcgggatctattccaggtggccacagccatagattcccacagtgggggaaaagcaaccatgtgaacaagatttcagatgaaagagaaaccacaaatgatcagttctggggctgattgcaaaaattagaggctgcctttcttggctgtttgagaaatcctctaagtcactgggtgccctttctagtagaaagacccacgttctggctgggcgcggtggctcatgcctgtaatcccagcactttgggaggctgaggaggacggatcacttgaacccaggagttcgagaacagcctggccaacatggcaagaccccgtctctgcaaaaaaatacaaaaattagctgggcatggtgttgcgcacctgtagtcccagctactcaggaggctgaggtgggaggatcacctgagtcagggcaggtcaaggctgcagtgagccctgatggtcactgcactccagcctgggtgacaaaatgagaccctgtctccaaaaaaaaaaaaaccgaacaaaacctccattcttacaagaccctcaaggcagcaaggacgggttattccctaagctggaaaggtgaccagggaggcctgcagtggcgactcgggaggagagtgacctcatcaaacagcaacctcattggccccgggctccagcagagaatcagctggaggctgcacccccgcaagtccatgagcaaccaccagaagccatgaattcagctccctttgtggagtctacaaaagaatctttgtgccctgaagttggtcataaatacttaacttaccaggccgggcacagtggctcatgcctgtaatcccagcacttcgggaggctgaggcgcacggatcacttgaggccaggagttcgagaccagtctggccaacatggtgaaaccctgtctctactaaaaatatgaaaattacccgggtgtggtggtatatgcctgtaatcccagctgctagggaggctgaggcacgagaattgattgaacccaggaggcagaggttgcagtgagctgagatcgcaccacggcactccagcctgggtgacagagtgagactctgtctaaataaataaaaattaaaaaaaaaataactcatcaggaaaacccctacaggggaaggggctctaacccctggaagatccatagtttggcctcagatgcgggagtgtggtgaactcccaagaagtgtagaaaatggcatgtgtgtttttctgggaagaggctctatgactttaaacagattctgaaggggctttgtgacttcctcaaaacacctgggaccccagtgatctgtgtacctgcaatcactctttccttttcagaaaacctactttttccccctcaattccttctctaaggatgttgcagaaaactatttaggaggcctgacagggaaaatctcacaagcaaaacttgtcctgcaaccttacttttattgtttaaaaaattctgtgtaaaaataaatacttttcaactcaagttaactggagcaaatagatccaattaaaaaaataacataaacacaaacagggttttctacttgccctgtttctgaagtcatgacgtgaaagaaaggcaaacccacccaggtgagccacagatcgcagaaaacacgagctgtccaaggaagaccgccctcctctctgaagcagtgctcatcttttcaataagaaaacaccaggcatcatatatttaaattttagaatattttaatgtccatttcttcagtgaatgcattttgaaattattagaattaacaatttaaaaagagcagataaaaggatatatggaaaatgcaaacagtcggttcttgctaattcaatttcagattctaggcatgatgtgattttccaaacaaccaattaaaaaaaactccttacctcgaaaatctagaaattcaaatgcagacgtgtctttggaaactacaaatgattacagcccatgtgacaggaagcacgcggccttcggctctccggatcgtgtgcaaatgtgcagggggagcccccgcgggtgacgtcagtgtggatgaagtcacgggtgtggcagagcctgtggggctctcaagctattcgagggttttgtaactgatgctctacatttgtttgcattggataaaattgtgtgtgcttgtttaccatatatatatatatatatatatatatatatatatatatatatatatggatatataattcgatctgagctgggactgagaagaaaatagcaattgcaactcaaagcaactatttacacacattcaatgctgaagtattgcttcctgccctaagttcctaagaggtattgccaccctgaagcacgacccatgccgtcagcagccctcgtgccagctgcttagaaactcgtgtctccagcacgatgtgctcgctgccaacagacaagagatgcacggcgtttccgctgcagagattctgtggttctgcactgaggtatgcatcggagcaggggacggggaggacccgaggggcttcgtggcccagagagaacgtctgcactggctgtttaggaaggctcagggtgtttgaaagacaacgttaagctctgggtgagtctgcacggggctgaaccagactccactttgcagctccttggtttcccggggtgaggaatcacaaacacctttgtggttggggaaggaaatgggcttgatggggaagaagtgtgtgcggagaactttgcggagcatgttctgagcgagacagcaaggtcgtgagcaaacgcccagcccctcaaagctacacagcctggaggggaaaggggaggggaggacattcaaatatacaccttaatactgatgcagaaagagcttcatgtgaccacaatccccacgaacaaggaaagcatcaggtagtgttttttaaggaaaaaaaaaaatctgcggtgttttataatacattctttagaagcaagaggtattgtcacaaccaccctttcttcggtattggaagaccagcaaactgacagtcacacctgacaggaaaccttacagctaatggggggaggtgccctggactctcaggacgccgggaccctggctctggctgtcctgatgggtggccatcccaggcaccgcccctggagaggtggcgggtcagaattgtgacttcttcatgccggggagggcaatctgtatgtctctggggaggagtagtgatgatggggactgatgcggtgtgaaaacgagacagtgagatttgacagcggaaagcaaaatgcacagggacaacgggcaagactgacaaggagtgcaccctgggcctcatcagcgtcccggggtcccctgaaagactggctacaactccgaccggacaactcgggcgagctcacttccacacaaacttcagactcaatatggcaaaacataatcagacaggaccagcagccaactgcccggacggagctcccccacaccaccctcgggattccgcccctaacaaaccccgcgtttgcatccagatgcctctgtccctagatacggtgtgagaactccatttcagagctggaatttgctccccagattaaatcctgccactgataggccctgtgccatctgagagcgggaggcagccaagaaacttctggaatttgtggaagccaagatggcaccggtgctgccggcacagacccccgtggttctgagctggaccccggcagggaggagcccccgtgggtggcaggggcagctggtgggcttctcctattcccctagcctcagaattgcactggccatgctttgaggtcccactcagacccctcttggggtggggaggttgggggcggccccaggtggccaaaacacaaaagagacatctggttaccttcctgggaactgccctcccctgtggctatgaccccccaccctgaggacccagcacccctcccgggagcgcacatgcttccgggtaaataaataaataaataaatgcaacctcggatgtttatttggtatttccctctccgatgagtcagcttccaggaccaacacctccactcccgatggggagacccctgggtggagggtcgggggtgagaggcggctctgagacccccgaggcctgggcacacgggcgtcgtgcccggctggcatttgctgtcttggcctgcatgcatgtgggcgagcccctaaacccgctcagtgcagggagcgcggctcacccacagcccacggggcgcggtgctcgggaaagtgcgggtgggcaatggggggtggcggagctgtcgtgacatgcccccttcgcaccccctcttggcggattactggcactttatatcagattcatgaatgcaagtgtgtgtgcgcatgtgtgcttacatagagaggtcgggtcgtagaggaacactgtgacatagacagaaacaaaataaactcaaaaacagggtattagccagagaaccgaaaatagtgtctcgtgggacgtgggaaaaagcaataaaaatgagatcttaaccacagcttttgttctaaaagtcaaataatacccaaagccatgatctccactggcggcctctgtcccgagactcgaggccgaggccagccctgaaggcacttgttctccaccacgtgctgaacggatgacccagaggcagcggggtttccagggaagggagcgaaagggaagaatggatgaaaatgaaccctgaataactgtgatccacacagaagttagggctgaaatgaccacataacaccacgtccggggagggcaactgtggcgcttggaaagcacaacagccaaatacaaatattactgtgtttcgacaaacagagcacctcgggcagcgggtgggcgccgcctcacacactctttgaaacgttgagcttggtgagttcgttggcttcttctattcctgtttcgtcacagtcgtctttctctatggctttgccaaatcgacccctttcttcggctttgacgggctccttccacggtctcttgggggacaggtgggcatccttggcctgcgtgctgctgtcagaacccagagatgtcttgtccacatactggacagaaggcaccaggttggcaatctcgtctgtgggagaccgtccgatgctgccatccacctggacgcggatgtctggggagatggacagctggtgctgtgggatgaccctgtgatccgtgcactttgggtacaggtaggtcttcatctggcctttccccttgacattcacggtccctctgtagtcgaagtcatagcccatcttgctcaagacgcggtagctctcttcgctcacctggatgcggcactccacgccggtggtgtccatcctgctggcgatgttgacggtgtctccccagatgtcgtacagcagcttggtggtgccgatgaccccggccgtgaggggcccatggttgaagccgacgcggagcttgaagttgaaccacagcatgttgttgttgaagtcgtccaccacgcgcatcatctccttggcgaactcgaacaggatctgcaggtgctcctgcgggtggctgccgtcctgggcctgcgcggtgttcagccctgacgccgccatgtacgtggctccgatggtcttgatcttctcgatgctgctgtagtccggcttgcttaggagctcgtcaaagtccccgatgagctcgttgaggacccggtagcactccttgccgccctcgtagttctcctcgtagaactcgctgaagttgacgatgctggcgaagatcacccctccgctgtcatggttcttggagtaggtctgggacaccttcagctgctcagccacgtggtaggggatgatgttcctcagcagccagtctgcctggtcccgcatgctctggatcttggtgcggtgaagatccgcttccacgtctccgtggtagtggaggcggtagctgacttcaaattcgcgattcaggaaccagaccaacaagagcaggagaaagaagacgagaaccacctcctggccgatgaggctggcgggccgccggaggtcacgcggcaccgaactattgcacgggttcctctcggaactggagagcaaagacacgggaaagggagaggttactgctcggcgcttccaagctcagaacagccccgctagctacgcaaagctttgttgagtccaggccttcaacaacctgaagctgtcaagctgcccattcctggtttgggctggctgaaggtatggagggataaagactaacttttgaaactgattgatttcattttgttaaatagaggtggggtctcactgtgttgcccaggctggtcttgcactcctgggctcaagcaattttcctgccttggcctcccaaagtgctggaattacaggcgtgagctgctgtgcccagccctgtaactaacatctttagtaagtgcttggtaatcgtttttcttttctttttctttttctttttttttagaagtctttagcttctttcaaaaatcttttcttttctctctctcctttgtttttttagagacatggttgttgtccaggctggagtgcaatggcacaatcatggctcactgcagccttaaactcctgggctcaaacgatcctcctgcccagcctcctaagtagctgggattacacgcatgtaccaccacacctagctaattaaaaaattttttttttgaagagacagggtcttgctggttgccaaggctggtcttaaactcgtaacttcaagccatcctcccaccttggccttccaaagtgctgggattacaggcttgaactgtgcttggcctaacatctttttttttttttttttttaagattgagtcttgctctgttgcccaggctagagtgcagtggtgcgatcttggctcactgcaccctctgcttcctgagttcaagtgatcctcctgcctcagcctcctgaatagctgggactataggtgtgtgccaccatgcctggctaatttttgtatttttagtagagacagggtttcatcatgttggccaggctggtctcaaactcctgatctcaaagtgatcagcttgccttaaagtgctgggattacaggtgtgagccactgcacccggctttttgctgaatgaactttttgaaagtaagttgctgacatggcacttcagctctaaatatttcagcatgtatctcctaagaataaggatatttccctatgtaactacaatatcatcatcatacccaagaaatttaacattctctgatatatttggttcttagatttctttttttttgagacggagttttgctcttgttgctggtgagatcttggctcactacaacctccgcctcccgggttcaagtgattctcctgcctcagcctccccagtagctgggttcacagacatgtgccaccacacccagctaattttgtatttttagtagagacggggtttctccatgttggtcaggcttgtctcaaactcccgacctcaggtgatccgcccacctcagcctcccaaagtgctgggattacaggtgtgagccaccgcgcctggccttggttcttagatttctaatccaataaacttatcattttacaaatagcttttatgagttctatactctctacctgtataaaaaagtttgacaagacgccatctcccctgattctgggttagttctttttgccgaaatcactcaggacaatgctaacatctgaaccagtgccattattttctcatggctgtgcagtgttccagcactcggaaattctgtaatttagccagattccccctgatggaactgggcccgagtctgtcttttcttaccacaaacagtgtcacagggaatattcccctacccctatctttgtgcgtatggaagtgctgagtcattttaaatattgcacatttagaatttccttagaaatttccaaattgcccttctaaacaaggctgaaccagtttctgcttttttttttcttttttttgagaaggagtctcgctttgttgcccaggttaaagtgcagtggcgtgatctcgcctcaccacaaactccgcctcctgggttcaagcaattctcctgcttcagccttctgtgtagctcggactacaggtgcacgccaccatgcccagattatttttgtacttttactagagacaggttggtctcaaactcgtgacctcgtgatccacccgcctcggcctcccaaagtgctgggatcacaggcgtgagccaccgcgcccagtctctgctccctttgataactgagcctgctttcagcggggctgtctccacttcagtggcactgatggagacagccatggtcagggggctgcagatgagtggtgagtagcacaatttctttttttctttttcttttttcttttttgagacagagtctcactctctagcccgggctggcatgcagtggtgtgatctcagctcactgcaacctccacctcctgggctcaacgattcttgcggcccagcctcctgagtagtgtgcgccaccaggcccagctaatttttgtattttttttttggtagaaacggggtttcaccatgttggctgggctggtctcaaactcctgacctaaagtgatctgcccgcctcgacctcccaaagtgctgggattacaggtgtgagccaccacacctggctgagtagcacaatttcttaaagtttgtttgaaatatatatatatatatatatatatatatatatatatatatgtatttttttttttttttaagaagagacagggtctgtctctgtcatccaagctggactgcagtggtgcgatcctagctcactgcagctttgacctcccaggctaaagcgatcctcccgcctcagcctccagattagctgggactacaggcacacaccaccacacctggctaattttttgaactttttgtagagatgaggtcttactatgttgcccaggctggtctcaaactcctgggttcaaactgttctgcttctgcctccccagtgtgctggaatacattttttcccatttaaaaatactacatactcatcatagaaaatgtagaaaaaaatagacaaaaaagatttgtccatcgtcctgccatccagaggcaatcactattaacatttgttgaactgcattctagtctttttcttttttacaacaccgtgactgttctgttcatgtaaatgctgtaccctgatgcattcctcccgcgcacagagtaggccagttgatttgatgcaataatgggcttggtcactatatacttatatatgcgactggcggatccacagtttagacagctccatcacactggaaagctcaattctttttcttttagagacagggtctcgccatcttgcccaggctggtcttgaactcctgagctcaaccaatctgcctgccttagcctccccaagtgctgggattacagggatgagccaccacgcctggccaaaactcaattcttcttttttctttcttgctctgttgccctggctggagtgcaatggcgcgaccttggctcactgcaacctccgcttccaggttcaagtgattctcttgcctcagcctcccgagtagctgggactacaggtgtgcgccaccatacttggctaatttttgtattttttagtagagacagggtttcaccatgttgaccaggttggtctggaactcctgacctcaggtgatccacccgccttggcctcccaaagtgctgggattacaggcacgagccaccatgcccggccaaaagctcagtcctttaatcaaagtgtctaataagtttcactaactgttcttgggatattaaaaaacaatgagcttgacctgtgtggccatcacggccctctgcgaagcacaaccgccaaaagccctggccgtgggtggaacagaacccctgggccccatcctggctggaccgcgggggagtttcagaatcttgggtaagccatgccatctttctgggtctcagtttcctcgcttgtaagctgtgaagatggactggagcatggctacgtcccttccagcctaaggttccgtgcaggaaaggcctgaggctgccatccttggaaagacctgcctgcaaaggtggtggctggcaccagggagctgggatttggggagggttcctgccattccttgataagagcggctcacactgcctacactgtctaaataaggaggtttacgctgaatacccgctttcctgctggaagtctggaatttaggcacgtgctgggcagaggcgggagacctgaacagcccctaatacaagcctggacaccgagactttaatgagcttccctggtaggcagcatgttacaagtgttgtcaccactcactgctggaggaattaagcccatcccgtgtgactctaccgggagaggactcttggaagctggtgccggcttcctccaaacgtcaactcacacacccttccctttgctgattctgccttatgtcttttcgctgtaatcacagcggtgagagagcagattgcggagtcctgagtccacctggggctggtcttgggagccctgatacgggctttgtgactcaacgcctatgaccaggaaccaagagtcctcagtgggaagacaccctgtgcttcactgactcatttcgtgaactgctattgaaacagatgacattacatatcctacatctcaagtactaagcaaaataaccatttgttacgatgatgactcaaacatatttctgtccagctccatgagccctctggttgattgtaaatagagcaggaagagaatatggactgggggaaggttttgtgagccccgctcgttgggttaggagttgacctttcttttggtttctcaaagtggtgacaccaagaacagtcccctttaggagcaggtgtcaccaaggtctaacatccccattatgtgcagggggtgtttccagtctctgtggtggaaatgggagactgtatctgggcttctcaatcagttatcgcttgtacagctcactctaatctgcgggagccggagccagcagcacagctgactcgagacgggcgcaggccaggcccctccaggcagaggagggacagcagcacatgggctagtgccagagggagaggaaggcagagcacagcgtttgctttccacctttgcttccaaggaagaaaagccatcacacacagcatgtgcactcagaaaccaagggggctgcctcgcaacagaaggcatctgtaagaaacaggtacgaggacagcttcccagctagaatgtgtgtttcctattttaataccaaaggaacaaaggagccgatcctattcctaaattcaaatagcaaagatccacttcaaaaagaagaatttctttttcttttctttttttttttttgagatggagtcttgctctgtcccccaggctggagtgcagtggtgcgatctaggctcactgcaacctctgcctcccgggttctagcaattctcctgcctcagcctcccgagtagctgggattacaggtgcccgccaccacgtccagctaatttttgtatttttagtagagatggggtttcacaaacatgttggtcaggctggtctcgaactcctgacctcaggtgatccacctgcctcagcctcccaaagtgttgggattacaggcgtgagccaccacacctggctcaaaaagaggcatttcatgtgactaaatgcaggagttaatttataagtcataaatggaagttagagtaaaatacagtgtaatccgttatcatggagaagagggattgaaaaactgaaaaaaatagaaagcaaacatcacttgcagtcctaaccagccaaacgtggcttcggttgacactttggtatatttcagtgccatttaaaatctgcccctagggaggtggtcaggtcgggggagagggggtcagcagcggtggggttggagggcttctggggtagtggtaatgctctacttcttggtctgggtggtagttaaatgggtgtgttctctggtgaaaatgcactgagctgtccttttatgatcaggtactcttctgtgcatactgacatacacatcaataaaaggttaaaaaaagatgctaggtgctttacttttaagtactaaagctgtaatcatcactcattcattatatcctaagtataaatcttgtacatatttttactatatataaatacctagttgtacctatagtacatatatagtttcacctagtaaatgaaaatcttaaatgttttccatatttactgcattttaacagttgtattatttgagtaaatgtataatcagttaatttatttattattgacaactacagttgctaatgaatcttttttttattttattttattttttgagacagagtctcactctgtcgcccaggctggagtgcagtggccgatcttggctcactgcaacctccgcttcccaggttcaagcaattctcctgcctcagcctcccaagtggctaggattacaggtgcccaccaccaccccagctaatttttgtatttttagtagagacggggttttgccatgttggccaggctggtcttgaactcctgatctcaggtgatccacctgccttggcctcccaaagtgctggaattacaggcatgagccaacgtgcctggccttttttttctgagacagagtcttgctgtgacaaccaggctggggtgcaaggacaccatcacagctcaatgcagcctcaaattcccggcctcaagcccaccttagcttcccgagtagctgggactacaggtgcataccaccatacctggctaatttttacaattttttgccaaaacaggatttcgctatgttgcccaggctggtctagaactccaggcctcaagtaatcttcctgccttggcctcccaaagtgctgggattacaggcgggagtcaccgagcccggtccttttctgtgtgctttgattttctctcccttcctctcaaatctgtccatcttttcgttgtggttctatttattatttgtaagcctggaaagttatctcagttttagaggcttgaaaactattgaattttactttttctagattttatatagtttaatttttatttccgactcttcaatttatttagaatttattctgctgtttatagtaaagcaagggtcaaacatttagtattttggatttcaagtcagttattttattactttttgagacacagtctcattctgtcacccaggctggagtgcagtggcacaatcttggctcactgcaagctccgcctcccgggttcacgccattctcccgcctcagcctcctgagtagctgggactacaggcgcccgccaccatgcccagctaattttttgtattttgtttagtagagacggggtttcaccgtgttagccaggatggtctccatctcctgacctcgtgatccgcccgcctcggcctcccaaaatgctgggattacaggcgtgagccaccgtgcctggctgatttcaagtcggttattttaaaatattttacaaaataacttttttctttgatttgcgagatttcctttgttgcatgcgaaagtcttacataaaattacatgactgtaatgtcttattaaaataataaaactaattttattttccccattagacattataactatgatacagttcaacgaggagatattttccactttctattctaagaatgcacgtattgttccttttattcaagatcccattgttttcaggaagcttcgaaatgggcagggtaatacagtcactctcgtttattcagacagaagtgcaatattaaaagcttacctgaaattctgtactgcgtcaaggggcgaagttaatacagaactgaaattaaaatgcagaaaaatattatcataaagagcaaagaaggcattccacaaggcaacctgagaagagcttgaacaaactatgttccttttttagacgtggttgtacatccacataaagccacctgctcccacctctttcttcacatctgtgtctcccaatgctgggggcagttcccttggtaaagctgagtttacgtctttgtttaccatcccgcatcctctctatcctgctgaggcttagcaaccgtgatgggattaggggctctgaggcctcaagtggatggaggagttctgggccgagtggaacttcaaccatcatccctaccccagatctgctatttgaactctgggcacaaaggcggcagaggggtcccccatcactgtggctctccagctccaggtagaaaagccccgcagccatgactaaaggccacggtgaatgcccgatgagggacctgtgatggatttaaaaggtaaaaagcagtttgctggatttcatactctcgagaaagagctcatcgtgaccatcgttctagatggccataccttcagaaaaatccaagtctgctttattttgcttaatctattcattaaagtttcctttcaagtactgaatgacagtcctattttaaattccctttttgatcttaatttgcagggaatttaaatgtcttttgtattgtgattcttttcttaagtaaactgaggacggatgctcacactgcccatggctggactgttgctttgctaataaccaaagacaccccgtgcctactccgtctgatactgacaatactgcggcaaatagaatcattttgtgcttttgaatgaattcaagcagaggtccttggcaacagcaatgccactccaacggggcatttcggaaatgccaggggtccctctggttctcttaataactcagggagccagaatgttagatctcctgcaaggacaaggaagaaatgtcccatgtgactttaaaacattctgcgcacctaaaccctctgtaattgtaaacaggcggttcttcaatacacactaatagtgaaacatttttataagcagttataggaaaagcccaatatttgggagaaatttattacatgaatggaagcttaatgggtttaagatatcacgaaatatttgaataaattgttcactgcttacattctgttatacaaggtattactgtatttccaacaacacatttagttgaaaaggcttaaaataccctgaaaccagtagcaaatgtgtaataggcaattttgagacttattttttatttttatttttggagactgagtcttgctctgtcacccaggctggagtgcagtggcgcgatctcggttcactgcaacctccgcctcccagggtcaaccaattctcctgcctcagcctcctgagtagctgggactacaggtgcacaccgccatgcctggctaattttttgtatttttagtagagacagggtttcaccgtgttgcccaggctgtcttgaactcctgagctcagacaatccacccgcttcagcctcccaaaagtggtaggattacaggcgtgagcaccaagaccggctgggacttatttttaacaaatcaagaattattcagttagtgcaacacatgaaagatagggatcttactggatgtcgctaatggcaaatattttaaatatagcacctatcactgccatcctgtaagtttttacattttttgtagtacaatgatgagaactgggcttgtccccagaggtctaccggcctccctgactcctgtttctgtgtctgcgccatcccattcctcagcacctaccagtgatacggttctgaaggccagcgtcctcctcagtatgcagaggatttcaaaataaaagacctatgttcagtgactggtcattaatcctacgtctcatgacatcatatggggaactgttttgacctatttattattttttgtttttgagatggaatctcactcttgtcacccaggctggagtgcaatggcacaatctcagctcactgcaacctccgcctcccgggtacaagcggttctcctacctcagcctcccaagtagctgcgattacaggtgcacgcccccatgcctgactaatttttgtatttttcgtagagacggggtttcaccatgttggccaggctggtcttgaactcctgacctcaggtgatctgcctgccttggcctcccaaagtgctgggattacaggcatgagccactgtgcccagcctgacataatattttgaaataagccccaggtgacttgcaagatcatcctacgtcttcacctcctccttccaggctgtgacctgtcccggttcatgaaccctaccccactcaaggaaagtcagcaccagcttcctctccaccttcacatccatctgcagctccgctctttcatggccttgaccatcttctatgaaatccttcaggtcctactttcttagattccagcccattcatcagaagtcacctcggtataatgcaatggcagcattatgttttccaggatgtctacattcaactacccagagtgctgttctaaatgatattctttttctttcttttgcatattactctgagggcatctcattagctctttggtatgatgtgtgctgacagctattttgggtcatgatgggaaatatctctatcggggcgtgagaagcaatgtgcaaatgcagccaggccctacgcaacctcgggcaaggtggccacgcaccctggtgcccgcaagcagtgctggccgcgtacctgtctgggcacagggagacgtagagcaggagcagcggcccggcccccacgacggtggcgagggaggacctcatccaggagctgagctggcagaagttacagtagtgcacgacggcaatcagcgcggccgagcctgtgaacactgggaactgcaagaggcgaagggttaggacagccgcccagggccaccccgccacccctgctatacccggccgccaaaacattcgccactaatccatgtttccttttttttttgactgagtctcactctgtcgcccaggctggagtgcagtggtgcaatctcagctcactgcaacctctgccttccgggttcaagtgattctcctacctcagcctcatgagtagctgggatgacaggctcccggcaccacacctcgctaatttttgtatttttagtaaagactgggtttcaccatgttggccaggctggtctcgaactcctgacctcaggtgatccacctgcctcggcctctcaaagtgcctgggattacaggtatgagccaccgctcccggcctaatccatgtttctgtgtaacctaaaaatatcaccgataccagctaattgctcactatctgcagtcagtcttacttttgctagtgggcagtgtcaaggacagatcaagcctctaggttccctacccggcgtgaggctccctgttcacatggcatcacactcttctgcaggtgtgggaaatggcacgtgtcttcgtggaaaggaaagggaggcctccctgtttgagaaacgctgtgtgatcagtttccttcaaaacacttttccttggggcccagtgagatgtgatttggggctaaagtgtcaaacaccatcagcccgcccggaagctcatgctcacttgcaccagaaggatcatctcccacggccgtgctggttccctctccacggagtttagcacagttcccttcctgatcagcagcagccgacccgggcacaagtcaattctgtgtgccaggtatgcttctcgcatggttaggaaaggtgggacagacgcttctttgtaaaatgtgaaggaaaataactgatttggaacttgatgaagaagaagccacactggcagggactcgtgcccaccggggactccccagcccggccactgcccgggcgtgagcatctgggcaggccaatgctaagtcggcttctaaaaaagctggctcaggagagtaaaagagttcgtgcctcttcaagggtttattttattttatttattttattttattttgtgacgcagtctcgctccatcacccaggctgcagtgtggtggtgcaacctcagctcactgcaacctctgcctcccaggttcaagcgattctcctgcctcagcctcccaagtagctgggattaaaggcgcctgccaccatgaccagctaattgtatttttagtagagacggggtttcaccatgttggccaggatggtctcgatctcttgaccttgtgatctgcccacctccacctcccacagtgctgggattacaggcgtgagccaccatgcctggccaaagggtttatttttaaattgctatcccaagtgatttaaagaaaagagagattagggagtccaggagagcgtggaaataaaacggctgagcctttacttacgtgtatgttggtctcatattcggaggtgacatgggagtagacggccagtgcgggaagcgacaccaggatggccccgatgcagtgacgtggtagccagccggcgatccactccagcaggcgcttggtgcaggccatgacgtcctccaggaagaacaccatcctgcgagaggcatgggggttagcaggagcgacggggcccggggtgggtcatcggccaggagacaggtgcgaggccgcagccagcgccgccctctgctctctcccgtgttgcccctgggatgggcgtgagagcaggcgtggggtgggagtctacctccctcacttttggtagaaggcaaggaagccaggcttagctcattgtacctgattctagggtcacatgttgcgttgtgataaaatatgcttgtgaaaagcacatgcttcgctcgcctaacagaacacgtgagagtatcacaggccctgaggagagtctcctgggggccaccacgttgccgtcaccggctcccatcagcttctgaggcaggaggtcttgacgggggcagctttggaggcgtcctggaattctgtggagcccgtgcagttgtcgcagcagaagaggcggtcctggcatctggtgggcaggcgccagggacagagctgtcctgcatgtgggcaggtgccacccagggaggttctgccctgcaccccacacagcagccaagcccctgggcacctgcaaaggcagaaggctgctgacagcatcttagcccagaggctgtgtcccagctacaaacagggtgctctgtggtggtgctgacacaccctggattttcttggagcgcagctcctgtggaaactgagtgacagtggtctctgctgtttggggcatcatcatcagtgtttcagaaaatcacaccacaggctgaacctggctcgtggcgcttagaccaccaaacccgcacacgcgtgccgtctgcatctgggctgtcatgttcatcgtgcatgttcacctctagctggcggcttcaggactctccagacagcggggctctgttgtacgtgaggtccagcaccacgtatttcattttaaaagactttgtccttctaagcagagcgactgtattcactgactccttttgcaggcgtgtgtctagcgggcttcgtttcaggagtgtgatgttgacacaataaaagtttctgtataaagaagcagctgagtgtgcgggccaagaaccactgtgaggaggaggaacaggtcttggctgagtccaaggacccctgggccatggtggggccacatggggaggtgaagagaaggtgtggggtcctcgtggggagacagtccttctctcaagcttgctgccagggagctggggataggcctgctgtccctgcctcaggagaggctgggcgggggccgctgttgtgactgaacagcaaaaaagcctctggcacagagccccccgcccccagccttcgggcctgaacacctaccatgcctctccctcttggctgcgtggtgtggccaggcgagggaacgctcactctccagccattccccacatggacgcaggcacagcctcacccttttagggtcctggacagccctggcttcctgatatttaaaggataatgaagactttggaatacttccaagaataaccacaaatatgcagaatacagaggccctaggaggggggacagagggaaccaagttcccagtcagcagcgggaaagatgtgaggttggagggggccttcatgctggtccctgagactgcagggatctgaaaatgagacctcacgcctgctggggcagagcagagagggtgatgcaggaagcctcctggaggcaacgggcggggcctgggccagtcactgaggaggcgcctggctttcctcctgtacaggaaagggatggggtgcccgtataccccacagcgcaggttcccgtcaacctggggtcctcaacacggccctcagaggggccagggaagcctttcagggtctgggcctctcccaggcttgacgattcctggtaaatggaaccaaatcccaccacaggcctgttcaggggtgcagcagccaccaccttcaccagatccttggggagtatgtctgtgcaggcagttccagcgcacctcaccccagccctcggcagtctacaccggggttgccctcaatgctttagaattgggtctgaaggagcagggaataatagctaaagggtgaaagtaaaaaggaatggagacaatgctggcctcagagccctcaagacgctacagctacccacattagaggaaaacctgggggtggaccagggaaggcagacctgggggagtgactgcccatgaggatgggtttctttttggggtgatggaggtgcccgatagttacatagtggtgatattcatacaattcttcaaatttgctaaaaatcactgagttgtccacttgaatgagtttattgtatataaatcatgtcacaataaagcagatcttcttttttttcttttttgagatggagttttgctcgtcacccagaatggagtgcaatggtgcgatctcagctcactgcaatctccacctcctgggttcaagttgattctcctgcctcagcctcccgagtagctggggttacacgtgcccacaaccaagaatggctatttttttttttttggtattttttagtagagatgaggtttcaccatgctgtccaggctggtctcgaactcccagcctcaggtgatccacctgccttggcctcccaaagtgctgggattacaggcatgagccaccatgcccagcctaaagctgatctttttaaagaggaaaaacaaaccaaccaggggcctgaggatgtctggtttgggttctggggaagtggaccctgaaagggtttgcaggcgacggctcctttgggaggggtccccagaagcacaggagggcactgaggcaggaggggaggctgtgccaggaagagggctgctcgctgggggtgatggggcatgagcccacagggagttctgggaaacactgagcacacgccacagacagcatggcccatggcggcctcggaggaagctgaaagggtcctgggtacagtgcaggtgggaaggagggggcaggaatcccagcctgcccaccccagatgggagaagccagcattccggcgcctcacgccagactcaaagccattcatttctgccctgggatgttggataagggcagcagacgctcaaggtcagggctgcctccccatgtctgtttgaagcccagctccggggcaccgttgctagtgggactctgctaggccggcagccatcctgttgagggtgacaggaccacccaaggggcttgtggtgcccaggacggggaccacacagggccaccttcctgctcaggaatacagagccgctgcgagccccctcagggagccaggctggtcccgagggcccagctttcccaagacgcacctgtggtctattcggagcctctgtcccctttaaaatgagctgtctttttattatcaggctatgtgtgctctttatccattctagatgttagaccttgtccgaggcctgatctgcaagtgttccctcccgttctgtgggttctttctctttcttgatggtgttctttgtagcgcaacagcttaacttctgaggaagttgggcttgtctattctttcttctgttggcgtcacatccaagagaccactgcctgaggcaagtgcgtggagatgctgtttggctccggtactctgaagaggcgcctgctgtcccaggcccactacccccgctcatgtcttttcctttccttcctccagattgtttcctatcttctcaccttctcctttgcagtctctgaacctggaaatctggggacaagctggcagcggttggggctgtggaggcaccgccccctccagcgaggtggtccccccgcatctgggccaacgtcagggagggaggatgctggggcacagggctcggggaggacacggggacccatctccagaaatcagccagcagggacagctggctggggaccagtccaaccgctcagccataagccatggagccagaagagggagctaacggctcagagctggagacccagtccacgcggcgcttacctgatggacaccgcgagggacagcacctccagcagcagggctgcactgaagaccgccagggcggcgggcgggggaggcacggtggccgcctcgtacttcaggaagcaggtggtggacagcgtcagaaacactgtggtcgacagaaacacatccaggagggagctgaaggtgggactagcaaacgtcttcacgggggagttctttatgacctgtgtggagcaggagtggagcagaatgactgggaggccatgggcggccaggagcgcagttcagatggagaaacaggcaacacgtgcggagcactgctgctctgggccaggcacagggcaggaaggctctcggagggctgtctccctctactaccccatttaacactggggagtccaaggcacagagaagttaaacttgcccagggggctgggcacggtggctcacgcctgtaatcccgacactttgggaggctgacgtaggagggtcgctggagcccaggagttcccggccagcgtaacacagtgagactccatctctacaaaaaactttaaaattagccaggcatggcagtgcgtgagtgtggtcccagctactcaggaggatgacgcaggaggattgtgtgagcccaggagtttcaggccgcagtgagctataatcatgccactgcactccagcctgggcaacatagcgagaccccgtctaccaaaaaataaaataattagctgggcatagtggtttgtgcctgtagtcccaggtacttgggatctgaggtgggaggattgcttgagcccaggagtttgaagccgcagtgaactatgatcacaccactgcagaattataccgtttccgaaaacaaaaaaacacaaaaaaaaccctgccagggtcacagagcaactgattatgacccagcacattctcatagacacattatatatttagctgcaagatgagttactgactggcgcaggtgaggtccctgcatctgtaaggcagttggacgagagcaatgtgcagggcggtcctgctgcatggcggagtcctaggttcagcaggtgcgaaagcggggcttcgtggcggaagtggccgacggggatttaagtggcacatcatcgcctgggaacctacggggcctggctctgtgctgggggccagtacactagagaggcacacactagtgttcggcaattgagggggagaaataacgatgctgacacgtccaagaggtgaccaggcccaggccctgcaaggctctggggaggtgcgatctccattgacgctcacggcaccccacaggcaggaactaccacccatctcggtgtacagattgggaggccaaggccaggggctacccctagggcacacagcgaacaaggagccaggccaggacttggcatggaccggttgactcctgagtgtgtccctaacctagaggaaggtgtaggatccaaaggcagaggctgtggttgggagaggaagggatgtagccagttcagctgctttccatttggccttgcaaccttctggcaacccctgagaggccatgggtgtccactcagcatcccggccaggctcggggctgagggcaggagctggagacgcacggagcggaaaggtctcctggcagccctgggtgcggtgtgcgttctttgggacaaaccagctccgggtgcctcgaccactcccaggaactaggtgggagggcaggaggggcacttggacggtgggagcaaggctgccagtcagccctgatgccaggctggaccctgccagggcaacctgggggttagggtttggttccaaattctctccaaggaagctggaggctctgtagtgcccaaaagggcaagtcaggtcccagccctggaatcccctcagaaggtgtgggaatttcttttttttcatttttcttttcttttccttttttttttttttttttttgagatgggatctggctgtcgccaggctggagtgcagtggcgcgatcttggctcactgcaacctccgcctcccaggttcaagcaattctcctgcctcagcctctggagtagctgggaggacaggcacccgccaccacgcccagctaatttttgtatgattagtagagatgggatttcaccaagttggctaggatggtctctatctcgacctcgtgatctgcctgcctcggcctcccaaagtgctgggattacaggcctgagccactgtacccggccaggtgtaggaatttcaggggcgacactgcccatgcccactcaccttggcagaggcccacgcacgtcccctttctgtggggctccatctagtgcccgtcaggggttcgagtcagggccgggtgcatgcatgtgatgtccctgagacatcactgccttgcccacatgtgaggccggaaggtttccacgtgggctgccgtccttctgagagcccacacctcccaccttccaagccaagggctcgggtacagggcctttcctgattggggctgccatctcctctgtagaactgccccatccatggacgctgccagaggccccgctcctccctccacctcccttgcagtctctcctgcctgccctgctacttgccagagacacctgtccctgccacagcctccccctctgggccacccctggccctgatgccagaggctcccaggcccatctgccccacccctgtgcatcccgggagtgccacctgtcccagtcccactgagaacgacgctcccccacatcatgacactctttcgccctctctccccatgggcgaaacccagggacagtgccactggctgccagggcaccgtgggccaggctccgccctgctcactacccacatcccagggcctccgggtgcggccgtcccaccatcatcagagcacaggctctgcagccgggctgtctgggctcaaggccactccaccatgattagctatgatacccacgcgtccatgcctcagtctctttatccaaaaccagggataaaccagtacttgcaccttgtgggcggtgggatgctcggctaagaacgcacccacgtggagcccccagcacaatgagtccccaaacgcgggccagctgggaggctcccttgtcctggcatctctcctttcctccccaccgggaccctgtggccacctgccctgagtttcggtaacagcctcccacctgtcatgtggcctcctgtcttgtccacactcttatcaccctccgaaactcagctgatacatgtttgttttttttctttttttgagacggagtttcactcttcttgcccaggccggagtgcaatagtgcaacggcatggtctcggctcactgcaacctccgcctcccgggttcaggcgattttcctgtctcagcttcccaagtagctgggattacaggcgcccgccaccatacctggctaagttttgtatttttagtagagacggggtttcactatgttggccaggctggtctcgaactcctgacctcaggtgatctgcccgcctcagcctcccaaagtgctgggattacaggcatgagccaccgcgcccggccatgtttttcttctttttgttggaagagacagggtctcactatgttgcccaggctggtctatctactggcctcaagtgatcctcctgcctcagcttcctgagtaattgggattacaggtgtgagctgtgtgatctttgtaacacaacctgttccagatccttcaacagctccccatggcctgtggcataaagtccatggcatgggagccgtgacctggcccctgccacgtcctgccactcctgccccaccctgccccggatgcgcctgcaactccctggacgaaccaggctctttggtatctctaacgtttgtgggtgctggccccactctccagaatgttccctcatcccacattccattaattcctagtccccccactgaggcaggctcaggagttccccccttggagcccccagcctgggcttggtgcctcgccgtgtgctgggagggcactcgcagacctccagctccggatgttgtttctaattcctgctccccatcaggccacgtctttcccccttccccagcaccaagaacagtccctggcagagcagaggctgagcgtacatttggtgcctggaggaaggcatggcaaaggtgtctgctgtttgggaggctcagcagtgcagggcgagaagcggcccggacgcctggtttggcagccagaccactcgtgtccgaccccggctatgggaccacagccacctgttcagccttgctcagcgtcagctctttggtaaaaggaggataatcatcagcttccctacagcattgctatgagcattaaatgagacgatattttgccttacgggccaccaaccagccaactgccaacttgcaagtccactccgggagccatgtctgggacattaacggatattcactgtcccttggaggctgacggaagggggcacctcccaccccacgaggcatgaactggctctactgggctcaccagggtctctctagagcccaagccaggacaccacggagtttaatgaagacctgctggaggaaccaagggaatcagagtgagaaatcccttttgttccgggtggggagggcatccactcttgacttgggaacactcagaggttaggtttgggcccagaggagagaatgcagtctggaagccgccaggattcaaaccaggctctaggttcttgtattattccttccagcaaccccctaaggagcacttgtgagcgctgggactctgctggaggctgtgaggaggggctggaggagagagatgggtgttgggactgtgctggaggctgtaaggaggggctggaggagagagacgggggtcctacctcacagagctgagcatctagggagggaggaacacgaatccagaaccacacacggaaagattccaaaatggggcacacacggagaaggaagtgtatgaagggaagtacaatccagtctgcagtcggggagagcttcttggaggaagtgggattgggtgatgggctgagaagtcaagtacaaggggttaaggcggtgggggcgggagagggaacatggagccggagttagagagagaggtgaaggcctcctgggcccttctcaggggaagaaagcagggagggcaacagagaagagtctcacccaagactccaggacaggtgggacgggggctcttccagggcaggtcggtggggagttcccttccagggcaggtggggggttcccttccagggcaggtgtgggggattcccttccagggcaggtgtggggggttcccttccagggcaggtgtcggggttcctttccagggcaggtggggaggggttcctttccagggcaggtgggggaccccttccatggcaggtggggggggttcctttaccagggcaggtgtgggggccccttccaaggcaggtgggggggtttccttccagggcaggttgggggtttcctttcaggacaggttgtggtgggggggccccttccaaggctggggatagcctggagatgccacggcagaggaaaggggctagtaatggcgaggctgcgctttaagacaaaggactaaagaaagggtttttttcctcctttgcaaagagacatttcatgtacagttgccacttagggtttacagagtgtgggaaatcaatgttcgccttcgtgttcccatcccttggtaaagcacaaaactaacagtgaatgaccatgtgagaacaacaaacacattctttagtaaaagcgcaaggagaaatgaacgcacctcttcctgatagctggtcctgtaggatcgctccagctcctgatccaggaagttcaggctgaactgattaatgggcggcttaaaaaagtaatctttcatcaggctagaagacacaacaaatgcagtcgatcaatacccagcaccataactgtgccaatgttttcagatcataattagctaccaaaacgctgctcattaggtatattacaacagctgcgtctaaaagcgcctgtggaacagacgccactcagctgccccttgttaaaacagatctgtggaaagtccttcgcacctcaaagcataatcatattttgtgtttcaccttcgttaaagaatgaccatccaccatgattatagcacacatcatcagaaccttggttttttggggttttttttttttgaggcaaggtctcactctgtcgcccaggctggagtgcaatggcgcagcgatcttggctcactgcaatctccgcctcccaggttcaagcaattctcctgcctcagcctcctgagtagctgggattacaggcgcctgccaccgcacccagctaatttttgtattttttagcagacgcggggtttcaccatgttggtcaggctggtctcgaactcctgggctcaagagatccacccatctcggcctcccaaagtgctgggatgacagcgtgagctgctgaggcttgtttttgaaaacacattcctaatgtctaggattaggagaagatgaaggcagcttttctgttctttgaaacaatcttttgtgaagaacacgcagatcactgtgctgagagtacttacatggatttggaggcttcaaacgaaaacataattcagaaccggcggtcctgtcattcagagcactgacagtaattgccaccgtaaaagctaacaggttgttatcacaaaattgtgtttatagttagcgtaattttggtgctattgtcacatatgcagattgcatgtgaaacctgcagaatgataaagctcagtgattttaatagcagggaaatcaaccccgctttccatgactctttcattcatttatgaattgccagcaaatagtaatatcctttctatactgcagaaaattactagaaactaagggaacgttaacatgatttcagaaagcaaatatagctgtgttagcctctctccctcatacagtgactatcagaagtaaattagacgaggctgggcgcggtggctcatccttgtaatccccagacctttgggaggccgaggcaagcggatcacctgaggtcaggagctcgggaccagcctggccaacatggtgaacccccgtttctacaaaaaatacaaaaattagccaggcctggtggcaggtgcctgtaatcccagctactcgggtggctaaggcaggagaatcacttgaacctgggagatggaggttgcaatgagccaagatggcgccactgcattacagcctgggtgacacagcaagactatgtctcaaaaaaaaaaaaaaagagtaaatcaggtgaaatatgtcaagtgcctcatgtgccccccacacaaagtacggctcatcacgtgtgttccttcctgtccttgcagcacggcggacactctcctttctgtgacaggtatccagtaacttccaacattctcagactcagaagagaaataattctgtcccaggacactgaccctctctcctcccctgactcagggagtgtggactgagggaagagcaaccacgcagctgcagagaggatgtgcacaaggccacattttagcagtcaagtggcagaagcgacactgctattagctgtgctgctccatttatttcttatttgttttttgagatggagactcgctctgttgcccaggctggagttgcagtgctgcgatctcagctcattgcagcctctgcctcctgggttcaagcgattctcctacctcagcctcctgagtagctgggatgacaggcacccgccaccacgcccagctaatttttgtacttttagtagagacggggtttcaccttgttggccaggctggtcttgaacccctgacttcaggtgatctacctgcctcggcctcccaaagtgttgggattataggcgtgagccacagcgcctggctgaaaatcaccctttgaggcattatagtgaagacagaggcaagaatcatcaatgaatgttaaatctagggaattctgatggggaatgaaatatgtacaagatcttcaagtattttctcacagattgcttattagtcataagaggaatataataaccctagatgagacaacccggcaccaccttgcctaattaatcaaaattagtatcactaatgaggaacagacgggcactgcgtgtccctggagaggacaccctgaggaggacacggcatcccttctgcagtctctgcctggccagagggagagcctgaatctaaccaatccaacttcaggaatatttgataaaaggactggacctgtatttttcaaaaatgttaccattaggccaggcacaggctcacacctgtaatcccagcactttaggaggccgaggcgggcagatcacctgaggccaagagttcgagacccgcctggccaacatgttaaaaacccatctctactaaaaacacaaaaattagctgggcatggttgtgtatgcctgtagtcccagctacttgagagacctaggcaggagaattacttgaacctgggaggtggaggttgcagtgagccgagattgagccactgcactccagcctgggcaacacagcaagacctagtccttataaaaaaaaaaaaaaaaaaaaaaaaagccaggcgtggtggctcacgcctataatcccagcactctgggagggtggggtaggtggatcacccgaggtcaggagtatggagaccagcctggccaacatgatgaaactccatctctactaaaaatacaaaacctagccaggcatggtggtgggtgccagtaaccccagctacttgggaggctgaggcaggagcatcgtttgaacctgggagatagaggctgcagtgagccaagatcgcgccactgcactgcagcctggatgacagagcgagactcagtcttaaagaaaagaaaagaaaaaggcagagaggcttctgcctgcaacctttgctttttcccagacagccccagtcgtacctgtcttctttgataacgtccacaaagtgggcgtccgttttctcccggatgttcttgaacctcagcggaaggagagccgactggtccaggctcacccctgcccaccttcccttctcctgcaagatctcacacagagaagtctgactgttggtgagcttctcctcttggggagggctgaggagcccgttctgagttttgggattaggtcctccagaagcctgcctcgagacaaagaggacgcagacacgggaagtgaagtggcaccgggcactgggcacacacgcctgtcccaccccgacctccgctgcggggcgctgctgcactgggcgtgggactttctgacctgcgaggaacccccacccccctgcgcctacagacctgctccaatcccagccctgactgcccgtctgctccttcctgttacccaacagtgcccagtggtaacgctgggtgttcaggctgccaggacattgagacatgggaagagtcggtgcggaggtggaggggaagggaggaaagtgaggagccgaggcccccagagtctgcttaggccagaaccacggttctgggagcagggtgcatgggtcgggggtccaggagaagtatgacgaggggtccagggctgtcagggcacaggcaaggtggatggaaacgggctcgtgtcgtgggtgtcccccgtggctgtgggaaggcatgggatgacctgcacctgcaatcctttggcagatggagagcagatggaggacgagagcccgcgccccaggtgagtcgcctgcatgagcccccgccgacaggctctcgcgggtgggctgagtcctggccctggtgtccaagtctggttttcctgaaagccttcctgccaccggccctaactcccaacctctctcttcacccagcctttctcgccgtgaagaccccctcttgtctctgcccgtctatattctctcataaactgagtccagcttccagtaccacaaatcccctcccggcactcgaatccacgcattttaaacccttattggcctttaaaggaatcccgcccagctcagcccctgagcgctggtttccacgtgggttgctgctgaccctccctcgagctccctgccggtctcttcaacacccggaggacccgcgggtgcggagtgctgttacccaagaggagttactctcagaactaagaagtcgacaagacaggaatgtcaccttgggtggatgcgccaggagaggaactgacaggaacaacagccatgagcttgttaccttggtgctgtttttatgctcgtcttggcagccgttttgaggtgctcctccctcggcgccggcttcagatttgggagcaaatgtgattccgcacgaagggcaggtctagaagaaaaacacagactgtggggacacacccagaaaccgcgactgccaccctgaattcaggcaggtccgctgttgccatctgccgtcacgcagcatggtggtgagcaaggggaaggcacacagaaccgctcggggatgagctgaaagccaacgggcaaagtgacagtggaaacacacagaaacccgggcacgaacgcaacaggacccaaaaatggaaccgggaatgttcactgactgaacaatggatcaacaaactgtggtctattcgaacaatgggatattactcagccacgaaaaagacggaagcactgacgcctgccacagcatggtgaacctcgaaaacattatgctcggggagggaagccagacacagcacagatattacgtgatcccgtctatgtgaaatattcagaaaaggtgaatccttggagggagaaggcagattcctggctgccaggcgggaccgggggcaggaagggggagtggctgctaaggggcgtggggtttgctacgattcgaatgtttgtgccccctcaaaagtcagacgctgaaatcctaattcccaaggggatggcattggggggcaaagccttgggaggtaattaggtcatgggggacaagccttcaaaataggattagtgccctcataaaagaggccccagaggaatccctcgtcccttcgccctgggagaaggcaccatctgtgaagcaggaacgggtcctcactggacactgaatcttccgggaccttgatctcggacttcccagcctccagaaccctgagaaatacatttctgttgtttaaaagccacctggtttgtggtatttcaacagggtttctctttgggatgataaaaatgttctgaaattgatcacggtgatggttgcacaaccttgctaaatatactaaaaaccactgaactgtacactttaaaaagatcgatttttaaatattttttgagatggagtttcactcttgtcacccaggctggagtacagtgtcacgatcttggctcactgcaacgtccacctcctgggttcaagcgattctcctgcctcagcctcctgagtagctgcgattacaggtgcctgccaccacgcccggctacttgttttgtgtttttagtagaaacggggtttcgccatgttggccaggctggtcttgaactcctgacctcaggtgatccacccgtcttggcctcccaaagtgctgggattacaagcatgagccactgtgcctggccaaaaagatcgattttatagtatgtgaattatatctcaacaaagctgttattaagtaaagaaactggccaccaactatgcgaggacacaaatccaaggttcttaagctccgtgtgatggtgagctagtctcataagatgggctgaataatcaaaggtacacgatttccagatctaggcgtacttaaaagtttataggaattaatggacctagaaaagagaaggcaagatttaatacaggtaccctaaaaagagcaaagcctttatttctcataaactaggattcaaaccctagtcaagtacttactagtttggagactctgttcaaatcactttacctcagttccctcatctataaacaaagagtgaagatatgttgctaagaattaaatgaaattggctgggtgtggcggctgtaatcccagcactttgggaagctggggtgggaggatggcttgagtccaggaatttgaggccagcctgggcaacatggcaaaaccctgcctcaacaaaaagcataaaaattagcctggcctggtggcatgtgcctgtagtcccagctacttgtggggctgaggtgggagggctgcttgagtctgggaggtcaaggccgcagtgagctttgatggtgccactgcactccagcctggggcaaaagagaaagaccctgtcttaaaaaaataataattaaatgaaataagtatatatatagcctagcacagttcctggcatacagtatacccgtaataaacttattattattattaatgtgaccaggtaacctaggaaccatctaagaaagcaactaacagcttccaatgaagaagacaaaccgtggcaagaaatatatttttttttttttttggactcaaaagcaatttccttgcagcaagaagtgtaaaacattgaaataaattatgggaggccagatattattttggaaatttaaagtaagtgtcactacctaagggcaaagatatgacccaggttgtatttaaagttagactgcagacctgtactatattaaataaaagaaacaaagattctacagggttgtatagtttgggaatctgatgtaacatacaagctaaatttgaacatttgtatgcattcaaaaaatgaaaatatacatgccaaaacagctagcgaaatcattaattaacatatctgagcaaataatggcatctagataacatttgcttacagctctttaaaaactgacattatcaacagaggtaaaatgttctagttatcaataacatacagtgagtctatttgaaagcacctcttggtattgactggcagagttaaacttctaaacattttgctggtgtgctggctcacacctgtaatcccagaactttgggaggccgaagcaggaggactgcttagggccaggagttcaagaccagcctgggcaacatagggagaccttgtctctactaaaaataaaaccaattagctgaccttgatggcacgtgcctgtggtcccagccactcgggaggctgaggcaggaggattgcttcagcgaaggaagtcaaggctgcagtgcactgtgattgtgccactgcactccagcgtgggtgacagagcaaacccattctcaaaatacatatatatatgtataaatatgtatatatttgccaatgagaccactgctcttattaaatgtaaaaaaatctaacaccaagagaagaataaaataggtgtgcctgatacccatgcctaaaagatgcctgagggaactctctggtgtggctaaggtggggggcttggtgcttgatggggcacaccagccatttcagggcccaaccggtagaccaggaaaggaagctggaggtgtggaagcgtctgctgcacttggctcagccaaagcccgaagtgcaagtgcgtgctcagtaaatgctggtagtgaatatgaaaacttctgttaactatgctctctggtcattaaagttcatctggtaattcaatgtccttgattacagacagaacagcccttggtatctattcttctgtagccatttagtcacaggaatctcctggcgtcagtctgtttcaggtatttttcttgcctcaagttcatctgctgtgcttttctctctttttttgtttgtttgtttttttgggactgagtctcgctctgtcacccaggctggagtgcagtggggagatcttggctcactgcaacctccacctcctgggttcaagcaattctgctgcctcaacctcctgagtagctgggattacaggcgcccaccaccacgcctggcttatttttgtattttcagtagagatggggtttcaccacgttggtcaggctggtctcgaactcctggcctcaagtgatctgcctgccttgccctcccaaagtgctgggattacaggcgtgagccaccgtgcccggccaaccctcctgtgctttaagacgaggccgcctgcttcttcagtgccccccacggcacactggctttatgagattttctaagcatttagagccatgaatgtgtcaccgtgacagtcaaaccaacttggcaccagagggcacactgaggacagggggctccatgccctccacaagggcttccctcagaggggctggaaggccggtgcagcccgggcatgcccactgggatgaggctgagctctgggggcctggggcagtggtctccacaggtggggaactcagtgctttgcttacatccccttgaacagaggccgaggcctgcaccctgcagtgataagaagttctgatacagaagtgaggtctggcagagccgcccacaaatggcaaatgaggctgcgcttgcagaaggaagggggctgtctgggtcacatggccagctgtagacacccacgctcgggcctcctgagggccgggacagtgctcactgcctattccattcccagcaggtttgtccgggaagtgggagtatgggaggtggggggagagccaggtgcagactccaggccgcgctgggtggcatggtcccacagacctgtgtcacccggacccagcagccatcattttactgcactttgaaaatgcggattttggctgggcgcagtggctcatccctgtaatcccagccctttgggaggctgaggcgggtggatcacctgaggtcaggagtttaagaccagcctggtcaacatggcaaaaccctgtctctattaaaaatacaaaaattagctgggtgtggtggcacacacctgtaatcccagctactggggagactgaggcaggagagtcgcttggacccgggaggcggaggttgcagtgagcccagattgtgccactgcactccagcctgggcgacagagcaagattcctcagctaccttccttttgagggataattttctagataaaaactttcaaacaaatgaaacaaaagaaatcttagagctgggtgtggtggcttgcttgagcccaggagtttgagatcaacctgggcaatgtatcaagaccccatctctacaaaagctttttaaaaattttagaaattagctgggcacagtggtgtgtgcttgtagtcccagctactcaggaggctgaagtgggagggtcgcttgagcccaggagggagaggctgccatgagctatggtcatgccactgtactgcagactgggtcatagagcaagaccttgtctctttaaaaaagaaaaaagaagccaggcgcagtggctcatgcctgtaatcccagcactttgggaggccaacatgggtggatcacaaggtcaggagattgagaccatcctggccaagatggtgaaagcccgtctctactaaaatacaaaaaattagcctggcgtggtggtgcacacctgtagtttcagctactagggaggctgaggcaggggaatctcttgaacccgggaggtggaggttccagtgagccgagatggtgccactgcactccagcccgggcaaaagagcaaaactctgtctcaaaaaaaaaaaaaaaaaaaaaaaaaaagaaaagaaagaaagaaagaaaagaaaagaaaagaaaagaaaagaaaagaaaagaaaagaaaagaaaaaaagagaaatccatctacccaatggagagattctcacatctcaacatccccttctgagctgtagttagaggccccttctgtaccaggagggtcccaccatgcaatggtgggtgggtttgtttccctcccctgacctcctaccccccaacccccatggcaattttccttgagcgattcattagcttaattttaatctggattaagacatttcacaacatgttttttgccaagtacagatgcctctgtgaaatgtttcccagccggctaaacagcgtctccccctgcacagctgcaggcatctccacccctgctgagaagccctccctgggaagagtatttctgactccaggaagctgcaggcatggaagcacctcactgccttgggagacaaccctagcagctggctcacagggagccacacgggcaggcacattagagaaaaagcagtgtcataatgacagtagctactatgacttaggaatgtctatgggccaagatcctacccgtgaacaagtcgggcccccatccacgcaatatctgcagtctcgactgtatgatctcgtcctttgcagccacactgtgaggcagcaatgatcattccgcagacggccacagactccagggccctgggacccggaccaccgtcatatggctctggccccctttcctggcacaaggaggacccaggaataatcctggcaccttgctctcctgggccttgtttccctagagtgacctgagcagctatgcctgtcctcctggttcttccaagcagcaccctgggccctccggcatcaagggaagtctcaagacttctaaggtcctcccagcagcacgcctggcgggccagggagtttgctggctgttgcctgggtaacctgagattccctggagaacgcccaagagcaaactctgcatttttccggattatctttgctccttcccccatgtggacgtgggctttggagggaagagtgtagccatttctctaacacacttgggcacatttgcatttgtttttaacacatttcaggacgtgcaccctacattccggtcaaaatatatggcacaaagctataaaatcgttttttcttcaaggttatttctcatcacaagataaatcatttctaagccaacagctgtcccttttcaaaactgtcaagggagggagtggggaaacctcttttctcagaaatgaggaggatacaccagtagaagagccctggctttgcctgcttcgtcttctcaacacgactgttttgcaagatgtcgtgttatcagaagcatcctttgctcccaaactcaaaatgatgttaacatggtgagcaggaatagtcatgatattgcaaccacaataaccacaaacacaatttcctgaggtgttctttgaaactccttgtatctgcttaaccctcgtaagcaaccacgatgcaggtactatgatcggttccattttacagatgaggacactgagacagagcaagcactggcccagagccacacggtacggtcggaaccgcgtaaagaggcggtgagcccaggcagcagagctcctggccccaacgatctccaggtgaacggggcagcctgtcagtgcggcagagccatggggctaactctatgtccctggcattgctgtttaagctaacaggttaggtacgggcataagtacaaaatagagtatttctgctaatgcaacattagagaaaaatagaagcagaatattagaagaaaagataagcagtaattatcacagaaaaagaaattttcttacatccccaaagcagtaagaacagacagcagatggcctgagaatactagacaagtcaccacatgaacacacacgtgtaaaactcacacacacaatctcagagccacacggggcggagtcgaaaagtccctggacctctcactcaatcccttagccctaaaggaccactgggctcaataaccaggctggtgatggcgatccgagtcaagaatagatgaaaatatactcagcagactgtcaggcaggaagactgttaccagctgtggaaacagtccatcatgaagtcaagataagaaaatatttggcatctggggaaatttcatggaaatgcaatatttcactctctggcaatgccagttcaatgattccgcacatacatttccatccctctctctacacacacacacacacacacacacacacacacacacacacatatataatttcttactttgaaataattttagacttgcagagagtgggaaagacagttcaaggactctgcatatatcctccgtacatactcaccgtacagttatcaaaaccaaagcaactcatgctggcgcgataccgttaactaagctgctggctttattctgatgtccccagtttccgcaccgtccctttgctgttcgggtctcctctaggtcccgtgttgcatttagccctcatgccccctgctcacccccagcctatgggggttcctctgtctttctctgtctcttctggccctgctgcgtttgaagtcccggccaggcattttgtcaaatgtccagatctggacctgcctggtgctttctcagagcagactgaggtttggggtttgcggaaagaatgccgcagaggtgacatgcccttctcagcacaccacactagggtaccggatggcagtgagcagggaggctcacctggatcatttggtgaaggtggcatctgcccggtttgtccactgtgaagttcctattcctaccccgccccccacctttcttttttgagatggggtctcattctagtgcccaggctagagtgcaatggtgcaatcttggctcactgcagcctctgcctcccagactcaagcgatcctcccacctcagcctcccaggtagctgggattacaggtggataccaacatgcctggctaacttttatagtttttgtagagatggttttttttttttattgttttttttttttgagatggaatctcactctgttgcccaggctagagggcagtgacatgatctcagctcactgcaacctccgcctccaggttcaagagattctcctgcctcagtctcccaagtagctgggactacaggcaccagccaccacacccggctaatttttaaatttttagtagacatggggtttcaccatgttggccaggctggtctcgaactcttgacctcaggtgatccatctgccttggcctcccaaagtgctggaattacaggtgtgaccacctcacctggcggagactaccctttagttttacaacagctttcttaagatgtcatttgcaaagcatataatgcacccatttaaagtatataactccagggtttatagcatattcacagggatgtgcaagcatcaccactatcaattcagactaccacttataataaatacctatttaatttctaagctatatatatttatatatgtatgtgtctataaaatatgaaatcattttttcaatttctataacgaatgaaaagccccttacttcctcaaattgggccaactgagcctactcataatgacttgacacatagaaaacaagtagataaaagaagttatcatttagggtcattttcaaaattcactgtcacaaaaggatggttcctgaggtgagtggccttaaaggggaaggagaaaccttttgaaagcaggacaggtcctctctgaatcatccccgtatgggtaaatctacatcactagcttcattactgactggtccatgtagaaacacccagtggccaagcagcccggggttctgaataatagatgaaggtaaactcaggaagaccagccacgcaggtgcgctccagggaggcctttcagagatgtactaagatgctttcacagctcaaatggttccctgatcagaagtaatgtgatacaagtaattcaattttgggttttcttttcttttcgagatggagtctcactctattgcccagtctgaagtgcagtggcgtggtctcagctcactgcaaccttcacctactaggttcaagggatcctcctgcctcagcctcctgagtggcttaggactacaggcatatgccaccacacctggctaatttttgtatttttagtagagatggggtttcaccatgttggccaggctggccttgaactcctgaccgcaggtgatctctctgcctcggcctcccaaagtgttgggattacaggcatgagccactgagcccagttgggttttctttttcttcatgaagatgttggaaaagctgtttttattgatatatggcatctagatccactcatcacccacagggttcatgagaaaatggaaagcaaatgcctgctggagcgctgacgtcacattcaacaggccaaggcacacatgctcccgtgtcatacaagtgacttggttacggccgagagcatccaacccacagcaatgctcagccgcaatcactgtgagaatctccctcgaatcggaaccgtggagaagatgggaccttccccagagagtcagtgacttcctgcaggcaagctgggaccgtctctcggcccctcccagtcctccatggctccgtctgtggtcactgtccctgctctgcgtggagtgaaggcgtgcgtgccgagtgtgagcgaggcttcttctcagccctggcgtccacaggcaccattccggctcatctcccagcaatcccgagaggtctcttccttatcaccaccgcactgaagaggaaaactctcacttagaggaattaagtgtgtgtttgctctttcttttctttttttttttttttttttgagacagtgtctcattctgtcaccctggttggagtgcagtggcatcatcacagctcactgcagcctctaactcctgggctcaagcgatcttcctgcctcagctgtctgagtggctaggactacaggcatgagccactgcacctggctgcagtttcttcacagtcgcaaagccaaggcttgagaagggtcttgcttcaagttgcgcccctgcccgccgtggtccgcctcccctccgcgacgctgacagtggcgtcctcatgtctaatgcttactccttggtttccttcttgacctctccttccttcactcgggcagtatctgtcccccacattatgcaatgtcagggcccttaggatgaggacctctcactgctggtcatttcaagaacccaaggccaggcacagtggctcatgactgtaatcccagcattttaagaggccaaggcaggaggatggtataaccccaggagttggcaaccatcctgggcaatatagcaaaaaaaaaaaaatttaaaaattagctaggcatagtggcacatgcctgtggtcctagctactcagcaggttgacttgggaggatcacttgagcctgagagtttcgagctgcagtgagctaagatcataccactggtactctagcctgggcaacagagcgagatcccatctctttaaaaaaaaaaaaaaaaaaaaaagaagccaacacttgggtgtagaaagggttccctttgagctatgacttcaggaccaaagccctggcctttgacatcactatcatttcctggtaggtcgttacagtacacaggttatgttacattagataagaattttccagctatgacctaggagatgacttaaggtcacagaggacacacatgctaagggcaggaaataaacccttcgtgggcgctgccctggttctacacagttctgctcgggcttctgacttcagtccttcgcctggctctgcagagctgcatcgctccatgtgtttaattaaagaattaaaaagccaaaaagaaactgttaattactacatgccaggcaccatgctcgacacttgggaaatatttaagttatttaacactcagtctctgaatgcaaagagctcccaggaagacgcataagaaacaaagatttaagatcgtgtatgttacagccaagtgggacagactgaagggactgagaatttggagacgagggaacagcgttatcagctgcggaggcacgggaaggcgtggtggagctgaacggtgaatgcagacaggagttcaggggaaagagaagccatgagtatctcaagtgagcagcagcaggaacaggacacacgtgaaaatctacgcatgctccttcagggaacgtttcctgaacaccttttctctaatgtattggtccttggcatgaaactccttttactacatgagcattcccccaaaaggtgtgaccacattagccctgcaaggtgcagcttgaaaaaaaacaattgtgctcaaagaggcctgagaatgctgtatataccgcgtcctcctctgaaggcctagctactgtctactagcctagtgaaggctccgagaagtcctgcagtaaagaaaccctttctgtgttgaatatcccaagcttcccgaatttactttaccactgagcaccctcctccctttttttggagacaggacaaggtctcactctgtggcctaagctggagtgcagtggcaaaatcatagctcatgcagcctaaattcctgggctcaagtgatcctcttggctcagcctcccaagtagctgggaccgcaggcacaggccaccaagcccagttaatttttaaaatttttttgtagagatgatgtcttgctacgatgaccaggctggtctggaaatcctagcctcaggcatccctcccacctcggccgcccacagcaccaggattacaggcgtgagccaccatgcccggccttctgtcaacttgatagatcacaagattctcagaaactttcaacaatatttggaaaatctccacatgccaagaagatacgctaaatggtttttgctcattccgaccaaaacaaatatatatgactagagtgcaatgtagtgtagaatcgccattgctaaaaccgtggtcactaaacccgtgagcatgtgatatggtgaactctgcgaccgcatcccctaacggacagaaacacacatatgtggaagctaaaatggcaaacacaacgaattatatatttttggctcggggctgtctttcacgacttaaatacagctcagtttgcaggctggaggaaacaattcttccccaaatagcaaaaccattcccgattccaccccacgccagcccctccctgcccgggtccgctgtctaggagcccagagctccattttctgactcctgcacaacgtcagcccaggcaaggcggctgtctctaaagtttgcaggcatccagggaatctcagatacatgagctttacacatgtgccaagagtacagggaagagagggtccaacaccactgtcccggtggttttcacccaggggtgactctgcacccccaggggacactgggccatgtctggagacatttttggttggcacagctggggagtagggtacgggtgggtatgctgccatctggcaggtggcggctagggatgctgccagccatctgacagtgcacaggacagccccacaacacatgactacctggtccaaaatgccagcggtgccaaggtgagaagccctgcattacactaacaaagcacccaacgaccgcgatccacgagcggagttgacagaacccgagtgcaatcattacgtgtaactgggcgacaggcactatgtattctgacccagtaagtaatctgcataccccagctgactgccacataatgaagactgttcctcgtaaataccaatagcggctttcaaacctgtgaatgaatgtggagaggcagggacgtattgggtgaagctgtaaccactggccgccatcctcacacataccccactgtgttatctgagaacacaaagcagcataggagagctgttttgattctctgtctcattttaagaatggagacagtagatgtttaaactataaaaataaacagaaggtaccagtggggaaactaaatcaaatgtgaaagcaaaggaacagctcataaactgaaatgatttcacacacccaaggtcgaccgcgccaattccctggtagtttatgatgacaggtcagtccagaaacgggcacttctaggcagctaccaggagatcccggttccaataatgaaatactacaatgttctcggcagcctgtcctctcagtgagctgtgtcctaggattcacccacaccaacatcatttcaagtaatcataaaatagtggatttcaagagacgtagaagtatttgagaaagtggtctctgaaatcagattatcaactagctctccacccaaggtgccaaggaaagccacctttactgtcatttatcaccagcttctagaaatcccaaaaggcaccacaggtcccaggaagagaaaataactaataattcaaatgagaagcatccttgtgcaatggaaaggcaatggaggtgcgtcatatgtcaaaaagcaaggatgttaaaaatgcagaatgctactaactttagactaaatattaaaatcgtgaaaaccaaatcgaaggtcattccaagttgtttgcctcagacctggaggctgcttattatttcacgtgctctactgcagaattaatagaaagttttagaagtaggaaaaaaaaaacaaaaaaactaaccttaaggttatcaaaggttttgacagtctgcgccaagtcactgacattccctgatgacgctgtcccctgtcccctagggcctgaggacacctgtgagccgtcaatgacctcaaagccagaaagcaaggcctctgcacagctgcagcgagactccttggctctctgacccgatatcaggtatgtcttcaaacctatgatggataaaagttacagtcagcacagattgaaagcaccgtctgttgaaacgcagctccgtcttgctctctggagaggactcactcctggaaagttgagagtaaagtgaaaatgtgaataggtcatagtttacgacggacgtccacgatctctccagagagatgcggcctcagggagaccgtgggcccccgagacacaccactcacccacgttacgttttcttggagtaatggctgcatgtttcatgttttaccttcagggttaaaataagcattaaaaagttcctccatgaaagggtcccaggacctccccgtgaaggcagcaaagcagattggttgaccctagacactgctttggtttatttccatctgtgaataccagtccagtgagtaccttcctaacggtcagtctagacgtcatggcagcttccggtactgaccatcttacctgtgtcagaggctgcaaaactaccccgaaaaacaagaccctaccagggaccaagaggccattaaaacctccccagactcagagctgttgagcatctatttcctgttggattcaaacactcaccccaggaacattcagcttttgttaagctgaggtccacatgcattttattgtctcacaaaatcccgcatatagaaaaaaaaaaaaaaggtggtcaaaaggacacttgacctgtatctttacaattctcctttgaggctgagctaacagccggacccacactgcgctggaaggagctgtgaacaggtgggtggatcctgccccgggaatctgctgggaagatggcaaaggagcagcttttctagaaagagcccaaggaatttttgaaaaagaagcaaactttatttaaagaaatccatcctttgacttcactggaatttaaccagatggcaaatgtatcggaaggagggacaatgtaatttaacatttaaataacatttatttcaggcctagtgtatgccacacaccgagaataaaatcatgaacaaagcagggtcccttcttttttttttttttaattgagatggagtctcactctctcacccaggatggagtgcaatggtgcgatctcagctcactgcagcctccacctcctgggttcaagcaattctcctgactcagcctgtgagcaggcaggtgtccaccaccacgcctggctaatttttgtatttttagtagagacagggtttctccatgtcggccagactggcctagaactcctagtgatctgcccaccttggcctcccaaagatgacaggtgtgagccactgcacccggtcgcagggacccttcttgaagggtttaagctccagcttcaggtcgtgaagggtgtggcatggaaagatgccatcgagaggcgacgtgtctacaacactgatcgactctggcttcttacgctgggtacatatttggtcagcgctttaaaattaattaatcagaaacctagggactacttcatcaataatcccgaatcattttataagtatggccccatctcatcacttcacctccctctctccttgtaaaaatactacgtggctaatctttttaagtcaactgttctgagaatttgccaagagtcctagaaacacgtaaagacagcctagaacgtagccaggtcatagctgagaatcaaaagacttagatatttttagatgccaactggccccaagaaactcttcatgttttgttttgttttgttttgttttgtttttcctttagagatagggtcttgctctgttgcccaggctggagcgcagtggtgcaaccatggctccctacagcccccacctcctatagcctcagcctcctgagtagctgggactacaaacgtccgccactatgtccaactatttctttctttcttttttgagatgggggtctcactgtgttggccaggctggtctcgaactcctagactcaagtgatccgcccatcttggcctcccaaagtgctgggattgcaggtgtgagccaccacacctggtccaatgaaaatctttcactcttacttagctcctgaacttttgtgcatttttttctccaacaaaaacccacatcccaatttatgcacaggatcaatcacgactgtaacatgtatacactgaaatggaaacgtgaactggaatacgacgcaggagtgaagccatctttatactaatttctcggacctgtcccaggcgacaccagactgactttgtaacttcactttgccagagttaaaaaatgcaacctatgtggactcaagagaggacaatgagctgccagggcttatacccgccttcatcaaagaagtacacgcaaggaggcctgtcctggggctgctctaagggtctccttcccatgactcctgagtgtggcccacaagtcaccaggtggcagggtggtgacaggagccactgacagccagtgtgactgtggatggccactctggagaccgcagtccccacatactgagagaggagggacatttttttgatgggaggtaggaaaagttgcggctgaaggatgaggttttccattatgtctgtggctggccctgcaaggtgctgttggctcagggtgcccctgcctgaggctacggctccccatgcacaagggctgccctgggagcatgaactgggctgcctctgaaacccaggaaggggccctcacccaggtgactgcgcacctgctccctgtgtggctccgggactgcaagagaaagtcaagatggcctctcctagaagtgcgtggcaactgaagctgagagaggctgagcagggaggcctgaagagctggagcacgacgggacagccagcacattcacagcgctcagcacggcagtccacggggagcacggagtggcagcggcggcctctgctcacaagctgggcacgtgcctcaagcacatctccaacgtctgctgttgcttttttgtactgggattactgagtcactcttaattcatcaaacatttattaagcacttcctgtttactacacactgatgggtgcagggacgatgtgtgactattttggccgagatcgtgacctgtgtggagcccattacctgaagaggggccaagaggacaagcaggtatgactatggtcaggcgtgccaagtcccaggacaaggaaggacgggtgctccaggaagcacaggagggggcatcttgagaagcctcaggaaggaaggggctgtggctcgaacgtgtcccctccaaagttcaggcgttgtggagtgagagtcttaaggaagcagggctttaagaggtgacgaggccaggagggctcctcccctgcgatgggatcaggcgcctgcataaaggggcttgctgtaaggggctctctcgcttgccctccagtttccttctcccttccagaagatgcagccctccccagacacctgaacctgctggtgccttgatcttggacttcccagcctcctgaagcatgaggacagaaatttccgtgctgtatagattacccagcctatgctgttctgttattgcttcacaagcagatggagacggacggatcagcaccctccacacggagaactgaaagacggggcgaggtcagcccggcaatagcaaaccaggccaggggcgggggtggctgacaccaggcaggggggttactagaacaggtcatgaaaggccctctacagaggtggcctgcagcaggcatagctaaaggatggcttggagctcagtgtggctggagcagagaacgtgtggagggaatggccagggctgagccacagcacctgtgcagggcactgtgtgggccatcctgggaagcctccattctggggccacgggcagcaggggggcgggaggagaaagaagagccacataggaggcatgaggcgtaggacaagccagggagccggtggaaatgccagccacagcgggtgggaagttgggaggcacgggagtcaggaaataacagtggaaacgggaaacctactccccacaaactgctggcgagaggcaaggctcccattacaagcaaccaagcgtgatgggcgagggcctggctgctggagggggcctcggagtcgggtccaggtccgccccctaatcccgtgatctaagtgagctgcttcatctctgcctctcagtttcctcatctctaaggggagggcaggagcagagctagtgagctgcttcatcgctgcctctcagtttcctcatctctaaggggaggacaggagcagggctagtgagctgtttcatcgctgcctctcagtttcctcatctctaaggggaggacaggagcagggctagtgagctgcttcatcgctgcctctcagtttcctcatctctaaggcgagggcaggaggagggcttaccacacagctcgcatgtgaggcttaaatgatcaacacgcacgcagcaagcactcgacattagctgtgattatcgacgcagtgtttgatctgcgtatcactggaatctttttcatgcaccttctacatacaaaagcatttgcaaaactgttaaatcaataattgctcctgatttgtttctgacttgagtttttctttaggaagcgctgaatgaccaacccatagtgataacatgatcctactagctttacgaaggtcaaacacacctccgtgtccacaacgagcaaaatcgggaagtaaattatctttttatttatgcttcaatatggaaagctaaatttaaagtgaaaccttttgtcagaaccagaagggttatcaccctgacaggtaaggcagagcccagctgcctaatcacaaacgcctgagaaatacatcaggacaggttactgagttcaagcccagcgaaagtcttaagtcaggagactctgcaggcgacatgatttaatgaataaccacacacatggaccctggggtccaagttcattagaatggctcttttgcagcagaaggtccaaaaaaaaaaaaaagacagctaaatgatttaagtgtagtgtaaacaggagaataattaatatgatttcttatattctttcctggttatccattgattttaaacctcaacaacagcgatgtcttttatcagcttaattttacaaaggctacagagaggggtgggcatttcctaatgggctcctgtctgacgggggaatttgtctatggctgtgtgcgtggaggttaacgcagttaacgttcttaagtattcttaagtatagtgtcacttctttgaaaactaaaactgcactttgcacatagtggtgatcaggtttggtgacccaagtataggaagagtgactgacaaagcccattttggaaaagagtgatgggcgaggcccatttctggcctcatttgtcccagtctctttctgtgggattcttgccttggactgagataccctcagccaccaagaatcaaggacctgactgccaactcaacagaaagagaacaacagcgaggcacggggatcacagctgtgaccccggcactctcggaggccgcggcaggaggatcacttgagcccaggagtttgagaccagcctggacaacatagcgagatcccatctctataaaaaatttaaaaatcagctgggtgtggtggcacctgtggtcccagctacccaggaggctaagatgggaggatcacttgagcccgggaggttgaggctgcagtgagctgtgagtgcgccgttgcactccagcctgggcaagagagtgagaccctgtctcaaaaaaaaaaagaaaaagaaaaacaagccaggcgtggcggcacacgcctgtaaatcccagctacttgggaggctgaggcaggagaatcgcttaaacttgagaggcggaggttgcagtgagctgagatcgtgccattgcacttcagcctgggcaacaagagtgaaactccgtctcaaaaaagaaaaaaaaattaaaagaaaaagaagaaaagaaaaacaagaaagagaagaataatcaggaaggaaagaatgttttaagacatgactttgggagccagccacatagcataacaaatgcctagaagcttacgtcacttatgacttaaaacaataaacagaaaagaggcaatcagcttgggctggttcagaaacattccaaaaacgtctttcactttgcattgcattcttcctcacgactaggtcggaaacgaccaagcggcatgagagttatttaaactaaactgtaatcagccaataagaaaaataaagataaaaatactcttaatctaccaaatagccaaagcctatggagtcatagatatattttataattatctattctttctgcgtaagaagaacaaaagttttggtacaaaagagagaatatctttcatatgttaacattaaaatgctctccggagggttgtaagtccttcctactcatatgcaccataaataatcataagaactgatttgttcttgttgtcccaatatttgatgataaatctcaagttcctactacaaatggctgctggtgaaacttaacctcttcttaacaaatgaagtcccaggtcaggcgcggtagctcactcctgtaatcccagcacttagggaggccgagacgggagcatcagttgtgctcaggagtttgagaccagcctggccaacatggcgaaatcccgtctctactaaaaatacaaaaattaactgggcgtggtggcacatgcctgtaatcccagctactcaggaggttgaggcaggagaattgcttgaacccaggaggcggaggttgcagtcagccgagatcgcaccattgcactccagcctgggtgacagagtgagactttgtctcaaaaaagaaaaaaaaaaaaaaagaagtcccaaataataaaatatgagatggatttatggaagaaagtgaaagaaacaaagggtaggcaccttgcctgtttaatttgatcttctgcttaaccaaaaaaaaatttttttgtttttttttgagacagagtcttgctctgttgcccaggctggagcgtagtggcgcgatctcagctcactgcaacctccgcctcccgggttcaaggaatactcctgcctcagcctcctgagtagctggaattacaggtgtgtgccaccatgcctggctaatttttgtgtttttagcagagagggggttttgccatgctggacaggctggtctcgaactcctgacctcaaatgatccgcctgcctctgtctcccaaagtgctgggattaaaggcgtgagccaccacacccagccagaaaataaaattttagagcatgtgcacgcattctctctctctctccctcccgcttccccacccctgcttctaaacaggtaccttctatacccagcttccctctctctcccagtaatggctaaacagctgccatcacagccaaatgggaatgacaggcatcccctgagtgaccacattcccctgttttggccttttttttttttttttttttgagacagagtctcgctgtgtggcccaggctggagtacagtggctccctcagctcactgcaagctctgcctcccgggttcacgccattctcctgcctcagcctcccgagcagctgggactacaggcacccaccactatgcctggctaattttttttgtatttttagtagagatggggtttcaccgtgttagccaggatggtctcgatctcctgacctcatgatccgcccacctcagcctcccaaagtgctgggattacaggcgtgagcgaccgtgcctggcttggcttcttatcttctgtattccgagttaataaatgccccactgctaaatgctacattccagaatgctaacatagggagagtccaggagtccacacacttcagagaccttcgcctcccacctctaagaaacctcttgaattagggtttactagcacgagccttcacaaagactgtagaaatgagtctctgagagacgacacccagcacacccagcacacccagcacaccagcgaacagcccaccaggtgctatcgctgtcattcatttgctcattcgctcgttcatgcacccagcagactaaatgtttactgagtacttaccgaaggttaggatctgggctaagggttgaaagaaataaataggttaaaaaagaaaaaaagccacctaggtgactttcactccaatgcttgacctcagttcccttgtctagataatggaaatgctggccggcgcggtgactcacgcctataatcccaggactttgagaggccgaggtgggcagatcacttgaggtcgggagttcaagaccagcttggccaacatggcaaaaccctgtctctactaaaactacaaaaattagccagctgtggtggcaggtgcctgtaagtcccagctactcgggaggctaaggcaggaaaatctctcgaacccgggaggcagaggttgcagatagccgagatcacgccactgcactctagcctgggtgacagaatgagaccctgtctcaaaaaaataaaagaaaaagaaaacgaaaatgctgtgatatgatggtcatatcatagcacagggctgttgtgaggattaaatgagttgattcaggtaaacagggacatccgaaaaagggaaagacggtgcttgtcctgagaacagctgtgaatgtgaggacagtcagtgagtgacgatctggacccacaagaagagagtcatatgcattcaagtccaagtgtctatgggctgttcagaagcaacaaatggcacttcaacaatgagttgcagacaacaaaatggaaatgaaggtctgcaataactattaagaatcctgtaacagagcagagtttaaataatgggaagaggctatgaaacaagagagctggggaaagataccagaactgaaacagaccaccagctgatcaccttttatttgtgaaatgacagcaccaaatgcaccagatgccacagacgggagggagggggataggtcacgtcggcagagggagggggtcaggtcacacctgcagcagggacgggggtcccagaccgtgttcttgtccctagagagctaacagctcatccgtaggtttctaagaggtgctgattcaagcacacagtgtagatgatgaaaaatagattatagaaagaagagaaaggaaaaactaaatttaaaatctgagactaggtagccactaaatacttgaaaacaaaaaaagggaatacactgaaaatggaaataaagctgtatgatgtttagttaaagaagccagtcccaaaaggccacgaactaggtgatcccctttatatgaaatgtctggcatagggagatctgtagacacagaaagcagatgagtggctgccatgggtttaggagagagagggtgtaactgctaacggatgcagggttactttttggggtgacgaaaatgtaaaattaggttgtggtgatggttgcacaacaccatgaatatactaaaaaccaccaaatcatacacttgagagggtgaattgcatcatatgtgaattatacgtcaataaagctgtttttttgaaaaagaaaaggaagctgggtgtggtggtgcatttctgtgatctcagctacttgggaggctgaggcaggaggactgcttgagcccaggaaatgaaggctgcagtgagctatgactgtgtcactatgctccagcctaggtgatagggtgagaccctgtctcaaatataataataatattaataatacaataaaataaactaaatacagtaatgtgaacatcaacaaggtgcaataattctgagatttagagaagaaataaaataaagctgggaagaaatacaccctccctgagaatacaaggtagagtgagcagtagcaggtaaatgaaaaatattaaaggcttagaaatagataatgtgggccaggcatggtggctcacacctgtaatcccagcactttgggaggccgaggcggggggttgcttgaggtcaggagttcaagaccagcctgaccaacatggtaaaaccctgtctctactgaaaatacgaaaattagccaggcgtggtgatgcacgcctgtaatcccagctacttgggaggctgaggcaggaggatcacttgaacccaggaggcagaggttgcagtgagccaagatcgcaccattgcactccagcctgggcagcagagtgaaactccttctcaaaaaaaaaaaaaaaaagataatgtggtagagctagggcagaaaaacatgcaagtcaagaataaggccaaataaccttgaagaactaaaaattcaacatagcaaaagttcagaagtctgggagagattaaataaaacaaaacaaaagaaaatttgaccttcatgaaatagctccaagaatcatccaatttgcagctctcactattgtagtccaacctaaaaacgccgggccgacacccacattgtcttcttcgagcacaaacacacttctcctgcagcaggtgtagcccgcacagcatggtgagcccagccacacccgcacgccagacgcttggccacagaaacgcagaagcggccactgtccttgcctggaacacagatgggccttttcatccaggaggagatttacttgcaaaggcattttcttctgacccacaggtggttatacctgcactgacacctcctgtgggcatcttcagctggaagaaaggccaccgaggctgcggagccacctcgcctgtaaacatcatatcatgcaaaggaaaagctctaagttgcggaatattcttctctttttttttttttttttgagatggagtctcgctctgttgcccaggcaggagtgcagtggcatgatctcggctcactgcaacctctgcctcccgggttcaagcaattctcttccacagcctcctgagtagctgggattacaggcacctgccaccatgcccggctaatttttgtgtttttagtacagttggggtttcaccatgttggccaggctggtcttgaactcctgacctcaagtgatccacccgcctcggcctcccaaagtgctggaattacaggcgtgagccaccgcgcccggctgatgctgaacatgcgtgactaaccttccgcgggagcagtcatgccgctgccttcaccacctgttgcttctgggaaatgtggatccaggctgctggctctctcccagatcgtatctgcagcacaggcacatgcttgctgtgaatttccacacttgtcagatcacccggttttcaacttgttttctagttttctctcttttgaagagtattttgcacactggctggggcagaggctgacagtttcccagactgtgttttcttgtttacagagcacatgcagacttgttcgagtcatctaacggagaaacccaaaaacctccattttctcctgagatatctctgctatctctaatttcacttcagcagcactggtggctgaaatactatggactatgtatttcggacttcctttttctgaacttttctggaagaatcgcagttgtgtgtgtgtgtgtgtgttttgttttgttttgtttttttaagagaaaaggtctttctctgtcacccaggctgcagtgcagtggcatgatcacggctcactgcagcctcgacgtcctgggctcaagtgatcctcccacctcatcttcccaagtagctgggatgacaggtgtgcaccaccaagcccaccttcttttaaaaaaaaatttttttttaaagatggaatctcactatgttgcccaggctgggcttgaactcctggcctgaagtgatcctccggcctcagcctgccaaagtgctggaattacaggcatgaaccaccatgcccagactcaggtatttattaataacctcaaggtgttgctgcacattccataagttgagagcaggtccactctgccacccagggatgtcccaggctgggcgatttgttctcccactgcacaccatgcaactgtcatttatgccttaagaaaatcccattgaagttgtggactcaatgcacaatcaaaactgaaagcaaaaccgaggcagtgagtagtgagtgcccaagcacgagaggaggggacaaaggctgggtccccggccatcaacaaacggagagctagctcataaaacagtgacctggagcttcagtcagcagccctcactcccaaaaggggtgaggagtcttcagaaactcccctgtcttatggcagaaagctgagctctgcacagaccctggaaaaaccactgttgtcaaaggagagatggaagtgggcagaaagcccaggaaggagggttccagactagtggaggtactagcctcaaacaagacagctgagtacttagagaagaagagatacatgccaggcatggtagctcatgcctataatcccagcactttgggaggccaaggtggaaggatcacgtgaggtcaagagtttgagaccagcctggccaacatggtgaaaccctgtctccactaaaaatacaaaaattaaccgggcgtggtggcgggagcctgtaatcccagctactcgggaggctgaggcataagaatcacttgaacccagtgggtgaaggctgcagtgagctgagatcgcgccactgcactccagcctgggcaacacagcagactccatctcaaaaaaagaaaaagaaaaagaaaaagaactttctatgaacttcccgtgatgatgggtacatcctgtagccgtccagttctgtggcctccaggcacatgtggctactgaccactcgaaatgtagctagtatgaacaaggaattaattttttaatgatttcaattataatttaaattttaaacagctacatgaggctggcagctatgtaggaagcagtgaagatccacatccttccttattggtgaaaggaatgaattggaaacagaaagttcttttttacctttattaaataaacgtgaagtcataagaactactaaaagaaaatgggtgggataaaagtaaaactaaatatgaaaccagtaagtattcactgttatttattatagatgacatttagacgcaaatacgagagggagagtaccctgtatattaatagcagggatagccaattacaaagtggaataagccaggcgtggtggctcacgtctgtaatcccagcactttgagaggctgaggcgggtggatcacttgaggccaggagttcgagaccagcctggccaacaaggtgaaaacccctctctactaaaaaatatacaaaaaattagctgggcttggtggcacacgtctgtagtcccagctgcttgggaggctgaggcaggagaatggcgtgaacccaggaggcggagcttgcagtgagctaagatcgcgccactgcactccagcctgggcgacagagcgagactccgtctcaaaaaaaaaaaaagaaagtggaatagaaacagttactctatcgaacaaaatagcagataatgttttagaataaagaaacaaaagagctggaaacatttgaacgttttcaaaaaaaaccctataagtgggatgagatactggttcacaactctaatttagagcctatataaacacattagcttgaccttgcttgacatacattatttctaaaaaatgttttaaatgtgaatatttagaagatacaccatattttctgctttttatatactataaattttactatgtgagtttaaaaagtggttggtaaaacacacacccaagctctctgatctttcacacccattaaaagcagcacatgtattaaacacactgctgcacaatgggcgtgccatgggtgctctccaaccgcattgggcttgaatgtttaactaggcctgaagccacagtgctaacaagatctggcagagacagacaaggccacgccggcagcaggtgtttcaggaaaggtattactccaccatcccttgcgctgaagccttagcctcaggcaaattcatgaaccaggtagaatctaattcaggtcactttggccaatctccactttctaccagcctcctccaggtccctactgcctcgggaggccccctacccacctgccaacctatcccctcaccatctaccggcaccaagtctgtgtgagcacactgtagatacacgagctccgtcccaactcagagctaggagagtatcagaggccaaacgcctgccccctgcttctgggctccaccagcagcctgggaggccaccccctgcagctgactcatctgcatactgagacttcctgacacaaatggaggtgacaatattcgttcccccatcatatcccagaaattcccttattgccgacatccattctgggtttttactgcgcttcacacgaggacaattccaggctgaagtggcaggtcccagcaccagactccacttcatcagaacacttctgttagagtctttgaaacgcatgaaatcccctttagggtccataataacgccttctggaaactcgacggcaagccactcaccctcagccctatcagaccccatggctccttacatttctgtgacatacttaatttgcaatgtcctcttttccatcatgaaataaaattaaattcatggacaacataacctttaatcactgagaccataaaggacacctccagcagctgactagccttccctcagccacctttgtgcccagcctaagggcagggtggcaccggagcctccatgcttcaaaggtggccaccagggcccatccccctttccatgcttctccctgcccagagagaaacagcctgaggacaggttaaagactaaatacaaccaggcatggtggctcatgcttgtaatcccagcaatttgggaggccgaggtgggaggatcacttgaggtcatgagtttgagaccagcctggccaacatggtgaaaccccatctctactaaaaacacaaaaattagccaggcctggtggcccatgctgtaatcacagttcctcaggaggctgaggcatgagaatggcgtgaacccgggaagcggagcttgcagtgagccgagattgcaccactgcactccagcctgggcaccagagcgagactccgtctcaaaaaaaaaaaaaaaaaaaaaaaagactaagactatgccacaattccgcatatgcatgtatttattatatacatatatgtataaggtacatatttgtatgtgtatatccgtgcatatgtgtatacctgcagcaattttttttaaaaggagaaaataggccagagccagtggctcatgcttgtaatccccgcaatttgggaggctgaagcagaaggattgcttgaacccaggaattcaaagcctcagtgagctgtgactgcaccattgcactccagcctgggtatcagagtaagaccctgtctctaaaatataaattaataaataaaaattaaacggagaaaatttcttaacaacttttatcctattcattctttcaacacataataagctcctgaaatccgttaagaatgagattagacctattctaaatcctactaacaccttacattgactctgtcttattaatctcagtactgtagtacctgggggaaggcgcagcaccgtggacactcagaaacgtcaagaatcaaatcacatctctacaacggtggtccatctgcaaacagcgtggagatcaaggaagggcagaacaaagtactgaaagtgctgtcatttctctggagggtgaattacacagaccaactttcttcacataataagaaacaagaagttgtttgtttatgggttctatgggagcacccgctgcaggccacgctagacgctggtgataaaactgtgaacatggcgtccatcacctgactcagtggtaggaaccagtggcagggagaatccacaagcaaggacccgagtcaccagctgtgattaagagccaggaagaaagcaaaagcttcctgcaatagagaatacccaacatgcggtttggacagagtcagggacgtcctttctgaagaaatgagactgaagtggagatatcacagtgagatggaggcaattgcggtggtgtaggtctggggaaggcacgagggatgcagggatcagcatggaaaggacggtcccagcatgctcacgtggctgaaaggtggcaactgttcccgatgcagactgagggaagaaagtgtggcatgagaggaggctggggaggtgggccaggccctgggagccattaagaggtttctgcctggccaggtgcagtgattcacacctgtaatcccagcactttgggaggccgaggtaggcggatcacttgaggtaaggagttcgagaccatcctggctagcatgatgaaaccccgtgtctactaaaaatacaaaaattagccaggcggggtacatgcctgtgatcccagctacttgggaggctgaggcacgagcatcgcttgaacccaggaggtggaggctgcagtgggccgagattacgccactgcactccagcctgggggacggtaggagactctgtctcaaaacgacaagaggcatctgacttacatgctaggcacacacaagagctctgcagtgttttaagtaagacagcacacagttcgattctttcttattttgcattttaattttttaactttttttttttctcttgagactgagtcttgctctgttgcccaggctggagtgcaatgacacaatctcggctcactgcaacctccgcctcctgggttcgagtgattctcctgcctcagcctcctgagtagctgggattacaggcaccaaccaccatgcctggctaatttttgtatttttagtagagacggggtttcaccatgttggtcaggctcgtctcaaagtcctgacctcatgatccggccacctcagcctcccaaagtgccgggattataggcataagccactgcacccatccaattttttaaaactttttaattcaaactaatgttaatcatataggaaagttacatatacggtacagggagttctcatatatccctcgctccacttctcctaacgtgaatgtcttattgtacgacgtcaagcacagcttgataatcaagaacaggaaattaactagacgatgaacttgatttgagtttcaccaatttttcacctgatttatgttccaggatcccatccaggatcccacgcggctggctggctctttttaaagcctacacagctctgggtggcgaatggctccggaggtgtcaggagtagaagcgggggctcactcctggccttttgctgtggtccaggcaaaagctggagtggccttaggtcaggttcatgatttaaggtctaggcagaaccgacaggatgtgaacaaagggaacaaggacacttcctgggttcctgggttctgccttcagtacgtggacggatgagtgagaccagaagaagtaaaagtttagggggcaaaatcaggagctcagttctggacctcccaagctgaagatgctggtgacacgctcaagcgatagggacaaggaggtggccataccatgaaatcagaagggagctcagggccagagatccactgtccataatatcaccagggagaagacagcaggtggggaggcctgggaagcagccttggagctgcaatgttttgaacggccagggaagtgggccagcagggctctgaggagggacaaaggggtagggaggggggctgggtgtgatggctaaagcctgtaatcccagcactttgagaggccgaggcgggtggatcacctgagctcaggagtttgagaccagcctggctaacatggtgaaacccccgtctctattaaaaaatatatatatacaaaaattagccaggcatggtggtgtatgactgtaatcccagctactcaggaggctgaggcaggagaattgccttgaacccgggaggtggaggttgcagtgagcggacattggtgccactgcactccagccagggcaacagagcaagactctgtctccaaaaaaaaaaaaaaagaagtggatcactgtgaacgctgcagagagaagatgaggccactagcaaagccagcctgggtttggccactggccacgcaaagactgtcagtgaccacaccagggagaggtgcgtttgggcggcgaagagcacaggccaggctggcaggttggtgtgcgagtgtgtgcaaggtggagaaggcacacgcggtcagtcctttggagaagtctggcacgaggcctgccgaggaaatggcccgggggtgtggcagggcggaggtcctgtgccatgtcctgcactgaccagggcagcccacgggaaggcagctgcagagaaggcagaacccgcagctccagaaggtttggggcatgaccagcagaggccaacttctattgtgaagaagaaaccgactcccagactttcagggaagggggtgtgtttggtctggtggcagtggggacagcaaagtaggacccttgggtgtggctacgattgagaggatgtcaggtagtgtgagattcaggctggtgtagaatcactcatgagaaagtatctaaaatcttccagatgacagtgctaccagctggacagctgacagtgggcgctggctctttcaaaacagtgctccaaaggcaaagaaatagcaaagacagaagtaaggcacttaactatttgttgggtgaatatagaaatgaatgaatgaatggatggatgagcagatacatcaagaagttaattcacaaattaaagcccattatgaaactaaagtagaggctgggcgcggtggatcacgcctataatcccagcactttgggaggtcaaggcaggtggatcacctgaggtcaggagtctgagaccagcgtaggcaacatggtgaaaccctgtctctactaaaaatacaaaaattagctgggcatggtggcgtcacctgtagtcccagctactcgggaggctgagacaggagaactacttgaacccgggaggcggacattgcagtgagctgagatcacgccattgcactccagcctgagccaacaacagcaagactccgtctcaaaaaaaaaaaaaaaaaaaaagttaatcctgcaatgaccatacacccagaaaccccaatcatggatatttaccctagagaaatcaaaccttatgtttacaaaaaacgctgtacgcaaatgtttgtagcggcactattcataattgccaaaacctggaaaccaacctaatgtccttcccaggatgaatggataaacacactgtggtccctccccacaatggggcactactcagcatcacaaggaatgaactagagacccatgcagcatccaggacgaatctcaatagctctagactaagtggaagaaaccagtcttcaaagggtacatgctgtgtggttccattttaatgacaggctcccaaaggcaaaactacagggaatggatagttgttgctgggtcggcaggggcctggaggcagggaacttaaggccgattcaccctgactttttagaactgaatcaaaaggaaaaccatacccaggtaacaaaaggatcagaggctactactccctttgcacctcgtggcagatgaaaaatggaaagtacctctgattggttccctcccgcaaccaaccagactggtcccaggccaggtcttcaggtgtaacgttgcaacttcacttcaacctctgattggtcgcctcctgcaaccaatcagactggtcacaggccactccttcacttacatagggtgtaaccaagtaaccaatggtaaacctctacagggtattaaggctccagaaaattctctaatcagccacttgctcctgctcgagcctgctcccactccgtggagtgtactttcatttcagtaaatctgtgcttcccttgcttcgttttctcgttgctttctttgtgcattttgtccaattctttgttcaaaatgccaagaatctggttaagaacccagacaacttgtagtcaagaccctccactggtaacacccataaagggtgtattagtctgttttcacactgttcataaagactttataattatccgagactgggtaattacgaaggaaaggtttaactggcttgcagttccccatggctagggaggcctcacaatcatggcagagggcaaggaggagcaagtcacgtcttccatgacggcagggaagagagagagtgtgtgcaggggaactcctctttataaaaccatcagatcaactggacgtggtggctcacgcctgtaatcccagcactgtgggaggccgaggtgggcatatcacctgagctcaagagttcgagaccagcctggccaacatggtgaaaccccatctctactagtaaaacaaaaattagctgggtgtggtggtccatgcctgtaatcccagctacttgggaggctgaggcaggagaatcgcttgaacccaggaggcagaggttgtggtgagccaagatcatgccattgcactccagcctgggtgacaagagcaaaattccgtttcaaaaaaaaaaaaaagaaaaaaaacccatcagatctcgtgagacttattcactatcacgagaacagcatgggaatgacctgcccccacgattcaattacctcccactgggtccctcccacaacatgtgggaattgtgggagtcacaattcaagatgagatttgggtggggacacagccaaatcatattaaaaggtcaacccttgggaaagatttttggggggtgattaaactgttctgtatcctgattgtactggtggctacaaaacctatacatgtgttatgatccttagaaccgtatagcaagagaaaaaagtcagttcacaaatgataattagcaaaataaaattatacgttaccatacaatcttgcaattccaatccaagcctctactcacgagaaatggaaacaactaagacttgcaagcgatgttcagagcagctctgtttattacagccaagacgtgggaataatccacgtgtccagcagctggtgaatggatggacacactgtgatatatccacaccaccgaatttaactcacgaaaaaggacctaaatacttgatctgtgctacaatacagaagaacctcaaaaacaataagctaattgagaagtcagctacaaaagactacaatagtgcatgattccaattatatgaaatgtctagaaaaagcaaatctatagacacagaaagtagatttgtggtttgggactggaagcaggtattgcctgaaaccagatatgatggacctcatgggatgatggaaatgttctaaaaccagatgataccctaaattttctaaaaataaaattgtatacttttcacagctgagcttcatagtgtgcaaatgataccttagtaaaactgtctttaataaaaagtgctcaattcgttatctattttctttttttcttttttttttctttgagatggagtcttgctctgtcacccaagctagagtgcagtggcgcgatctcggctcactgcaacctctgcctcccgggttcaagcaattctcctgcctcagtctcttgagtagctaggactacaggcacctgccactgcacgcggctaattttcgtatttttagtagagacggggtttcaccatcttggtcaggctggtctcgaactcctcacctcgtgatccaccctcctcggcctcccaaagtgctgggattacagacgtgagccactgcgcccggcctagctatatattttttaaagtaaaacttgatccctacctcatagtgtacacaaaaaatatcagttcacatttcacgtggattatagacataaatctgaaaagtgaaacaatagagtatctaggaaataatattatagtttcatgacctcagaagtagagaaataggacaaaaaaagtcctcacctaacaaagaaaaaaagtggatcaattttatggtaggctgaaccatatgccaattgccaatatttgaccatttcgatctacaaaaatggcaatttcgtagtaaaaaggcaaaactagagtgggagaaggtatttgcctcacatataactgacaaagggctggtagcctgaatataaagaactcctcaaaatcagtaagaggccaggcccgggggctcacacatgtaatctcagcactttaggaggccaaggttggtggaccacccgaggtcgggagttgaagagcagcctggccaacatggtgaaaccccatctctactaaaaatacaaaaattagctgggtgaggtggcacgtgcctgtaatcccagctactggggagactgaggcaaaagaatgttgaacccgggaggtggaggttgcaatgagccgagattgtgccactgcactccagcctgggcgacagagtgagactctgtctcaagacaatacaaaacaaaacaaaacaagcccaacaataagaaaacaaaaccagaccactcagtagaaaaatgtgtaagaaagctgaacaggcacttcactgaagagccaacccaggtggccagcagacatatgaaaagacactcagccagggaactgcaaatcaaatacagaatcacaaatgaaaattaccaaaagaaactgcacccacccaccagagtggctgcaattcaacagagtgacaagcgctggtgaggatgcagagccacccacaggaaccctcatactctgctgacgggtatgaggtgataacaatgttatcaccatttgttatcaccatttgtaaaacaagtcggtattaccgatggaagttgaagacactcacactctatggctcaataattccccttctagacattgatttcggccaaagaaatgcatgcaagtgtgcaccaggatacagtacgtaagtattcacagggattattgtaaaagtcaaagcccagaaacaacccatgtatccatcaagaggaggatcgatggatacgttgtgatatgaccgagaaggcacaacagcagtgacgatgaaggaaccccagcgtaagcaacaggcaacaggaatgaagctcacaaactttacactgagtgacagaggcagccacaaaagaatatatactgaccaggggcagtggctcaagtccgtaatcccagcactttgggaggcctaggcgggtggattacctgaggtcaggagtttgagaccaacctggccaacatggtgaaaccccgtctctactaaaaatacaaaaaatcagccaggcatggtggtgggtgcctgtagtcccagctcctcaggaagctgaggcaggagaatcacttgaacctgggaggtggaggttgcagtgagtcgaggtcatggcatcgcgctccagcctgggcaacaacagcaaaactcggtctcaaaaaaaaaaaaagaatacacactgcaggttccatttgtacgaaattcaaacacaggcaaacgcaatttatggtgccagaagtcaggacatggttacctttagaaggaggaagtgggtagcgttgggagggacacgagggaggcttctgggatattctgtttcatctgggtgctggtttagtggatgtgttccttttgtgataattcttcaaactgtacacttatgcattttatgtatgcatattacacttcaatgcaaaatttattttaagaaacaggaaaccaaactcttcaaaaatgccaatagcagtaaagaaaaaaaaatgtgcggaactgttctagatctagatcttgagtgtcctcttttaggaaaagatcatccctgattggatcctggatgaacaccataaaagctctaaaggatactgttagatgctggggaaatttgaacatgaactatatattttataagagtattctgtcaatgttatatttcttgagtaggataatttgttttgtctgtacaggagaatgtccttgttcataggagatacatgctgaagaatttaagggtgcagggccacaatgtctgcaatttagtcagttaacggttcaatggctcagcaaagaaaaaagaggacaaatatagatacacacacatacacatatgcacatacatatgtgtgtactgtattatatcccattcagggttcttgcacaaatgtgtgtataattatattcacacatacatatatacacacctacactgagacagccaaagaaatttggcaaaatgttaaccacgggtcaatcaggtgaagtgggatattagtgttcattatactattatttcaacttttctgtaggtttgaaatttatcaaaatgaaaagttgcgaaggccaggcacagtagctcacacctggaatcgcagcactttgggaggccgaggcgggtggattgtttgagcccaggagtttgagaccagcctgggtaacatggcgaaaccactggctaatacaaaaattaatcaggcatggtggtgcacacctgtagttccagttcctcagggggcagaggtgagaggatcatctgagcctgggaggtcgaggcagaggtgagccatcatcgtgccactacactccagcctgagtgacagactgagaccctgtctcaataaataaataaaattaattaattaaaattaaattaaaagttggagaaaaaagcaaaagcaagccaaaaaacagacaagccaaacacccgacgccaagtgttgaaggactcacagttggataagaaaaccaaaaagtccgggcgcagtggctcacacctccccagcactttgggaggccgagccgggcagatcacagggtcaggagttcgagaccagcctggccaacatggtgaaaccccatctctactaaaaatacaaaaattagccaggcatggtggcccgtgcctgtaatcccagctactcgggaggctgaggcaatagaattgcttgaacccagcaggtggaggttgtggtgagcagagatggcaccactgcactccagcctgggcaacagagcaagactccatctcaaaaaaaaaaagaaagaacgaaagaaagaaaaccaagaagagcagagacgggaccaccaggaatggcaagatctggccccctgcggcaggtggagggcaggacggctgctgggtggctggctgtgctctcctgcaacctgcctggtagatatgcaaaggcggtcaccttataacaatcagattgtacatttattttacgtggtcttccatctatatcacacaatttttttttttttttgagatggagttttgctcttgttgcccaggctggagtgcaatggtgagatctcggctcactgcaacctctgcctccctggttcaagagattctcgtgcctcagcctcccatgtagctgggattacaggtgcccaccaccatgcccggctaattttttgtatttttagtacaggtgaggtttcaccatgttggccaggctggtcttgaactcctgacctcaagtgatccacctgccttggcttcccaaagtgctcggattacaggcatgagccaccgtgcccagcctgtatcatatacttttttaaaaagagactttacagaaaaacagactgagcaaacagagctgcatgccggtgcatgagcaacaagttataatcgcacgctggaggaagaaagaggaagccgtcggccacacagctccgctctgccaaggctctgctgccgtccctcacccgccccaccacgtggcaacccaatcacaacaatgccgccgtcccccagctgctaaatgctctcaccatttggttgctgtgcaaacacacctaacttagacttcagactgatgtcctggaggtgctacaagatggccattctttatgagtaaggctgccttccagggtaaaaattatgattttcccataaatcacatataagcacttagcaaaaaatatttaaaactctcataagttttggtcctaaattcttttctcttgctgttactacaaaaatgacagagacaaaaaatttattatttataacggcttggaatctaattccaaatgagttgcttccgtagattcacgtaatactgcagaactaaatatgcaagattcccgattccaaatggaggccaaattccatccacacaggagacagaggaaccctcagcagtctctccttgaagtaattttttttttttttttttttgagacggagtcttgctctgtcgccaggccagagtgcagtggtgtaatcttggctcactgcaacttccaccaccgaggttcaagcgactcccctgcctcagcctcctgagtagctgggactacagacgctaattttttatgatttagtagagatagggtttcaccatggtggccaggatggtctcaatctcctgaccttgtgatccacccgcctcggcctcccaaagtgctgggattacaggcatgagccttgacaagctgacaacagttatctatgttcttcgtcagttcatggactcgacaccaaaatgcctgggttcagatcccaattcctgtgaaggcttaagcaattacttaacctctttgtgcctcagtttctgagtctgacagattatggcaacatcagtgactttacagggttttgaggattaaatgagtaaatactctaaagggctcagatctgtgcctggcacatattagcaccgatgctggcctgttcaaaaattctattattatttgctcaacaattgcctgaaaacatagaaaaactgtctgccacatacgcagatgaggggaacaacgaaagatttggtgggtttcagaagaggtacaggcctgatggctgccgtgcgccaacaaggtgagcctgcagatcagagaccacgtgcatgagccacagtgcatgtggctgctgtgtcccctctgccttctcggtcttacacaaatggtctcttgtggctcaagttacatacagagctccaacttagccaaggtgacgcaaaacgaactcactacacgtaccccttgtcaacttggtgtccatatctactcctcttttcaaccgtacttaacttccaaatcaagtaaatagcaactaggcttccatgccatataatgctactatccgtcttacaaccaaaaccatgctaaccctctccccagaagaggagccaaagtccttttatgaactttttttgagacaaggtctcactctgtcacccaggctggagtgcactggtacgatttcggctcactgcaacctccgcctcccaggttcaagagtttctcctgcctcagcctcctgagtagctgggattacaggcacctgccaccaggcccagctaatttttgtattattagtaggggtttattagatggggtttcaccatattggccaggctggtgtcaaactcctgacctcaagtgatctgcctacctcagcctcccaaagcgctgggattacaggcatgagccactgcacctggcccaaagtccttttacattctatctgagtggttatccgttggcaccccatggaatgaagaaggagactgaagtgataacataaggctggtagctgacagacccctgaagtgtaactatgaaggcgggctgtggaccttgccggctggaagcaagacccttctggtcatctttactaccaggtagagaaggagaagacactcaccgcataccaggtaccaggaaatgtgttgatttgttccagcaacaaaaacacatctggcacagcagctgtaactgcagtcaccgcctagtttaagtttatgacaacctgctgtcattctctaagatccatccgtcttctagacaagccaaatatggattaaacggagatgtgacacgatcaccacccttgcatctttcaagtccctgatggtggcactaatctctgccatcctcccaggaatgtgataattgctttgggttgactattttggtagacagaggcagttctggcagcttccacttggcctttgctaccacaacagccctcactccagggaaccagtgtcagaattctgccaggtgctaagtagatatatatttacttatgcattgcagaactgcagaaagaaccacaggacagctattatatcttaataattacttaatatataatacacaatgatatgtgggtattaaatattatgagtcattactctgaaatggattaaagttaatataagtgtaattgccatacagagtgattatgggtgcccactcaaaagtcagccatactcaattatacacaaaaacacaaaacacacgtgcacacatgcttagattgcctcgcaaagcctatatgcatgggaagccaatgacacacacgaggaaagatgggaacacagagctgcttcttggtttcagggaatcctcacttctttcttccttctcagggaaatttcgctttgtttcatgctcgacctccagcctcccaggtcttggccttaaagattccaagggggccgggcacggtggctcacacctggaatcccagcactttgggatgccgaggcaggcggatcacctgaggtcgggagttttgagaccagcctgaccaacatggaaaaaccccgtctctactaaaaatacaaaattagacaggcgtggtggcacatgattgtaatcccagctacttgggaggctgagggtggagaatcacttgaacccggaaggcggaggttgtggtgagcccaaatcgtgccattgcactccagcctgggcaaatgagtgaaactccatctcaaaaaaaaaaaaaaaaaaaaaaaaaaagattccaaggggccccagcccccctcccttcactaaagacaagccagctccttagatcccatgatgccagagctgtgatcttccagtacactggagaagctccttgtatcttcctatctcctagtaggctgatttcatccaccaacagccacagcaccttgaagcaacccaggagctgctgtttcccgtgatcatgtggtcaaccctggtccttcaaacttctttcagaactcacacacacaccacgtccccttatgagttttgagcagaatgctttttctttgaaagtctgtattcaacaccccctttttatttatacaaacttggagggtatgtgagaaattttatggcatgtatataatgcgcagtgatgaagtcagggcattcagggtgcccatcactcaaatacaatacattttggttttggggtttgtttgttttttttttttttttttttgagacaatctcgctctgtcacccaggctggagtgcagtggtgcaatctcggctcactgcaacctccgcctcccaggttcaagcaattctcctgcctcagcctccagagtagctgggattacaggcacccaccaaccacccggctaatttttgtatttttagtagagaaagggtttcgccatgttggccaggctggtctcgaactcctgacctcaggtgatctgcctgtcttggcctcccaaagtgctgggattataggcgggagccaccatgcccagccacaatacattttttgttaggtgagaatatatataatattagaataatattactctgctctcaagccttgaacttattccttctacgttactgcatgatggtaccctttaaccgacttctcttgacccttctcctccccgccactcacccttcccagcctctgttacccttcttgccactctctacctccatgtgatcaaaccttttagctcccacatataagaacatgcaatatgtcttttgtgtctggcttccttcacttaatgacttccaagctgggcatggtggctcatgcctgtaactccagaacttcgagaggccaaggtgggacaatcgcttgagccccaggagttcaagaccagcctgggcaacatagtgagaccccatgtctacaaaaaataaacaaaattagacaggcatggtggtacatgcctgtggtcccaactactcgtgtggctgaggtgggaggatcatttgagcccaggaggtcaaggctgcagtgagctatgattgtgccactgcactctaacctgggcaacagagcaagactcttctctaaaaaataaaaataaaaaataatcataataataatgaccttcagttccatccatgttattgtaaataacagggttttgttccccttgatggctggacagtatcccactgcatatacatataccacagtttctttacccatccattcgatgatggccacattgattccatacctttgctattgccaacattgctgtgatgaacatacaagtgcaggtatccctttgatagatcgatttcttttcctctgggtagatatctagtagtgggattaataatagccattgtgcccagtaagaccccacttcttaatattattctcatataattctaatagccattctgactggcataaggtgatatttccttctggttttgatttgcatttctctgtgatgagtgatgctgagcattttttattgtaatgctcttgactaactgtgccacgtttacaactgtctttgagcggagacctgtactacagagtcctacacagggttaaggaggagcatcagaaggcagtgaacagacgtgaggcctatcagctggtactagaaaagagacaatccatttaaggctttgactcatttttgaaacctatgtgctatggtctaaatgtcccccaaaattgacgtgtttaaacttcatcacgaagggatggtattaagtggggtcttactggcacagtggctcaacacctgtaatcccaacagtttgggaggctgaggtggaagaatcacttgagtccaggagtccaagaccagcctaggcaacacagcgaagactccgtctctacaaaaacaaaattgtttttaatgagccagacgtggtggcacacgcctgtggtctcagctacaagggaggctgaggtggggggatcgcctgagcccaggaggtccaggctgcagtgagccgtgattgcacccctgcactccagcttgggcgacagagtacgattctgtctcaaaaaaaaaaaaaaaggcagtggggtctttaggaggtaaggaagaagtcatgagtgctccaccttctcaaatgggatgaagaccctaatacgagagggcttaggggtgagcaaccgcatgaaaggcctgagggaacgagtccgtagcctttgctcttctgtcatgtgaggacatggcaccagacacccaatgccaaggcctcgatcctggacttctcggcctccagaactgcctccagaactgtaagaaataaatttctattgtttggaaatcacccagttgcaggtattttgttgcagcagtaaaacggactgagataccgtgtcgctgtacactctttgcagtatgaagtcagcatggtttcagttgagaaaagaggaacagagtagttgggtctcatcctcacaaccctgtttctctcctctcttctctcggggtcatcactccccaaccatccaaaccagaagcctccaggtcactttcttctccttcctttccctcaccatcaagccctgccaagtctcgctgtggaatccactactttccttccactcccactgcctgaaccctgaatgtctctcgggccccagcaaagagcttccaaaccattctccaggcttccagtttctcctcttccaattcatcctccattatattatcaccccataagccttgctctgaaactcgtaatgcttgcccttttataaaaataatagcaacaacatctcctacaactaagatttagagaatacggattatgtgtcaaacactgttctaagcaccttacacgcattaccctcacagttaacccgcaccagtctgtgaataggtactactacaaactcctgctaacagaacagagcagagactctaacgtggcatgcaaagtctttcactaccaggccccaagcccctttccacccccatctcccatgtcctccatctttgccgcttccccacgtacttgcggtgctgtttctcaaacacccacccctttctgtgttacacgccctcatgccgtttccttgccattttaggtgttctgctactgttttaattcttgtctttttaagtgttccaacgacactttaaaaatgctttaaatgcaggattgcaggccaggtgcggtggctcacgcctgtaatcccagcactttgggaggctgaggcaggcagatgttctgaggtcaggagttcgaggccagcctgaccaataagatgaaactccatctctactaaaaatacaaaaattagccaggcacggtggcatgtatctgtaatctcaactactcgggacgctgagataggagaatcacttgaacctgggaggcagaggttgcagtgagccgagatcgcaccatttcattccagcctgggcaacaagagtgaaactctgtctcaaaaaaaaaaaaaaaaaaaaaagcaggattgcacccttgaaagttaaaattttacttttgctgaaaggaacaattgaggtcaggtgcagggactcacgcctgtaatcccagccctttgggaggtcgaggcaggcggatcgtttgagctcgggtgttcaagaccagcctgggtaacatagtgagatcccatctctacgaaaaatgcaaaaattagctgggcatgatggtgcacacctgtagtcccagctacttgggaggctgaagtgggaggatcacctgagcccaggaggtaggggctgcggtgacccatgattgcaccactgcactccaggctgggtggcagagcaaaaccctgtctcaaatccaaaagaaaagaaaacaagagaagagaagagaagaccattgagcttaacacgccttttcatataaataactccaatggcggcattcatctaggctaaaattttggtttctgagaacaaatcattttgctaataattcagtggacatttatactcaaagataggcagagcccctaaatctgcaggtgcatgaaaaattcaggtgtagggacattacactacacaattacctcagactagggtagtttgttgcggtgaggttgggtttttctttccttccttttaaatttttacttaatcaagaaagcttcttttaagacaaacacttggtgaggtggccaagcactatcatatttcctggtttcctcttcttctttacttaacaaagaactgctcattaaaatgacatcttcttaattttttttttttttttgagatagagtctcgctctgtcacccaagctagagtgcagtggcgcaatctcggctcactgcaatctccacctcctgggttcatgcgatcctcccacttcggcctcccgagtagctaggattacaggcagccgccaccacacctggttaatttttgtatttttagtagagacgagatttcaccatgttggccagactggtctcgaactcctgacctcaggtgatccacccgccttggcctcccacagtgctggtattataggagtaatgacatctttaaactcacatctaaggagtgtctactgagtataagacattgattccaggttaaataaagtatctacacgagtcttttcacctattgactgaactgtctttaataatcacacttgtgtagtacttttcatttccattacctcatttgattttccaacgagacaggtgaaacaattctgcttccagtagacatgggagggtggaaacagcagggccactacttacctgtagtagtcagttttaagttgaaggtaaataccccttcaaaatttctggatggaaaagaccacaggagataaagcagagaatcaaagcccagggaggaaaatcatataggggacattaaagaccagcagggtcataagacttcccaagaaatggcatattctagaaatagagcaaggaagccactccacactcatccttctctgaatttctacccttattttttccttctaaagagctagacttgggctgggcatggtggctcacgcctgtaatcccagcactgtgggaggccaaggcaggtggatcacctgaggtcaggagtttgagaccagcctggccaatatggtgacacctccgtctctactaaaaacacaaaatgtagctgggcgtagtggtttacgcctgtcatcccagctacttgggagcctgaagcaggaggatcacttaaacccaggaggcagaagttgcagtgagctgagatcactgggcgatcgagcaagggcgacaaagcaaggccccgtattaaaaccaaaaaaaaaaaaaaaaaaaaaagaggctctttctaaacttttaaatctattgctaaattcaaggaagacttgattgcagtagcatttaactctggaatcacaaataaagtactagcaaattccatcttcatatactactgctttaatgccaagctaatacttaaaaaagaaaatgggcaaagaaaaagaaaaagttgatgattcatgagtctaaacaattttttgtttttatttatctgattttttttgttttttttttttttgagacaaggtttcaccgtgttgcccatgctggagtacggtggagtaatcacagctcactaaagcctcgatcacctgggcccaagccatcttcccacctcggcctcccaagtagctgggacctcagggatgtgccactgcccccagctaagttttttttttttttttttttttgagacggagtcttgctctgtcgcccaggctgaagtgtactggtgtgatttcgactcactgcaacctctgcctcccgggttcaagcagatctcctgcctcatcctcctgagtagctgggactacaggcgtccgccaccactcctggctaatttttgtttttttagcagagacgggggtttcaccatgttggccaggctggtctcaaactcctgaccttatgatccatccacctcagcctccgaaagtgctgggattacaagcgtgagccacggcgcccagctgactcagctgtttttaaattcttttgtagagacagggttttcctatgttgcacaggctggtctcaaactcttgggcttaagcaattctcccgcttggcctctcaaagtgctgggattacatgtgaaccagcatgtctggccttcaattcatttctaaaaagagaggaaaaatatatggcttcttccccgccccattgttatttgattcaattatttacaaaatgaattcttaggatattttgcatttttatttccttctgaaaaatcagtttttacaccatgaccttaatctagctaattctgttaaaataggatttaattttagataagttcccagaggacctgcattccattcaattgttggttgaactatatttcctagtgactaggatttataaatattaattatctgaaagagtggaaatgaacatatagttatttttagaatatactgtgataacaacaacaaaaaatcctgcaaaacggagctagaccagcgctgacatgaaaatccaacagccacctggcgaactctgtgttccaagaggtttttatttacagtgtaggatgtgactttacctataaaatgctttctggctgccactccgtttggacgattccggttttggtctgctaacttatcaactgtatgatttgggcaagttcctaaacttctctgtgcttcgtttctcccctttgtaaaacaggactaaaaatattaaaactcggccgggcgcagtggctcacgcctgtaatcccagcactttgggaggccgaggcgggcagatcacgaggtcaggagatcgagaccatcctgactaacatgctgaaacctcatctctactaaaaatacaaaaaattagccgggcgtggtggcgggcgactgaagtcccagctacttgggaggctgaggcaggagaatggcgtgaacccgggaggcggagcttgcagtgagcccagatggcgccactgcactccagcctgggcgacagagcaagactctgtctcaaaaacaaacaaacaaaaaattaaaactcttccctgtggggttgctttaaaaatcgtataatgtgttatatgtaaacataaagcattataacaagacagaggaatacaccactggagcaaaatcagaagcggttccctcgttttttcacaatgtggagtctggcccggcgcggtggctcacacctataatcccagcactttgggaagccgaggcaggaggatcacttgaggtcaggagttcgagaccagcctggccaacatggtgaaaccccatctctactaaaaatacaaaaattagccaggcatggtggcacgtgcctgtaatctcagctgcccgtaatctcatctacttgggaggccgaggcaggagactcacttgaacatgagaggcagaggttgcagtgaaccaagattccgccactgcattccaacctgagcaacagagcaagactacatctcaaaaataataataataaacaatgtggagtcttttattctttgcctagaattttctgtgcattgctggaatgagtatatccagaattcattccaaagttaattaagaaaagtacagttaggctttggtaaaacagtctgccaaaatttaacaaaaaagagaaggagaagaaaagttcattaaaaaataacatcactaggaactctgcaaccttgagtggggcacttaagtgccacagacctcagtttcttccttttttgttgtttttttatttttgttttctaggcagacattgaatgctagtttcttcctttttaaaaaaatgaaatagcttaactagaaccatctaaactacaaagaatctttttaaaattctaggccaggcacggtggctcatgcctgtaatcccagcactttgggagacccaggtgggcggatcacctgagatcaggagttcgacaccagtctagccaacatggtgcaaccccatctctactaaaaatacaaaaattagccaggtgtggtggtgtgtgcctgtaatcccagctactccggaggctgaagcaggagaatcgcttgaacccaggaggcggaggttgcagtgggctgagatcgcaccactgcactccatcctgagcaacagagtgagactccatctcaaaaaaaacaaaaaaacaaaaaaacaaaaaaaaaattctaaaacactaggtttatgaagtaaataataaaattctgtgataggacggagccattttcttccaggctatttaccaaacacagcaaaggaaatcaaaaaaaggcttcccatatagtaaaacttacattttggagatctggatttctccattataaacctatggaatcaaatcatttaaaatctagttaccagagaaacctcggtttaatattaacaaacatacttcctttaaccacgagccactttaatgtatatcagttttatctctggagcttcatagatcccaacagagaaggctgatctattttcagagaaacatagcaagagagtgtcacttctgaaccattatacatttaaacaatctctctacatgtagagcctgcatctaaatcccagcaatttttcaggacctagctctgaggccacatcagcactccaggcaggcggagggactctccaccccgcctcttttgcccccagaaaataaatctttccccagaccaacaatccacttcccggcctcacagcaacgggctcccggctcccgcacgtgactgccaactctttacgagatgaggctgtgctggctcggtatggttgataagacaagcatgcaagaaatatttattaatgcaaactcgtataaattcgtatcatctgagtttatgggaatgaggataaatcacaaaagcattataaagtgaggctttggacaaagtcctgaatggaagagtctagtaccatttttagagcctcttttgttttttaaactccttttactatcattcccagccttggtagacacttgacaaatatttgaggggaagctgaggacaaagagatgaaaataaagtgactgctatgaaaaaatgaaagcccaggtaacaataaacagtttaatctctgtttagttaggaaggagccaaacgcggctgggcacggtggttcacgcctgtaatcccagcactttcagaggccaagacgggcagatcacaaggtcaggagttcgcgaccagcctgactaacatggtgaaaccctgtctctactaaaaatacaaaaattagccaggtgtggtggcgtgtacctgtaatcccagctactcaggaggctgaggcaggagaattgcttgaatccaggaggctgaggttgcagtgagctgagatcggaccactgcactccagcctgggcaacagagcaagactctgccttaaaaaaaaaaaaaaaaaaaaaaaaagagccaaataattttgcctcccaatttgctgcatccatccaagaggggaagatggtctcaggcagtaactagctttgaaaacccttgtgaattttttgagatagggtctcactctgttgcccaggctgcagtacagtggcgcgatcttggctcactgcagcctcgacctccttggctcaagtgatcctttcacctcagccgcccgagtagctgggactacagacatgcaccaccatgctttttttctttctttttttttttttttttttttgtagagatgaggtttcatcatgttgcccaggctggtcttgaactcctaggctcaagcgatcctcccatttcagcctccccagtagctgggactacagttgcataccaccacacctggctaaactttttttcatattttttgtagagttgggggtcttcctatgtttcccgggctggcctccaaatcctgggctcaagtgatactcctgcctcggcctcccaaagtgctgggatcacaggtgtgagccacggcaccaggtctgaatttgtgattcgtgttaatgacgaacctgagctgagccttaagtatctgtccggagtcgcagaagcaatcagcacagtgcccagcactgaaccacggcacacagtgcccagcactgaaccacaacacccagtgcccagcactgaaccatagcacatgcgcattccccccacgcccccgaacttatattcgtcaccatatgttgtgcagatccacgaatgggcagagtcacaattctcacatgagctttgtaaataaggaaaaactgcatgggccagcacacgttgcttgtgtgtgtgtgtcctaagcactgatgacaaatgcagaaccaacaacattcccactcatccagaggaaatcgtgagttctcaatgagcaggctgggagtagcttagtagtcatttccaaagcactgtgaaacttgtctacttcatgaaaaagtactgaggctgttttacagccctttaacttaaatctagtaattgtgcctatcagagttctgaagaaaataagactcaataatctaagctactagttcacgcagatcatcttaaagcaagattttccacagacctcacatatcgaggtgacatgatccttttctaaaatgaaagagcttcgctagagcccagaagttcgagaccagcctgggcaacataagtgagaccccgtctcaacaaaacaacaaaaaaaaagttttttttttaaattatccaagtgtgctggcatgcacctgcagtcccagctacttgggaggctgaggtaggaggactgactgagctctggaggtcgaggctgcagtaagctataagtacgccactggactccagcctggtcaacagagcaagacccaatctaaaacaaaaaacaaaaaactacgaaaacatattccacaaaaaagatttgtacataaggactgtatataagattgtttctaggcagacattgaatgctaatttcttcgttttttaaaaaaaatgaaatagcttaactataaccatctaaactacaaagtatcttttttaagttctaaaatattaggatttataaagtaaataaaattctatgacagcatggagccattttcatccaggatgtttggacacccttctcctttttttgagactccatcaaagaaagaaagaaaagagagaaaggaagagataaaaagaaagagagagctagcttagcaaaaatcatctaaactacaaattatcttaattctaaaatattagaatttataaagtaaataaaattctgtgatgtggtttctctagttaagggcctgggggacttacacagctgttacgaagacattatttaaaaaaatcttcagttctccctggggggcaattggattgacaattgcaattcctttgtaaccaatgggcttctgtgtgagctgttagacgcacactggtattcgttcaagatggaaaaccaaacaacatggacacaacccatgacagccttcaaagttctgtctgcatgaccaatcaggtcctttggttgaaatccatgaccaatcaggtcctttggttgaaatccatgaccaatcaggtccttcggttgaaatctatgaccaagcaggtccttggttgaaatccacgttggccaggctgatctcgaactcctgacctcaggtgatccgcccgcctcggcctcccaaagtgctgggattacaggcgtgagccaccgcatccggccagagtgtgttgttttctcattgcagtccctaacttgccctgaaccctcccttacccaggtagccacgaagcatctggtgactgaggcctgggagtgagccctggaggttctggctgacgctctgccgtgacccacttggggcttctgtgacgtccccttcagcctgacaagaggacccagttctcctctgtgctcaccctgaacaaaacaggtcctagtctgggaagggcgccaaagagagatcttttcactggtttctgttccctgtcatttttgggggagggtgggctggggaacacaaacacccaataattggaaattgtcagacatacaaaaaagaaatgtaattagtcataaaccctattttaaggttatatttgcactgccattttaaaatgagaaaacactaataacattaaaatgaagtctttgttaaaagtaaccatgcattgttcaaatttccatttgttctttgtttgacaatgaaaaatcattctaaattagttccatacacttactgtgaaacacaacagtttattcctgggtcacattctcccccttctgtggtttatataacttctctttgttccgcaaatggcagtacaatggcaaacaaaataaaatggagtttattatgaaaatggatccattaagctacctaagaataacatagccctacaactcctgcacttgtagagggacacgggtgagatgaaacggacgtcagtacccctgcaagaatcacacagataggcccctcggtgcacctggagagggaggccacaatggcaaataataggagacacagcgatgccccactcccttctttcccaagagctgccatttctgcccttgctggataagctcagtgtctcacacagcgtgagcgtccactagatgctggcttggacaggcgatgctgagggttcccatagacggcactctagtagggctgctcaagtccctcctcacaatccagaggatctcacctaggcagggcccatggtcactccccaggagaagagccaggaatgtccccatcaagcaaaacccctggtctccagctcacaactcaaaacccaagcaaatgaaggaaaagctcctgggaccatcaggactcataacgaccaagggtcagtcatggtatcaggaaatcgtaatcctggctcagaaaggttttaaatacagggaagcagaaggctggggcagcaaaggacactactaagagcaagcgactcacagggctcacccggaaggcattacaaactggaattcctaaaagagtggttgccaagctcacccagaagaggaggtcccactggtccctgagtctgctccaaacggccacgcacagcgtgggcatcctctcccctgctttccattgctgtacagaacctgacctgggaccagagagaagagggtccagggaaatgctgctgaaggcttcgtctctgcagtggagagaaagtcggaaggggcagcacccacccctagctgcccatagatgaccaggcacaggcacccaccaccgacactggcacaatcccccaacatgttctcagaccagaccaagaccctagccgagcccaaggatgctggctaatcaaatagtaaacacctttggccagattatccttaaaaagtctctggaatgtcaccttcagtctctgtagtctactttctaacatacttctgagccgaaaccacgtgaaaagatttttcttctgactacaaggcagaacaataaaagtgaccctctgagtcaaaaacaccacatgaaactcacctcccgcctccaacccatcccttccgcatccttcatgtccaccgtccctttaccaacaaccagctgattcttccagacttcaaaatctttcagattaacccagaaatatcgataagggaggcctttttcttagcttatgttgtatatgtttttctgtttaggctactgctataaagaactatccaccagcctgggcaacaaggtaagaccgaccctgtttctacaaaaaatacaaaagtagacgggcatgatggtgtacacctgtagtccctgctactcaggaagctagggtgggaggactgcttgaacccaggagttagtggctgcagtgagccgagatcacaccactatactccagcctgggtgacagagtgagactgtgtctcaaaaaaaaaaaaagaactatcccgagagtccactgttgggggccgaagtgggggtggggacccttggctgccatgttcctgggccaggaacatggactggatggcctgcatgtcagaagactggtgacatacaagggtcaataaataaaaacagttaatatgataagagctgttactgttattgttagaaaagaggggcacagccaaggaaaggggagaaagctgaaacaaaccatttgacttggatggtatcatgatttttatatgagatgaatggatacatagatacgagcgggacagatggatacaaagaactacaaacgcatgtgtgcccgtgtgtgtatgtacaaacatatgtgtacgtgtagggaagtacatgcatatgtttaatttcctagctatgccaggcgcggtggctcatgcctgtaatcccagcactctgggaagccaagatggatgggtcacctgaggtcaggagtttgagacccagcctgaccaacatggtgaaaccccgtctctactaaaaatacaaaattagccggacgtggtggcgcatgcctgtaatcccagctactagggaggctgaggcaggagaactgcttgaaccgggaggcagaggttgcggtgagccaagttcctgccactgcatgccagtcttggcaacaagagtgaaactccgtctcaaaaaaaaaaaaaaaaaaaaaaaattcctaactacgctgcttgagaagtccttgtagccgtaatagcccagtagcgtgaacacacctaatacttagatcctggtttctaaaaaccactttctactaaaaggaaccagggcttattggagaaatggctgattccagggctggagcaaggaaagttccgggtgagcctagaaccaagaactaaacatgtggccgggagcagtggctcacacctgtcatcccagcactttgggaggacgaggcaggcagatcacctgaggttacaagttggagatcagcctggccaacatggtgaaaccccatctctactaaatatacaaaaattagctgggtgtggtggcgcacgcctgtaatcccagctacatgggaggctgaggcaggagaattgcatggacccaggaggcagaggtttcagtgagccatgatcacgccattgcactccagccggggcaacagagtgagattccatctcaaaaaaaacaaaaacaaaaacgaaaaaacctggccaggcatggtggctctcacctgtaatcccaacactttgggaggctgaggcaggcagatcacgaggtcaggggattgagaccatcctggttaacacagtgaaaccccgtctctactaaaaatacaaaaattagccgggcgtggtggcgggcgcctgtagtcccagctactcgggagactgaggcgggagaatggcgtgaacccgggaggcggagcttgcaatgagcagagatcacgccactgaactcccacctgggcaacagagcaagactccatctaaaaaaaaaaaaaaaagaagaagaagtaaagatgtgctcaaagaatgacatgaacacatcaaaagaacacaggggccagcttggaggcgctgcttttggccaaatctgggacaatctgggtatcgaagcaaatgataatggtaatgaattataacccaatgggtaaaataggagtctatgagtgtattgataggaaggagagaaagacagcaggcaagctccagcttgcagtggaatgccaactaatcaatgcaaaagaaacaatgcaactagaaacatcaccatttggcaatgctcatactaattccctcaggcaagaatcatcccaggatgctaaaacaaatgggcaaaaagcttaatgagaaacaggatattttccgagtccccaaaaaatctccccaccagaaacagtactttttaactgataattacaaaataccaacaaattaattttacagtggagaaacctggtagacaccacctcaaccaaatgataagttaacttctccagaaatgggactgatcagacctgtgtgcgttcctgtcgtgacaaccctgcagggactctcctgccaggaacctaccacctgattctcatcatgaaggaatatgagaccagcccaaaccgagggacattctacaaagtaactggcctgttctcttaaaaaaatgtcaaggtcgtgaaagacagagacgaaggaacagccccagattgaaggagactcgagagccattgacacagacggcgcctgtggtcctgggcgggctccggggcctctgcatttggtggcatggtgtgacagtgcccacgtcctgatttgggcaggtcggtgcaggctatccgggacagcgtccttgtttttaggaaacccacacaggagaatctagaggcactctctgcagtctattctcaaattattccggaaaaaagggatgtgtgtatgtggagagacagacagacaaacatgtcggaatgttaattcagggaatctgggtgaagagtatttgggaattctttatactgtttgggagcatctctgtaaatttaaacttacttcaaaattagaatataacgccaccaaaaccccctctatcactcactccgcattcctagataacaactagtgtggaattctgttctttgaatcactagatatcaactagcgtgtaactctgttgtttgaagccacctggtttgaggtactttggtacagtagccctaggaaataaatatgctactcaaagaatattgaatgtggctttttctacaatactaaaatctgacctaccatgttaacttagtaaggcaaactgctggggcggggtcccgtttcagccgaacgcatctgacaatgccttaagtcacacattgcataatcacaagttgcttcttgacatgagcggctcttcaagtgcacggggaacaacagattctttgtcagggactcacaagagtcacatgctgttattcttttctccttaagagacaaactgattttttaatcactgagagcctattacatgcgtggcatagttttaagatgttttgacatgtcacacgtaaacgatagtaaacatgtcttggaagaggggctaagatgtgggacgaacgtgattattcaatgggcatgcgcttccggccacgcatcacacgcacatacaccagcgcggttatccataactctaccatttcaagtgagccgcaagagactgtaaatcgcagtgaagtgggccgtcaggcaatgattactaaataagcatgggaaacatctaagattaacagtgaagagagaagatgcgtttggaatggaatcctggagacagttaagttaccaggtgctttcacagtcgttttttcaaattcagtcactgagacataaaataatattgatctttgagaagagctctcgacggaaacagcagttggcagtgtccccagagcacttgcccttcctctggagcgcttcacgtgcgagcccgccgtctatttataacagttgggcacttgtcgccacaatggctgattgtgtggcccagctgtctgtgtctatcaagaagggcaggagtggacagcctgcactttgatgtttcccttttttggagactgaaaataacatttttaaaaaactgccaaccggcaaggtcacaaaatatttttggatggcacggggacccgattgcaaagctgtggttcacatcagatgcggaggcctgggaagaagccagtgagccccattgcacaatatcctgctcatgccaacttcaaaagttatttgcctcggagagctcccagacgactctttctcggtaataaaacacagcattttagaaatttgcaagggtcttctggatagggcattacccagaggagcaaggatttccctggccactctggttacagttgcaaccagcagccccaggcctcttgccacccttgccccgccccaccccacatccctcacccccactccacaaactcctgcccttccctgatgagctctcaagcacttaccagcgacacgctacatatttttctaatgcatgtgtcaatttcttgactcgcccattctattatagatggctcacgaaagcaggattagcgtctgttttgttcactgatgcaaccacagagccgagaatagtgcctggctcacaatatttactgagtgcatacttgtggaattaattaatttaaatagcagagacaatgggatcaggaaacacatggaaataccgatgaccagtattagatgtcagggttctgtcgcccttccctccgcccccgacgaagatcccagctttgtttacatatttgtggtgcacaaaaatagaaatggactaaacaaaattcccgattttcccaaactgtggtggattgcagaaaccaagacttcgcagggctcggttctgaaatgattttcactcaaaccatcttcctgaaactcttcctattactctctgcccatttcgcaaaccttcttgctggaggtattagatacgggaagcacctgtagtaatcaacaagtatggctctgattaaatggatttttttctttttttttttttgagacggactctcgctctgtcacccaggctggagtgcagtggcacaatctcggctcactgcaagctacgcctcccgggttcaagcaattctcctgcttcagcctcccgagtagctgggactacaggtgcccgccaccatgcccggctaattttgtattgttagtagagacgggtttcactgtgttagccaggatggtctaaatctcctgacctcgtgatccacctgcctcgacctcccaaagtgctgggattacaggtgtgagccactgtgcccagccgaaatggatattttgaaaatcatcaagttatacaaaagaatcccacatgctgtacaacaccactcgagattttagggtttttgcgggttttacatcagtagatcatgaaaccctgactctttaattattatgtaaatgaaattcaacaacacactcacacctcaaaaactctggaaggtcagaaagaggcagagagcagggcccccgcggaaggggaggcacacaaggcagacagaggcagaggaggtgggagtacaggccccagcactgtggtagccaacagcagagccattcttccacaccgggaagggcccccaggcctcaggaagccagctctattcagcagatttcacaagtgaaaaagcctttttagatgtcttttggggtcaggcgtggtggcttacacctgtaatcccagtactttgggaggctgaggcgagcagatcacttgaggtcaggagttcaagaccaacctggccaacatggtgaaaccctgtctctactaaacatacaaaaaattagctgggcatagtggcacacacctataatcccagctactcgggaggctgagacaggagaattgcttgaacccaggaggtagaggttgcagtgagtcaagatcaggccattgtactccagcctgggcagcagagcaagactctgtctcaaaaaggaaaaaaaaaaaggccagacgcggtggctcacacctacaatcccagcactttgggaggccggggtggggggatcacgaggtcaggagatcgagaccatcccggctaacacggtgaaaccccgtctctactaaaaatacaaaaaaattagccaggcgtggcgccgggcgcctgtagtcccagctacttgggaggctgaggcaggagaacggcatgaacccagaaggcagagcttgcagtgagccgagatggtgccactgcactccagcgtgggcgacagagcgaggatccgtttcaaaaaaaaaaaaagataccttttgggaacaattccccagcagaacaaaggtgccacttctaagtatgaggaattccttatcaaagatgcctgagcctgcaagacagctcccacaagtacaagcgctgcaacgactgggtgactgcgcgtctctggcaagcggttttgaagccacttccttagctcccatagacaggcagtgctggaaacacacatgcagggagctcccagccggtgttgtgcgatacagaacccgaaagctgcgccctccccgcaaggaggttgtctatagaaaattctgtgacatcaggattcttcaataatctcttcaacatcagctctcaacatatttatagaagatctccaggcccagcagttttcctacctgtgcaaaatgctgtggcttcaaagtaatgttttgttgtgttttgttttgtttttgagacgagtctcactctgtcatccaggctggagtgcagtgatgcaatctcagctcactgtaacctccgctcccgggctccagggattctcctgcctcagcctcccaagtagctgggacgataggcgtgcaccaccacacttaggtaatttttgtatttttagtagagatggtgtttcaccatgttggccaggctggtctgaaaatgctgacctcaagtgatccacccacctcggcctcccagagtgctgggattacagccgtgagccaccacacccagccaaagtaaatttaaaaggggctttcgtcctcctaggagtcagaatcagtcctcactgtaagaagcagaattctaacctcaaaactggtctcctgggaacactggaaagcagtgcgtgatccgaaggggcagaaatgactgacactctcaaattcccctctgcatcatgggcactcagcactgtgcctagtgcatagtaagacttcaacaaatatgtgctgttgttataattcggcatgacgatggaggtgcagaggtttacctgtgtttttattatctctggttgacaaggcggccacacccaggttgcctgttctgaagctgtctcaagacagtgaccatcacccaggctgaggtccaggatgatgtgagtgcaaattgctaaagctctccttcaggtgccaggcctgccatgacacatggcgagtcctagcagaggtcagaccaacaactcagttctttcaggtaacctgtactgatgaaaccgccccccccccccccgccaatcttactcttctgttatttcatgtctatgaagggttttggcataaaaaaaacaaaaagcctcattttaaaaaaatctacaattgtttaggtttttgtttaaagagaagcgtctggttctgttgcctaggctggagtgccgtggtgcaatctcggctcactgcagcctccaacccctggcctcaagcaatactcctgcctcagcttcctgagtagctgggactgtccatcttttttttaataacagctttattgagatataattcacataccgtacaattcatctgtttccagggtacaattcagtggtgtctagcatattcacacagggctgtgcaaccatcaccaccatcaacctagaacactttcatcaccccagaaagaaactccgcacccggctgcagtgacaccatcatcctggcttattgtcgtttgtccgccggccaccgttctgtctctgtttctttcccaacaccagcctctcttttcacgcactatctccccgccagccctgctccctgcattctgtaggaaatgcttggctcctacagtggttgacgaataccaaagcttctgtgagcacgccagagggcccccacaaagctctctcctctgtctgaaacattactctgaaggagtgatttcttgttcattctgaataaggatgacgacaccaggaagcggaggcccggggagcatttacggcgtgttctcgatgtgtgagcactgtggccagcacgttccaacccagtgctgcaagagttgctcccagccccacttcagagatgagaaaaccaaggcccagggaacccaaggtcacaaaggactctaagaaggagagttgagtaatcccagcactttgggaggccaaggtgggcagatcgcttcaggtcaagagttcgagaccagcctggccaacatagtgaaaccccatctctactaaaaatacaaaaattagccaggcgtggtggtgggcacctgtaatcccagctacttgggaggtcgaggcagaagaatcgcttgaacccaggaggtggaggttgcagtgagccgagatcatgccactgcactccagcctgagtgacagagtgagactctgtctaaaaaaaaaaaaaaagagagttgaggctgggcgcagtggctcatgcctgtaatcccaacactttgggaggccaaggtggcaagatcacttgaggtcaggggttcaaaaccaccctggccaacacggtaaaacccccgtctctactaaaaatacaaaaattagccaggcatggtggcgtgcacctgtagtaccagctactcaggaggctgaggcaggagaatcacttgaacctgggaggcagaggttgcagtgagccaagatcgccccactgcactccagcctgggaaacagagaaactcttgtctccaagaaaaaaaaaaaaaaaagaagaagaattgaaatttgaactccaagcaatgtgacaccagagctcaggcccggaaccccatgctacactgactcttgttgagagaacactccaagatgtaatcatgcctacaatgacgttgcagggggaagtgactgatccactactttcctggagaacctgggaaggtatgtgtgatcaggaggataaaaggccagggaacaagaaaactgcagagaggagacccagcaggcaagatgctgcaaaaggtgcagcggaactgagtccaccgaggagctaaaaatccctccgtcttagaattctgtccttgccaggaaagggctcctcatctcctgattgctaattaactttatctccttgaatcaagggagctaaaggaagtctctgaattagaaacctttgtggtgaggggtaaaggaactttggtaagaggatataatcaaaaatatgatgattaaagaaagatgattaaagcttggaaagcaagtcactaacttattaacagtggctatctttaagggatgggattagtaaagattttcatttccattttatacatttctatattgccaaattttacaacaagcttatagtacttagaaagttggaagaaaaaccggccgtgcacgatggctcacgcctttaatcccagcactctgggaggccgaggtgggcagatcacctgaggtcaggagttcgagaccagcctggccaacatgatgaaactccatctctactaaaaaatacaaaaattagctggtggcgggtgcctgtaatcccagcaacctgggaggctgaggcaggagaagtgctagaacctggaaggcagaggctgcagtgagccgagatcatgccactgcactccagcctgggcgacacagcgagaatccatcgaaaaaaaaaaaaaaagaaaaaaaaagaaagaaagaaagttagaagaaaaaaccaaaaagatgacctggggagaggggaagaacttctggaataatgaagtgagaagcttggcaaaacctctcctcaaaaagtaacaacaaaactagacaagtcggtcaaaaacaaccaccacagggttggaaatcaaccaaagacatacaaaaaattgaaaaatgtttattcaagaaaaactacgcagctgggcatggtggctcccacctgcaattgtagcactttgggaggccgaggcaggaggattgcttgaggctgggagtcagagaccagcctgggcaacatatcaagaccccgtctcaacgaaaaacaaaaaagtcagcctggcgtggtgatgcacacctgtagtctcagccactcaggaggctgaggtgggaaaatctcttgagcctgggagcttgaggttacagtgaactatgattgtgccactgcacgccagcttgagtgacagaggaaggcctcatctcaagaattaaaaaataaaatgaagaagaaaaatgaccaaatcttgagttagagcggtggtgttctgtgatgctttggcttgaggggctcccctccttcccctcagctcacccatgctgctacatctaccagggtgggacgagctgtgaaaattggtggctccactgctggaggggttgacttgatttggaggagagcacatgcccaaaggcactgacataaaccacggtgatttcctgtaaacaacaggaaatgtacagaaggtcaacatctcagccaccctgagcctgcaatgccggttgtggcaaccaacagatcaggagaccagccaaaaacctagccggaagatacagagaataagggagctatcacgggcagtggtaaagtccctgaagtcccacacattcttcgtgctctggaaggctgcacacaggcaggaaagactgaagagggccctggttatccactcatccttggctaaagtgaggcctaccccacgcacaaaggaggccagaaaaggcctggcaaaaaggaaaaaccaagacaggctcgtataatatatgcctgaattctgaacatgtccctaaacgtacacacatatccaccgcaaactgtgaaaagcattagtagctcaaggtgtttcagcacacctctgaataatcattgcctgaccactaagctatgctgacctgggttaacccctgcaaagccaggcttaaacacattttaaaaataagaaaaaaaaaatgagcaggatcatcagcagctgctacagagacagacttcacagaattaatccaggcaagtcacaaacaaaaagaaataaacaacaaacctgcgttttgccaaaggtgatcataatccagagttgctacaacgtattaactaaaatacagagcttaaaaaaataaaatataagacatgcaaagaaacataaagtattgtgaattatactcaggcaagagtcataactggaaactctaagggggcccagatattggacttaacaaagatttcaaagttataagaaactactgtaagaatggaactgaaggaattcatgtttaaagaactaaaggaaagtatgtaacaatgactcatcaaatagagaatactaataaagagacagaaattataaaaagaaaccaaacagaaattctagagttcaaaagtataataactgtaatgaaaagttcactagaggggctcaacaacagagttgacatgggagaagaaagaatcagtgaacttaaaattatccaatctgaagaagaaataaaaaagcataaagaaaaataaaaagaacctcagaaacacagggataccatcaagcatgccaacatatatataaaggaagtttcaaaagaaaacgaagcaaaaggaagcagaaaaaattttttgaaaaactaatggcataaacttctcacatttgattttaaaaaattaatgttcacatccaacaaactcaaagtaagctcaaaaaactccaactcaataaagtgagccaccatgacacatcatagccaaactgctggaagccaaaaacaaagagaaaatcttgactgcatgaagacaaaatggttcttcatgaaaaggagcactaccataagattaacagctgacttcacgttagaaattaacagagaccagaaaacagtaaaatgacatattcaaagcactgaaagaaaaacttccaatcaagaattccatatccatcaaaaccataccccaaaactaacaagtagaaataaagatattcctagataaacaaagacagaaaatttgttactggcagaccctacttacaagaaatactaaaggaagcccttcaagatgaaagaaaaaaacaccagattatatcctgaatccacatgaagaaataaagaatgctagtaatactaattacataggcaaatatacagcagatttataaatagtctcttttttacacttaactgatttaaaagacaagtacatataacaataactacagacttttactactgggcttatgacatacaaagatatcatatacatgacataataccacagaggaggtagatagacatagacatttaatggaacaaagtttctatattttattgaaaatgaattagcattaatctacagtagactgtgagctctaggcacagtggctcatgcctgtaatcccagcactttgggaggctgagatggaaggatcacttgaatccaggagtttgaaaccagcctgggcaacatggcaaaaccccatctctactttttaaaagctatatatagatctttaaaaagtagactgtgatgagatgcatattgcaatccttagagtaaccactaaaaatataaccaaaaaatattaaaaacctcaccaaacagatgaaaacagaacactagaaaatatctatttaacacaaaagaaaacagtaaggagaaacagaacaaaaagatgtgagacagagaaaacatagcaaaatgttagatgtaatccaagcatatcaataattgcattaaatgtaaatggattaaacactccaataaaaggtgaagactgtcagattaaattttttagaagttctaaccatgtgctgtctgcaagagatgcagatggagaaaaatgtactatgcaaacaaaaccataagaaagttgcagtggctataataatatcaaagtaagtatgggaggctgtggcaggtggattgcttgagtacaggaattcaaggttatagtgagctatgattgtgccactgcactccagcctgggtgacagagtgataccctgtctcaaaacaaacaaacaaaaacacaaaaaaatcccacagactgaataaactttaagacaaaaaagttataagagaaaaagaaattttgtaacaataaaagggtcaactcatgaggaatatataaaaacataaatacataagcacttaatagcagagcacaaaatacaataaagcaaacactgactgaaccaaagggagaaataggcaattcacaataatgtttggagacttcaatatcccactctcaataattgacataatagttaaacagaaaatcagcaaggatatacagactttgaacagcattgtcaaccaacctgacgtaactaacatctgtagaccatgtcaagcaacaacaaatagaatatatattcttttcaagtgtacatatcgcattgtctagaatgaatcatgggctaggtcataaaacaagtatcaataaatttaaaagaattaaaatcatataaagcatgttctctaccaaaatgaaatttttaaaaatcaagaacagaaataaatttgtggactccccaactacttagaaattagaaaacatatctaaaggattcaaaggtcaaagaagaaatcacaagggaagtttaaaaatacttcaaactggatgaaaagaaaaacacagcagatcaaaatttaggatgcagctatgagaagtacttagggagaaatttataatgttaaaagcctgtatcaggaaaaaaaaaagaaaagtctcaagttaataaactgagcatcagcagggaacagtggctcacacctgtaatctcaacactttggaaggccaagctgggacgatcgctcaagcccaggagttgaagaagagccttggtaatatagtgagaccctgtgtctacaaaaaataaaaataaaaattagctggcccaatggtacacacctgtagcctcagctccttggggggctgaggtgagagaatctcttgagcctggaaggtggaagctgcagtgagccagtatcgcaccactgcactccagcctgggccacggggcgagatcatgtctcaaaaaaaaaaaacacaaacctgagtttccaccttaagaaactataaaaaggagagtaaactaaatcccaaaaaaagcagaaggaaggcaataataaatactagaccagaaatcaatgaattagggaaagtaatagagaaaactgatgaaaccaaaagttggttctttgttcagaaacaaaacaaggatgtctactctcaccatttctactcaacattgtactggaggtgctatccagaacaataaggcaggaaaaagaaatttaaaagacacagattggaaaacaagtaaaactcttcatattcactagctctatatatagaaaatcttcaggagtctacaaaaaactactagaactaataagcaagtttaacatgttcataagatacaaaatcaatatcaggaaatcaactgttttgtgtataccagcaatgaacaatccaaaaacaaaattaagaaataattccatttgtaatagcatcaaaattagtaagttaaaattacaaaactttgttgatacattaaataatatctaaataaatgtaaggagataccaggttcttggattgaaggactcagtattgttaagatggcatttcttcccaaattgatcaacagattcaacaagacccagcaagctttttgtagaaattaacaagaaaggttatgagtgggtaactgaagctgggtaacgtgtacctgagagttgattatactactctcttcacttttgtttatgtttgaaatcatccataataaagtgttgttttttgtttttgagagacagggtctcactctgtcactcgggctggagtacaatggcacaatcagagctcactgcagcctcagtttcctgggctcaagcaatcctcccacctcagtctccccattagctgggactccaggtgggtaccactatgcccagctaatttttttaatttatttgtttatagagacagggtctcaccatgttgcccaggctggtctcaaactcctggactcaagcaatcctcccacctggacctcccaaagtgctgggatcacaggcatgagccactacatttggccagcaacgtggtttttgtttgcttacaaaaaaaaaagaagactacacaaaagaaaaaaatgtacaactaattcaagggctgccttaattattcctcactctttaccctcggcccacatcatttccctacaggctgatccttgcccagtccactcctgattcatggctggtgaataggtgagggaggaaaatggagagagcgaatacacagagtgacagagggaggagaagtgaaaggtcataggcattcgctgcagccatgcctgtagtacgtccatcaccaggcttcaatttatagcagctacatgactgcgtgtgtcaatctctaactggctcatgtgccagaccagaagctactattggaaaatgcccctctctcgtcatgtcgtttgcacagtaattcacttagatctgaactgagtacaaatgagtggtgctctaagatcaaagcaccagggtctttaaaatgatcttcactctccccgcaacctgccccgaacacgtgcatgctcctttcactttcaattccaaactgcacccttctaacgctggccgaaagggaaagtaagccctgttttcgtttcctttcaaatacttgatgctttccaattttattcctattttccctaatggaataatacttactacttggaaagcatcattcatctcctctcaagatcctcacagcaacaccatgttgccagaagggcaggtgcgaaatctgaaataatggcagaagtcgaatgtcgcacgtcaatgtacagcctcccatcgaggcccatggctttatttttatgtatttatttatttattgagacggagtctcactctgtcacccaggctgcagggcaatggcgctattttggctcactgcaacctccacctcccggatttaagcaattctgcctcagcctcccgaacagctgggattacaggcatgagccaccacacctggctaatttttgtatttttagtagaggcggggtttcgccatgttggccaggctgatctcgaactcctgacctcaggtgatctgcccgcctcggcctcccaaagtcctgggattacaggcgcccactgccacacccggctcagttttgtatttttagtagagactgggtctcaccatgttggccaggctggtctcgaactcctgacctcaggtgatctgcccgccttggcctcccaaagtgctgggattacaggcgtgagcctccgcgcctggactaaggcccatgactttagcaagcgggatgttgttttccacctcctgctgctgcctcttaaggaacaggggcgcttcttcaccgcagaggagacggttctccattctaggaatgggtatgaacttgcctgaatagtctatgatgggcaatggggacgttccatctacatctcattatgaaaatccccaaaaaccttacaaaaccatataatcgtgaagttttaagaagtcttaaatagttctaatatataattctccacaaatcttttctctctaaaaaacacttatttttctcattttgatatgccacttcaaagcttttcccactccttgagtatatttacttttctctctcctctctctagtgactgagcagtgattttacctttacctatttatttagagatggaggtctcactctgttgcccaggctggagtgcaggggcacgatcagggctcactgcaggctccacctctcaggttcaaacaatcctcctacctcagcctccagagtagcttggaccaaagatgcatgtcaccacacccagctaatgtttttattatttgtagaaatgaggtctcgctgttgcccaggctggtctcaaatgcctgggctcaggtgatcctcccgcctcagcctcccaaagtgctggaattataagtgtgagccacagcttcccactaacaatttcactttttaaagagatgggtcatattgtccagtaacatttacatgagatccatgaaaaaaaagtgaatattattctttagaataataaacaattcatatcacaaaattagctttaaaagattcccgcttgtaggagctattagaatttcaaaactgcccagttaaacataacctggttcatcccaacgttttcatttacatataattcaaaaagatttacttttccataaatttcaaatgctcttcagatgaaggaaacattcatcattacatcaaagcaagtgcaacttcaatactaaatttcctgatcttttatacaattagactgcaagtgctcatctgagacagatttagagaaaattgcggctgatgcccagctctatgaaagagttttaagaactgaaataacttaaaaaaaattagaatcacagaatggggggagatgagaaaaaattcatcctaaattagaaatacgaactcctgcccaaagtgcagggtttttaaaaaatggaattgttaaacagattgaaataatatttagaaacaacaccagctcacaagggtagtaaaatactaattcttaaaatcgttaaacagattgaaataatgtttgtcaataacaccagctcacaaggatagtaaaatactaattcttaaaatcctccctcttgcgctatgcctgcttctgagttggctgagcaagttccttcccttccccaggcttctaacagtgaacatgatctggcagcattagacacaccacaactccactccagaccaagatgggtctgggtcaaacccaggacttctgcttcaaattaggagagttaccaaattaagacaattctgcctcaactgagtcaccctccagggacagctgagtccatttccagggtaagtactggggtagctctacccaccccagagagatgtattttatggtctgtcctaaacagaactggacccccagagaagttccgagatcagcacagcctgcagctgaccctcgggagagggtcaattcagggcatttgctgaccaaaaggatggatctccctcaccgggaggtggactgcaacctcccaaacactttgccactgtagctaatgtgtgcaaacatttactttgtgaatttgtatcttagtagcttcactaagtcagcaaaatccaatctctgaatctttttgtggtgactgaactaactctatgttgcacttttggtgaaaaactgcaacatagaatttaattaattctttaattaaatgggttaagggaaaaaccgtggcaataattttttttttcctctttcacttttgggatttgaggtcttcaaataagtttttctaattgtagggaaaacaaagtcttttaataattaccattaatgatttataatttaagcagtttaggaaataaaaaatgcatagaacatgatattctcatacccagacaagctcatatcccacctgcacccctttacagtcaaggatgattttgcatctcctttcctcacttaagtgccttttttgccaactaggataactcatataatgaatttttgccaactaggaaaactcatataatggctttttttaaatctggtttttctaataataaaatcatatctgttgcaaaaaaaaaacaaagcaaaaaaaatattagtacaagttcctctaatcccactgtaaagaacacgcgctatatataaatttgtatatatccttcaatgcatgtattattatctctctagacccacattattaaacacgctattttatggaaaatgagatcatgttttacatatggtacagttgcttgcttttttcaattcacagttcatggccgggcacggtggctcacacctgtaatcccggcactttgggaggcctagatgagcggatcatgaggtcaggagatcgagaccatcctggctaacacggtgaaaccccgtctctactaaaaatacaaaaaaaaattagctgggcatggtggcgggcgcctgtagtcccagctactcaggaggctgaggcaggagaatggtgtgaacccaggaggcggagcttgcagtgagccaagatcgagccactgcactccagcatgagtgacaaagcgagactccatctcaaaaaaaaaaaaaaacaattcacggtggctcttttgcacatatgggtacacgcagatctatctcattcttacaaatggttacaactattccaccataaggacagaccataatttccacctaatagatgttcaagtgatttcccactttctgctattacaagaaagacagtaaccaagattctcatacatacatttttgtacttgtgcaaatattgccatagggtaaatccctaaaagtgaaaggacttggtcaaatggcatgacatgtgaaattctgaagatatgcaaaatgtcctcaaaaaggtttctgcaattcgtagtcccaccaacagtgtttcagagggcctgcgttccctttcctctcaccaccaacaactagaatcaattttttcatctttacgaatcaaagagatttttcaaattttttttcttatttcaatatgctgttgttgtaagttattattattattattattattattattagggggattgtacatttagcccaccgcacactagctgcatgacctagagaagtaatttaatatcccggttccttggttgtaaaatgcagataatgaaagtaacatctacttctcgggggagccgtgaagatgtaatgagcgaaggcatctcagacacttggtgccgagtctgacagagtggggcttcaacaaaggttggaagaacaacgaataaatagaatatattctatgaacaatgaataaatggaatatattctatcagggtgacttaccagagttacctcactcatcaccaatttggctgctgttcaatttttgctattctcaattatattcgtatcattgagtaaattattctcttgtatctacaggaccatcttctaaggcgactctcccaggattcggacagtgttacagttcttacttctgttctttagaagaagtgaaccagcaacaacaggccacccatcaagttttagaaaattttctctgccttaaaaagtatataatgcggccaggcatggtggctcacacttgtaatcccagcactttgggaggctgaggcaggtggatcacttgagggcaggagtttgagaccagtctgcccaagatggtgaaaccctgtctctactaaaagtacaaaaaaattagccaggcgtggtggcacatgcctgtaatcccagccactcaggagggtgaggcacaagaattgcttgaacccgggaggcaaaggttgcagtgagttaagattgcgctactgcactccagcctcggcaacagagtgagactctgtctcaaaaaaatatgtatgtgtgtgtatgtgtgtgtgtgtgtgtgtgtgtgtacttttaaggcattctcttttgtacttttaaaattactagtaaggacatacatttccatatcactcactgtttgttgtatagaaaataagctttatcgttataattttcacgcatatatttttctccaaattatgacctggaaaaaaaacttgcagctagtaactggaaaactgggtaacatatatttataaaagacaaacacacatgtatttcttatatgtggcttttctctaccagtaaagaataggatgtggatgaaagtttcaaataatattatgttataaaccttatataattactgaactcaacaaaacttttgaaaaataaccaagtagaagttatttttagaaacctggaatgtcattccacctaacagaaattaaaactggctgggcctggtggctcacacctgtaatcccagtgctttcgaagaccaaggcaggaggatcgcttgagtccaggagttcaagtccagcctgggcaacatagagagatcctttctctttaaaaagaaaaaagcgaagtgcagtggctcacacctgtaatcctatcactttgggaggccgaggcaggaggactacttgaccccaggagttccagaccagcctgagtaacataagaccccatctacacacaaaaatacataaaaatgagctgggtgtgatgatgcatgcatgtagtcctagctactcaggagtctgagatgggaggattactttgagcccagaaggtcaaggcttcagtgagccatgatcagaccactgcactccagtcttggcaacagagagagtctccgtctcaaaaaataaaataataataataataaaaaccaagataaataatataaccacaacttttcttgacccatcaaagaggcggggttacaaagtaaccaagtagtagccaggcgtggtggctcacacctgtaatcccggcactttgggaggcccaggtgggcagatcacttgaggccaggagttcgaggccagcctggccaatatggtaatatcccatctctcctaaaaatacaaaaatcagccagccatggtgatccatgtctgtaatcctagctactcgggaggctgaggcgggagaatcaattgaacccgggaagcggaggttgcagtgagcagagatggtgctacttgcactccagcctgggcaacaaaagcgaaactcagtctccaaaaaaaaaaaaaaaaaaaaaaaaaaaaaaaatcaaaaaagttgaaaacagatcaatatctggcattgaggcttttaaaaagtcaaatccaaaattccttataaaggttcctgcaaagccaacttaaaaagggtccgtatggtggatcacaattcttgctacatttgatgcaaatcttcaggccaagtataaagcaactaaaatttgttttgcaaataaattggtcttactattatatatataatttatccctggtagaaatggggaaactggagaaagaaaaatttagattctagccttaaccattgtttgtgagtttttattatctgcctacaatttgggctaatcctgaaccatttcctggctgcaacaagtctctaaagaagaaccgagttttaattttcatcatgatgcattttagttggcttcttaacagaatacgttcttttttcattgttgttctggcccacgaattctgggtttttttgtttggtttttgagacagagtctcactgtcatccaggcgggagtgcggtggtgcggtctcggctccctgcaacctccacctcccgggttcaagcgattctcgcgcctcagcctcctgagtagctgggattacaggcgattctctttctattgcaatctctgtgtgcacagaattctactatccgagtgatcgatgttatatatctcacattgttttgcctattctgacagaaccaaagccactgcattctgaagactgaagacgatttaaaagcctgtgaatctcccttgtttggaatcccactgggcccgatctgttttccatgaccaaggcactgctgctaaagctatacagtatcaagcaccctccttaaaggctcagggaccatgaaggaagaagagggcatgtgagattacaagagctggattacaagagtggactgtggaggctgaagtagctccatcgtggatgctactccgccatgtggcttctgattaaccccagttccaggaaaccctctgagatttccagcttatgcgctgttcctcgtgtaagaccaagaacttaccataaagcctgaccttaggtcaaacaactttgatgttattgtactcacactgacctacacatccctctgaatcaccccttccctacggtatacaagccctgggaccaggggataatggtgcagggatccactgtctcttctcgctgcagccccagttcacagactaatgaacagaagcttgagaacagacatagcttctgtgcataagcccctattaaatgtttctaagaaaaaagaaaatgcttgaagaagaaagaaaggatagaaggaaatatttgaagagataatggccaataattttttaaacataataaaagacatcaaagcacagatccaagaagtttagaggactccaaaaaagagaaataccaaaacaacatcatgtccaaattgtcgaaaactaaaaataaagagaaaatcttaaaagctgccggggtgacagtgggaattgggaaacatattacattcagaggaacaaagaaaagaattatagcagacttctcaccaaaacaacaaaagccagaaggcagtggtgtgatatctttaaagtactaaaagaataagttgcaaaaaaaatttttcaacacaaaccttcatatcctaaaagaaaaaaaaaaaaaaaagaaacaaacaaaaccaaaaaaaagaaaaaaccgactcttaaaaatgagtgtctcttggatctccttggtatgaaatttttctttaaacattttcttttttttcagaaagagtctcactctattgcccaggctggaatgcagtgacgtgatctcagctctctgcaacctccgcctcctgggttcaagtaattctcctgcctcggcctcccaagtagctggaactacaggcatgcgccaccatgcccagctaatttttggtagagacggggtttcgccttgtcagccaggcaggtctccaactcctggcctcaagtgatcaactctcctcagcctcccaaagtgctggaattacaagcatgagtcaccgcacccagccctctttaaaaacttttttttttttttgagacaaaagtctcactcagttgcccagactggaatgcaatggcgcgatctcagctcactgcaacctccacctcctgggttcaaatgactctcctgcctcagcctcccaagtagctgggatgacaggctctcaccaccatatccagctaatttttgtatttttagtagagacagggttttgccatgttggccaggctggtcttgaactcctgactgcaggtgatccacctacctcggcttcccaaagtgctgggaataacaggcatgagccattgtgcccggcctaaaaacattttctaatgggagggaaataaaaactttttcagacagacaaaggctgagatcatttattcccagaagacctgtagcataaaaaatgttaaaggaagtttttcagtcgggagatgagacagaaacctatagatctacacaaagaaacgaagagttcctgaagtggcctaaaaagaagaaagattttcaaaataattttcaaaagtattttgaaaatcttccattgttctaaaactacactgtctatatggcagccgcttaaatttaaattacttaaattaaactagtttatttaaaattcagttgttttcaggtactcaatggtcacacatggatagtagctaccatattgtatagtctagatataaaacatttccatcattgcaggaagtttcatcaaacagcattgctctaaaaggtaattttctgtaaaaataacatgttatgaggtttataatatatataaaatacattattatgacactattagcatcataaacatttacaaggttctcatagaaccttgtagtaacttacagttatgaagaattcttacgaggttcttatataataaatggtataatatttggaggcagactgataaaaaatgtactttgtaaatttcgggcaatgacttaaaataagtgagaaaaaatatataagaaataaatcgatagaagagataaaaatagaatcatgacaaaaatctggctgggcacagtggctcatgcctgtaatcccagcactttgggaggtagaggtgggaggagcacttgaggccaggagttcaagaccacgctgggcaacatagtgaggatctgcctccgcaaaaaaaaaaaaacaaaatttaaattaaaaaaacaattagccgggcatggtggtgtacgcctatattcccagctacttgggcgacagaggcgggtgggtcgcttgagcccaggaggtcgaggcttcagtgagctacgatcatgccattgtaccccagtctggatgacagggcaatacccagtggcaaaaaaaaaaaaaaatagaaaacacactagcaaattgtctacaaagtggaaggttaaaaagtgatcgaggggaaaaaaaagcagttcggtatttctttacatagacaattcaaaaggttgttctgaatctcacaaagatttattgaaagttgttacacttttaagtactactttatggccgggtatagtggctcacacctgtaatcccaatacttttgagaggctgaggcaggaggatcgcttgagcccaggagttcaaggccagcctgggcaacatggtgagaccccgtctccacaaaaaaatagaaaaattagccagctatggtggtgcatgcctgtagtcccagctactcaggaagctgaggtaggaggatcacttcagcccaggaagctgaggctacagtgagctgtgatcatgccactccactccagcctgggtgacaaggtgagacctgttactatatatatatggagtgcagtggcaccatcttggctcactgcaacctccgcctcccgggttcaagcaattctcctgtcccagcctcccaagtagctgggattacaggcatgtgccaccacgcccagataatttttgtatttttagtagagatggggttttgccatgttggccaggctagtctcgaactcctgacctctggtgatctgtccacatcagcctcccaaagtgctgggattacaggcatgagccaccgtgcctggccagtgcctaattttaatctcttactaaattaaccactaaattaattttttaaaccccagaggaacattaatttacagcagaagaggtaagggaaaactggatgtactggcaagaaatgtacccggtcccatgtgtgcaatctgtcaacatgtaaatactgagcgtctgctaaacaccatacaccagggacacaaaaatgttgcaaaatgtgtcctggagagctcagtgaaggggagacacaactccaaagacccattaacgcaaaaggaggtaaaaagagacctggcaaggaatggcggctggggcagcgggggggccaggcgggagggctcaggaaaagctttccaacggagatgctactggatcttgtaaggtgggcaggggtccaacctgcacagatacctggctgagagtatctggcttatttgggaaaaatgcaggcagtgttttttggagaaacagataaattttaagtctggaagagttcataggggttctattatcctgaaatgcatcgctgttatttctttaagtgacagatatctagttaatgaggagaaaaggcaggcacaaaagcacaacgtgatgacagagcaaatgcaaaataacagctgggtggcgtagcacatgcctgtggtcccagctacttgggaggctgaggtgggaggatcacttgagcccacgagttcgaggctgcagtgcgctaccatcacacctgtgaacagccactgtactgcagcctgtgcaacacagcaagacccccgtcttacaaaacaaaaatgcaaaacaaaattagtgcccaatttctcaggtttatgcctagttgctaatctgtgacatctctgttagaaaagctaacaagagcctaaaagaaaaattcaagtcagctccaggactgatggtggcaaatctacaactccttccacttaaaaattcaacaaaataagagatttagatttttgcatttttgtgtgcccaaagaaaaaggctccagttttctgtttcgtgttccatcagcttacataacctaactcgtcccacacaaagacagacgaatgatttttcttgcagatgaaatattcccaagctctcacctctaaggtctaagtggatcttgtgataaccagcacaaagtgaggctggggatttgaaaagaaaataccagaaatggttaccaaaaactgacaagagcacccaaacagcatctgtgatcgctagaagatagacgcactgacaaattaaggagccattaattagtttcaaagagaaccaaatggcatcaataattttttttttagacaaggtcttgctctgttgcccaggctgcagtgcatcaataattaagaatcagcctcctggctgggggcggtggctcacgcctgtaatcccagcactttgggaggccaagggaggaggatcacctgaggtgaggagtccgagaccagcttggccaacatggtgaaaccccgtctctactaaaaatacaaaaattagccgggcatggtggcaggcacctgtaatcccagctactcagggggctgaagaaggagaatcgcttgaacctcagaggtggacgttgcagtgagccgagatcacgccattgcattccagcctgggggacaaggttgagacttcgtctcaaaaaaaaaaaaaaagaatcagcctcctttctgtacacgctttccacagctagcatgcggactcactggactacagggtgtaagatgaggccaactgtaagccctatacagggaagttacagttttgttcaaaactcactcacaattgggaacagcctgagaccatgcctgcatggaacagcacagccttgtccccccccgaggacacttcctgtgacatctggagagatgagcagattcacgaggcccaggagggttttcaggtggtctttctggctgtagagagatcaaacacacccttccccaacgtcctttaggagtaaatgaccaatttagcaacaatgagcactcaagaagtacgccagcattctctttattatgattatttcctgcacattacatcatgccttcttttcttacagcgggaaaacacccacacacacgcacacaggtatatgcacacacacacatcaaaagttactgtaactcctaagcagagaataggcatatttttggcctttacctttcagtccaattttttaaaatgagatataaaaactgaaaaggaggggattttaaatttatatgattttctgccaagaaaaatctaaggctatctgatttttaaaaatcagacacaggccaggcgcggtgactcacacctgtaatcccaacactttggaaggctgaggtgggtggattacttgaggtcaggagtttgagaccagcctggccagcatggcaaaacgccatctctactaaaaatacaaaagaaattagccaggcgtggtggtgcacacctgtaatcctagtacttgggagtcttcggcagaattgcttgaacccaggaggcagaggtggtagtgagccaagatggtgccactgcactccagcctgggcaataaagtgagactctgcttcagaaaaaaaaaaaaaattcagacacaataagcattcaattaagtgtccagttacaaagaaaaataacatgttcagcttcatagtttcttataaagttaaacacactcatcatacaacccagtcactccactcctatgcatttaaccgaaacaaataaaaatatacatccacggaagacttgtgaatgttcacagcaactctattcataatagccaagaactgcaagcaactcaaatattcatcaactgataaactgattttttaaaatggtggtatatccagtccaggcacaatggttcatgcttgttatcccaacactttgggaggccaaggtgggaggattgcttgaactcagaagtttgagaccagactgggcaatataatgagacctccatctctacaaaatacttaaaaattagccaggtgtggtggtgtacacctgtagtcccagctacttgggaggctgaggtgggaagatcacctaagcctaggaggtcaaagctgcagtgagatcacgccactgcactccagcctgcctagagtgagaccctgtctcaaaaaaagaaaaaaaaaaaagaaaacaaaaacataaaagtattagaagaaaatataggttaatattttacatagtcctcaggtggggaaggcttttctaaccatgatactaaaggtagaaaccataaacaatgattgatagataagaccaacataaagattttaaatttccacatatcaagaaatatcacgattgaaagacaaattagaaaatgggaggcattttacaacatatatggaagacaaagatttaagatacttacataaataaagaactttcacaaatcagtaaggaaaagacaaccaattcacaagcaactcatgaagaaatacaaaagggcaacacacatatgaaaaagagatttggccccactactaattatcgtgggcaaagacaacggcaaataaggatattcatcacactgttataattgacaatattatatttcatcgagtctaagatgccaatgatgatgtttcattactttttgttctattaaaatataatgcaaagtgctgccaattaaactatgacataccattaaattatacaatgcatcctgatgtgagggatggctggattattaacagtttcatattgtgatatacaatgattcaaagctggaaacaatctacatttccaacaagagatatttcctgaataaattatagtacatccccagaataaaatctaagtcatttaaaatgatgatacagatgtatgtacagacttggccaggcatggtggctcacgcatgtaatcccagcactttgggaggccaaggtgggtggatcacctgaggtcaggagttggagaccatcctggccaacatgttgaaaccccgtctctactaaaaatacaaaaattagctgggtgtggtggcggacgcctgtagtcccagctactggggagtctgaggcaggagaatctcttgaacccgggaggcagaggttgcagtgagccgagatcatgcccctgcacttcagcctggatgacagagcaagactctgtctcaaaaaaataaaataaaataaaataaacaaagatgtacatacagatttaagtggaaaggtattcatgatccatgaatggtgtttaatggtgttaatggtgtttaatggtgttaatggtgtttaatggtgttaatggtgtttcatatgacaccattatatctatatatatttatatgcattgatatatatttgattttgaataaatatttgatatatatcgtatatgcactgaaaaagtctaaaaacctcatgttgaaacattcaaaatggctatctctagttggtaaatgtttttttaatcttctttttgcttatctgtcttttctaaaacaccaaaaacatgttttacttttataataaaaaattaataaaaataagatggtcaccccctttgccatctgccaaaacagagagcttcaaaagtcacacattccttaaagctgcagtatttacaaaggaaagaaaaaccttcaagcaatctaaaaagctcaaacaggaaatgattaaactatggcatattaattcaaagaaatactatattatgtagatgcacaggaaaatccccatgaaatagcaacagaaaactcaaacacaaaatgaccaacatcaattttaacaaagaaaaaaattaccacctgtacctaagaatttaaagaagttaacagaggtaatttttcttttctttactttttttttgagacagtcttgctctgttgcccaggctctagtgcagtggcatgctcttggttcactgcaacctccatctcccaggctcaagtgattctcctgccttagcctcccgagtagctgagactacaggcgtgcgccaccacacccgattaatttttgtatatatatatacattttttgatagaaatggggttttgccacgttggccaggctagtctcaaactcttggcctcaagagtgatcctcccgcctcaacctcccaaagtgctgggatttcaggcatgacccaccgttcccagcccaacggaagaaatttttctaataggcttcagagaattatgtgttttgacctttccattaatgtcttatataaaattagtttgacagaaacaataaaaaatatatacaccttcagaatcatgacggcgttctccaggcctctaccagaaacatttttttcgtttttttttttttgtaaaaatatcaattttatgctccaaaaacattccacatggcaaccaaggtcccgtagagagcactttttcccccttgcctcttctttaaactcctaattcaaaattttggtttctgataacctgctcaggataaaaagaaaatctcacatagaaatgcctttactacagggaaatggagcaagaaatttcccttgtctctgggattgcttttttctgttttctggttaaggaaaacatttcaaagttcataaaaacaaggaactaaaattagagagatgagaactgaaccttgactcgaggtagggaaaacactatttttaaaccgagaaatatttctaggtctgtgctttatgagaaaggaagacgagcgtgctcatgtgtgtggatggtgtggcctggggagggacggtggcaggagaaaaccatctcccgcagcggggcattccctgcacctcacacacatctgctctcgtggaacacaaactggaactaatcagcaggcggcacctgggaattctagtcacttaacagcagggagaaggttgcacgttgctcacagcagatcatgaagccatctccacctcctgctgtcaccatcctcagaaccagcagtggctccatggctccctgactccagaggagctggccgcacaggagaccctctgtcattcctgcagaacagctaatgctttgcagagctccagatgtaagtttaagaaatacgtttgttataaggtttcttaacaagacacatcagtgatatctaagactcttaacaggtgactattaaagaaataaatctcttccacatattaaaaccacattcatcctgacagtcatagcccagctcgaaagccttcgagagtgcttttacctcccaccacatcaaatctagatttcttcctttcatcctgacacccacatgttcaacatcacagcacatgcggggagcccccagggtgcaggaggggaggagggcgctgtgtctgcaggggcgtgtgggtaaaagcaagagagggtgtaacggtgggtggggggagggtgctgtgtctgcaggggcgtgtgggtaagagcaagaggggggcagcaggggaggagggcgctgtgtctgcagtggcgtgtgggtaagagcaagaaagggggcggcgggggagtcttggagaagggaggggtgcggaggggcactgccttgtgaggtcactggtggtgatgtgggttccaagcagcaagaaaaagggattgaggccaagctggagaactgaaggcaagtcacgcacaggcagagttggttaaatgatccaatttcacaagtttctcctagaacaagcagctacattttcattttttaaaatgctgcatgaaggttgggcagtggctcacacctgtaatcccagcactttgggagactgaggcaagagtgtcacttgacaccaggagttaaagaccagcctcggcaacatagcgagaccctgtctctacaaaaaaaaaattgaaaattagccaggcatggtggtacacgactgtattcccagatactcaagaggctgaggcaggaggatggctagagcccaggagatcaaggctacagtgagccactattgccactgcacaccagccagggcaacagaacaggaccctgtctcaaaagaaaaaaaacaaacaaaattctatgttttaactaaagtcacagccactaatgcattgcatccctaagaatcattttctttcttcatgtcctccccgttcccacacacctaccttccttaccagcagaagcctgattctgcttggggtatctcccttctacctgcttaggaaggagatgcacacacgcacacacacacatgcatgcatgcacacaggcacacccatgcaagcacgcacacacacatgcaggcacacccacgcatgcacgcacacatatatgcacacccatgcacacccatgcatgcatgcacacatatatgcacacccacgcatgcacgcacacacatgcacacccacgcatggacgcacacgcacacacaccatgcatgcgcacacacagcccacccgcagtaagtagctggagcagggtaagttcaccccaatggggcttccctcccctttccagtaactaaggaggatgtggcacatggccccgccttggccaaagggagctgagagatgtctgcttagtttccatgccagtaaaataagacatgcaggattggaaaagcccctcttctttactagatatcactgtgtcattcggaatggctgcagccactttgtgccacaagggaagacatctcccacgtggcaaagacagcagagagcaaagatgaaaagcacctggggtcctggaaatgtcatcacacctctgaattaatcaaccctggaactgccatacttcttgttacatgagatagtaaatgcgtttttttgtttgtttgttttaggtaattttagttaggttttcgttaactcacaacaaaaaccatcttaaccaatataacatgcttattttatcaaaacataaagtcttttttttagaaaaatcacctatacataagttttctgtttgtgtgggatacaaaagtgtctttccactagtgtggctataataaaaaagacgaacagcagcaagtgtttatggagacgtggggaaatcagggcccgcacacactctggtgggaagagaaaatggcatagccactttaaaacaaactccagacattcctcaaaaagttaaacagagttaccatatgacccagcaattccactcctaggtacatacccaagagaaatgaaaacatatgtccacaggaaaacgtgtctgccaacattcatagaaacactattcatcatagtcaaaaagtgaaacaacccaaatatccatcaactgaggaatggataatcaacaaagataaacaaaacgcaatggaatattattcagccatgaaaaggaagaaagcactaatacatgctacaccatgggtgaacccagaaaacattaggctcagtgagagaagccagtcatgaagggccacatatgatgtgattccatttttatgaaatgtccagaacaggcaaatgcaaagagacagaaagcagcttaggggctgccaggggctgggagcactgggggtggcagctcgggtgtgccgggcttctctgtcgagtgaagaaaacgtccccaaattgtctgtagtgatggatgtcaaagtataggaactgtacacttaaactgctgaattgtgtgacatgtgaattacatctcaataaagctttcttttgtttgttttgtgtttttctttttgacacagggtctcaccctgtcacccaggctgggtgacaggtgaattacatctcaataaagctttcttttgtttgttttgttttgtttttgtttttgacacagggtctcaccctgtcacccaggctggaatgcagtggcacaatctcggctcacagcaacctccgcctcctgggttcaagtgattctcctgcctcagcctcccaagtagctgggattacaggcacccaccaccacgcccagctaatttttatatttttagtagagacagggttttaccatgttggccaggctggtctcgaactcctgacctcaagtgatctgcctgcctcagcctcccaaagtgctgggtttacaggcctgagccaccgggcccagcctcaataaagcattttttaaaaaatgaaatgttggctgggcacggtggctcacacctgtaatctcaacactctgggaggccaaggtgggggtattgcttgaggccaggagattgaaaccagactggacaacacagtgagaccccatctctacaaaaaattcagaaagtttaaaaattaggtggtgcacacctctagctccagctactcaggaggctgaggtggaaggatcacttgagcctgggtggtcgaggcttcagtgagccatgattgcaccactgcactccagcctggatgacagagtgagactgtctcaaaaacaaaaacaaaaacaaacaaacaggaaatgtgatagaatcagtggcaatctctgtgtttctgttattaacatagccaaactgagccgcctgctagttatcagaaacccaacaaggaacgacccatattcctgtgacttcttaagtaactacttaacttgcgcatttatgatactcatatcaacttcaactcccggccttctaactggtttagctacagccaaataaagtacacatttttaaaagtcttcagacgcctgtctctccatttacccattggtgccttaggtataaacagtgctgagtggtggcactggctggcaacacccagaggctgaaagggaggacactggaagctggacgcagtggctcacgcctgtaatcccagcactttgggaggtcaaggtgggcagatcgcttgaggtcaggagttcgagaccagcctggccaacatggccaaaccctgtctctactaaaaatacaaaaattagcggggcatggtggcgcatacctataatcccagctacttgggaagctgaggtggaagaatcacttaagcctgggacgcagagattgccatgagccgagatcgcaccactgcactccagcctgggcgacagagcaagactctgcctcaaaaatgaaggagagagagaaggcaccaggttccaaaagagagccgcaccaagtgtgtgcacccagcccccaggagccctccgtaaatgtgtgttaaatgaatgtgtgtgtgaacaccatcagctgaggtggtatagaaaaagcaactcctggtcagagcagggaggaactcatctaaaggggaggctcccaagagctgcagcagagggtcaccaaaggaggggaactccatgtgggattccaaccctgactggttacatggaagtgaacaggacctcgtcgaagagggagaggtctgcgttgcctccaagcagtgcttcttgaaatggtatccccccagcagccgcctcagtatcacctgggaacttgcaggaatgcacattcttgccccaccctggacccgctgagccagactctctagggtggggcccagacgtctgtgttttgactcagatgacatcggtgcaggctcgagagtgagctactcttccagggacaaccagtgtggtccttccacccatgcgtgtccagggatgaccagtgggtgctggtgttcagggtggtgtgcggacatccattcatttattgcataattattaaaaaaaaaacaacactcgctgagtatctactgtgccctaaaaaatgagaaagactccgctaatgtgtaggcagtcaaccagccctggtcagcgtactcacaggtaggcagacggccgcgcggagagcaccaaggggcagaaggatgctgcttgggggtggggaaggtggcgacgcaatgaaaacagatgaaggacaaggagaaaaaaaatcaagtgctgccagacactggcacaaagctggaagggaggtcacatctatcgagggggaggagggcaacacaggaggagaagagacagggaaaccgcctctccggtgccttccacagagggtccattgcaagcaagtggagaatcagccacatgccatgtactacgtggcaggggtggcagcccgagccctgagatcggagagcctatcccatgtgacgcatgtcagccacacatcacccaggcctgtgatgaaggacaagcgcacgctccgctctgatgacacgcgcagctggcacggacccaggagggatcatggacgtgaggagacgtcagtgtccaaagagggcccatcagcccagagaaagttgacacagaatcatgaaacataatctacttaggggacagctcactctcagcaccagtacaaaatgtagattttatccattaatacttccataattagctcaaaaaaattggactgtgttttttatttttattaatttttttaagacagggtcttactctgtcacccaggctgaagtgcaatggcatgatcttggctcactgcaacctctgcctcctgggttcaaacgatcctcctgcctcagcctctctagtagctggaattacaggcatgcgccaccacgcccggctaatttttgtatttttagtagagatggggtttcaccatgtttcccaagctgatctcaaacccctgacctcaggtgatccgcccacctaggcctcccagagtgctggaattacaggcgtgagccaccacgcccagccctccaaagcttcttcattctcccctaatcaaggtgctgctccttcttcaaatcctgccatcctaggagctcacctgaaccctattccattctgatactgcgccctacatcccaacaagttatgtcttttacctgcattctattaatgtgaaatccactctggctttcttggtgagcgtttctacatttacctgcacccctcatgaagcagggagtttcctcttttatggtgaggttttgttttgtatggagattcgtttgttctgtaacatctccttctttaagaacaaggaaggccgggcacggtggctcacgtctgtcatcccagcactttgggaggctgaggcaggcagactggttgagaccaggagttcgagaccagcctggccaacacagcaaaaccctgtctctattaaaaatacaaaaaattagccacatgtggtggcacatgcctgtaatcccagcttcttgggaggccgagacatgagaattgtttgaacccaagaggtggatgctgtagtgagctatgatcacattgctgcactccagcctgggcaacagagcgagattccatctcaaaaagataaaaaaaaaaaaaaaaaaaagaagaacaacaacagctaagagtttggcagagtttactctgcacagttcagggagggcactgagtctgtgggcataaacactcagtccctcgtgggatgtgctggatcaaatcagatcctttgctcagatactacagtcctgaagcaatcctgttactatttgctcggatactacagtcctgaagcaatcctgttactatttgctcggatactacagtcctgaagcaatcctgttactatttattttctttctttctctctctctcttccttccttccttctttctcttttctttgtttctctttgtttctgtctctctcgctctctccctctctttctccctttctttcgtttctttcttcctttcttcttctttttttttgtttttttgcgacagagtctcactctgtcacccaggctggtgtgcagcagtgtgagctcaagcaatgctcctgcctcaacctccccagtagctgagactacaggtatgtgccaccatgcccggctaacttgttactattaatgaggcctcacagataccttgatctcatggaggaactgccttgggaagtagatattaatattccagccactggaaaagtacatcatattccccaaagtaacttaatacactggcacctgctttatacatcggtctcatggtcagcatgaatcacaactcctaaactcacacagttctgaagactgatggaaatgaagattctggtttgtttttgtctttgttttagatagggtcttgctgtgctgcccaggctggagtgcagcagcatgatctcagctcactgtagcctcaacttcccaggctcaagcgaccctcccacctcagcctccagagtagttgggactacaggcacgtgccaccattcccatctagtttttgcattttgcagcgacaggatttcaccatgtgaaccaggctggtcttgaactcctgagctcaagcgatctgcccaccttggcctcccgaagtgctgggatgacaggcatgggattccaaaccaagattcttaatctcaaaattatgaacaagatcctgaagctcggtgatcacctcaggatctctgtccctcctaagaggctgtaacagcaccgtccacctcatccctctccgctccacaatctacaaaatctctatgtccaatcttatcttgccaatctacaactgtcttgtactacaatatactctaattgttaatgttggtctggtaggttcgcttttcataacagctttatatagagagaattcatatactgtgtaattctctcgtttatagtttataattcagggaggtttcgcacacagagttgtgcaaccatcaccatagcccattcgagaacattttcatcaccccgaaaggaaaccccatccatacccatcggcggtcacctcccatttcccttcagtttccccagccctggccatcactaatctactttgtgtgtatggatttgcctgtagttctagagttcctagaaatggaatcatataaaacgtggcatttgggtttttgttttgttttgttttgagacagagattgctctgtcacccaggcaatctcagctcactgcaacctccacctcctgggctcaggtgatcctcccgcctcagcctcccgaggggctgggaccacaggtgcatgccaccatgcctggctaatttttgagttgacaggattttgacatgttgcccaggctggtctcgaactcctgggctcaagcgatcgaaacgtggcctttgtggtctggcttttttcactgggcatgttttcagtattcgtccacgttgtcacatgtatcagaactccattcctttttaaggctgaatcgtatgctatcctacagaggtgctacgttttgttgatgtgttacttgttttgtttatgtgttcatcagcagacaggcatttgggctgtttccactttttggcaattgtggataatgttgctatgaacattcctataagtttttgtgtggatgtgtgtttttcacctcttaggcacaaacccaggagtggcatggctgggccctacggtagctccgtgcttaaccttttggggacctgccagactgtcttctgcagcaagtgaaccatttcacgttctcaccagccgtaaaggggaaagtctgggaggctcccgagacaagaccatggtttcttcgtgctcacatcttcaacctccagcaggtactccaaaattttccaccagtgcctgcgtgccaaggtggcttccaaagagagagcaaatcaagcctggccacaggggaccagggcacttcccagaacagtcctctccctggtgggatccttttgttccctggaaaagccaaccccccttaatcctgggtagttttacctacccacaggcttgaattacatcctaacaaacagtaaaccacacttgctgggactccgtgggcccgagggctgcttaacagcttggcaggcatccccggcagccactgtgacccagctgccctacaggccattccaagctcccccaacaagggcacttttcaggtgaactcatacaaatgtgtgccgagcgatacccctgacttggaggggactccagctgaggtcagccctggagcaggccccccacgccctatggatacttccaagcccaacttagcaaatacagctggaggcgtccaacctcacccagttgttcaaggagggaccttgccccttcctttgcctttaaggatgaacagattttttttctacttagaaactcaatgtgttcctcttctatcctaaacactactgatgttcggtaatgcagacatgtttacatgctatttcttgttttaacaacatgaaaacaaaataaaaatgaactatgaactgatgacagtgtttgggagttgagctttttctgtggccaacgctgcttttaaaaacgttctatattaaggaagtgctgtgggaacactgctggccgtggaaaccgtcccacctccctgtgctccgaagccagccagcaggcagagtcctggctgggcacgagacgctcagggctcactcgaccccacggaaaccagagggaagcctaattttatcacgctgtatttagacggtgtggattcatttgaacaaggaagttcctagagttgttgagattttttttttttggtcaatgtttaaatactacttttttttcaagcttgccctagataccaactgtttatctaacacacaattccagtgttgccaagcctcatgccaatttgaagggaacagccaaaacttatgcattcatataaaaagagtctctaggctcttatatctacattataatttttatcctaatcacaaaactattccgaatggtagtgaacaaagtaattatttcaatcaagaaacataatggccagccacatctatgaccaaattgacctaagctttcagatgttttccaaaacatcggactgccacaggtaactttttacagggtcttcatataagttcctattttattattttattttattttattattttttgagacagagtctcactctgtcacccaggctggagcgcagtggcatgacctcggctcactgcaacctctgccttccaggttcaagcgattctcctgcctcagcctcccgagtagctgggattataagcacgcgccatgatgcgcagctgatttttctatttttagtagacacggggtttcaccctgttggccaggctggtctcgaactcctgacctcaagtgatcctcctgcctcagcctcccaaagtgttgggattacaggcgtgagccactgcacccagcccaagttcctcattttaaaagtggcagaggtttgtcaaaaagttaaacagagttaccgcgtgacccagcaactccatgcccaggtatgtgccccaaagaactgagaaaacagatactcaaacaaaaacgtgtacacgagtgttcccagcagcaccatccacaatagccaagaggcagaaacaaccctaatgtccatcaatggaagaatggaaaaacaaaatgtggtttatccatacaatggaattttatgcacccataacaaaaaggaggtactactccatgccacaacatgaatgaaccttggaaacatgctgagcgagagaatccagacacacaaagccacgtatcctacgattccaagtataagaaacgcccagactcggtaaatcctgcagatgcaaagtgcagcacagcggctgccaggtgctagggcttgggagctgggaagtggctgcttagtgggtgtagggtttccttctaggggtgatgaaaacgcttcggaattagacccaggggatggttgcacaacactgtgaatgtgcgatatgccactgaactgttcaccttaaaaatcattaagttatgtgaatttagcttcaattaaaaataaagcaggctgggtactgtggctcacgcctgtaatcccagcactccgggaggccgaggcgggcagatcatctgaagccaggagtacaaggccagcctggccaacatggtgaaaccctgtctctactaaaaatacaaaaaattagacaggtgtggtggcgggtgcctgtaatcaccggtacttgggaggctgaggcacgagaattgcctgaatccaggaaacggaggttgcagtgagctgagatcgtgccactgcactccggtctaggcaacagagcaagaccctgtctcaaaaaacaaacaaacaaaagaaccaagtaggaagaaatgtggccagttcctcctgggcagtgttgtacagaacacaccaaatttctacagtgactcctaccagacgtttcttgggaaagtaagcaaagtcctttcctgaaattctggtaaattttcataaaaatcaatacttccctaatttaacattcacattttagcttacagtataactagttatagaattgttcattaattctaattgactttcgattatacaatctaatatctaatttccattttctatttctagtacataagcaaaagaaatgcccttttggtcttatggaaaacgtgtcctatttaataagacacaaatttgattcaaatttctctttctcctcctcccccttaataatacactaaaaataactgtaataacatcttacacatcctgaacgcctgtacctagcaacctcacttactcagactatagctgacaactaaaaacctgcacaaaggctgactccttagccctttccatcaaacgatatctgcaggctgaacgagcttaattacttgttggtttggttttttaatgtaacgaagtaaaaaccaggagcaaatgtgatacaggaaagcacaccaacagctacatacatggatagcaaaagaagccaaaaaaattattttttaaaatgtaagaactggaaaaacagaatgatctcagtttttttaaaaaagcaaagattcctatttttatagagaaattgctatattagtaaaagccaaataacaagaggcaaaaataactgagtcatcaagaaaattacctcttatttggcacagtccatttttatgaaagtgctttatctatttcagaaacataaaatcaaatgtttgaattggttaaaacagaaaattatctgattgattaaaagagaaaatcctctgctcttcagaaaactcaaccatccagaaagtgctatcactgacatttatatctaacaacatggcaaatgaggttggtttcatattcaaccatttgctgtccccgaagctctctattaaggatctggctgatcagaaaacttaatatttaatcaacctagagcaggcctagaaaagaggctactgtttaaaaacaaacaactgattatataaaacatttacatcaaattataattcagtattaaatctcatggaatcacgcctttcaggaaaacgtctggacactagtgaaaatgaaatggctaaatctcaatcaaagtatattattaagtaataaaagattttatcattcaactttttttttgtctctacataaaaaaagtatttttgtctctacaaaaaatacaaaaattagtcagtcgtgttggcatgcgcctgcagtcccagctactcaggaggctgaagctggagaatatcacttgagcccaggaggcggaggctgcaatgagctgagatcacgtcactgcactccagcctgggcgacagagccagacgctgtctcaaaataattaattaattaattgtttaaaaaatcaaagaatagcttaaaattattactaagctaagaaccttgctgctattacttgttcaggaaagctccacacaccataggcagtggtgctaaatgcaacagaagccttagtgcgaactggaacttctcccaggagtctatggaattggaaacttaatagctactaaatacagtaacatcatgactggagctatgaaagcaaacatttccatttgaacttcaagtggcagaagggacaaagttgataccttagactcatcagccctgaaagtgttcctaatcacaatttctttcaggagccagaaagaacacagcgttaattatgttaatccagctgagacgttcactatgaaatgtgtgttagagaaaagtcctttgaaatttcttatttgcatggtagttctgaaagtttttaacctcctgcagttcctggcacacggagtcagtcactcacttgtcctcaggaagcacaggacagcagcaggttcggaatcacactttctctgtgtgatttcacaactcgggtctttgtccaggtgagattctcactcgggtcagagggcaaaggtatccaatgacaaccctgtccttcagaaccaagtagtgttttcccatcagccgtgcaaatcacagcaaatgtcatgtggctttccagcagcctctttgctgtttgttgaggaaggataagaaaaccatggaggattaaaatcaccacattcaaattactataaagaaaaggaggccaggcgctgtggctcacgcccgtaatcctagcactttgggaggccaaagtgggacgatcgctcgaggccccgcaacacagcaagacccccatctctaataagaaaaaaaaaagggagaagaaagaaaaggaaaaatgcagacaagccagaaaataaaattgaggagattaatacaatataataatcaggcactgcagatcacacctggaacaccgcctcacccaggcaaaggaggaaaagctttcatgtgtgctcatcatttgagcaaaaaggaagaaaacacacacagaaactcaggagatccagaagagacactctgaacaaagaaaatggaaatgacagggaaccaaatgatccacatcagggattttaagagggaaattatgcttctgaatgaaaaaaataaaatcattcaaaactttttataaatctttgacaaaatccaagagtttcctttcaatgttgatgacatttaatttttttttttttttttttgagacagtctctgtcacctaggctggagtgcaatggcgcaatctcagctcactgcaacctctacttaccaggttcaagcgattctcctgtctcagcctctgagtaactgggattacaggtgcgcaccaccatgcccggctaatttttgtatttttagtagagacagggtttcggacgttggccaggctgatctcgaactcctgatctcaggtgatccacatgcctcagcctcccaaagtgctgcgattacaggcgtgagccaccgcgcccagccctctaatttctaattacaacatctaaggtagacactttccagatgcattaatgtgggggacaactagaggactaacacgtccccttgcacactcaatatagggccagtagatccagaagctcaccgtcaagagcaacaagagcaagcaagtccttcctcaacagaatcatcggtaagaacactgtcagtccaggattcactcagtcctacgagtgaaaaacttgccaacacagtgaaattcattttactggcaactaaccttccaatctctctctaaaataatgttcacatgggaactgaagcacattaaaaaaataataattattcacttcacattttctccaagccatttcaaaagtgtttctcagactttcaaaatcaaacaggattcccagaccaggcaccatgggtcacgcctgtaatcacagcactttaggaggccaaggcagctggattgcttgagctcaggagttcaagaccagcctgggcaacatgatgaaaccccatctctacaaaatacacaaaaattagacgggcatgatgttgcatgactatagtcccagctactcgagaggctgaggcacaagactcacttgaacccaggaggcggagtttgcagtgagctgagatcacgccactgcactctaccctgggtgacagagcaagactctatctcaaaaaaaaaaaaaaaaaaaaaatcaaatggggttcctctaacgataccctgctttattcaggaaacgtgatcctcaggaaaccatgtgtaaattatacttctagaactcaatcttacgtatttatatttaaaggaagtaaagaatcttttatgaagttacaaatctcacacacgccctgcaatttagtggctctataaatcggagcttccctatgctaaatgtgtctaaatgagagttcgtagttgaaacaagaggacaaagaaaaaaacacttttcaaattaagaatgagcactatgtcccaatcacgtgagaatctcagctatacttagacaatggtggagattttaagcatatctatctcaaactttatattttaccaatatgaaaaaagcagaaccagagagattaaattatttgcccaaaagtgcttgttagtggaggaaatgtattaagaccaaaagctaatttacaaaaacaaattaaattttcaaataagatcatgctataaaagtgcttccctttcagaaaccaccctcaccacacccagtttttaggcagctcattcacacacacaaaaatcacattaatgaacatcagaagcagtggcctttccttatgggaaaaagaactcatttatgaagttccagaatgcgatgcaatccacactttaaatagtaacacaatagggtacgaactaactgaatcaacatgcaataaacactttcacttaaagtgtcatagccttaatggtatattgcatttaatatccatacacaaggaaataaatcacacgcatgtggggtttcttcctttctccaggctagagtgttagaaaatgtagttaatatttcccaaacaactcaaacacgaaaataaatgattcaaaagctgctttttccccgctttggaagggggaaaaaaaaaagaacagattttaatagcattacataaaaatcctggaaattatgcacaaagactaccctggagctttgccagaaacaggcatgctggttttccatgtgtataaatggtaatcaaataagaattaccaggagctacaatattattaagataaatatacttcttgaaatctccatcttacaaagcttaaaaacaattgccagaactaggccgttcaaccccacatttcctgggcctcccctaagcactcagtcctctgtgtttctgccctgcgccccacgccctcagcgcagcacctcggagcccacagtcccaagctgtccacactctggcgcccctgggcccattcacattcccaggcaccatgcgctggtcagccctctcggccaccacctttgctagagcctatcaagaccctccggagcctctatttaatgaaccactcagtcattccagcaaagcggttactgcctttcctctacctggaggcttgttctgtgtagatgtttggggtgtggtttcacacataacagggtactcacatgtggagttacatatatatatatatatatatatatatatatatatacacacacacacactatatatatgtataaatacatatgtacatatatatatatatatatatatatattttttttttttttttttaagacagagtcttgctctgtcatccaggctggagtgcaggggcgcaatctcagcaacctccatctcctgggttcaagagattctcctgcctcagcttcccgagtagctgggattacaggtgcccaccaccatgcccagctgatttttgtatttttaatagagatggcatttctccacgttggccaggctgttcttgaactcctgacctcagctgatctgcctgccttggcctcccaaagtgctgggattacaggcatgagccaccataccaggcttatatttacttatttattcattcatttatcagcaaatattatcacacatatattatatgcctggctatattcccagcgctaggaacacagcaggaagtaaaacatggaaaattcctgctcttaagatgcattccagtggcgtggaaacagattataaacaaaattaagtcaaatacatatgatgcaagctggaaaagagagtggctggcccatagctccaggaggcactgttgaaagcaaggctcctactaagggaattcctggagttgggccttctggaatgttccacagcggtcctgagggatggggtttgctgggctgggggaggactcctcagtctgcaaacatgtcatctacgttttggtttgggattttttgttttgttttgtttttgtttttggtttttttttttgagacagaatctcactctgtcacccaggctggaatgtagtggtgcaatctcagcaacctctgcctcccgggttcaagtgattctcctgtctcaatttcccgagtagctgggactacaggtgcacgccaccaagcccggctaatttttgtatttttagtagagatggggtttcaccatgttggccaggttggtctcaaactcccgacctcaggtgatccgcccgcctcggccttccaaagtgctgggattacaggcatgagccactgtgtctggcctgtaatattcattcatttattcattcattcattcagccaatattatcaggcatgtattatatgcctggctatattcccagcactaggaacacagcaggaagtaaaacatggaaaattcctgctcttaagatacattccagtggcgtggaaacagattataaacaaaataagtcaaatacatatgatgcaagatggaaaagagagtggccggcccatcgttccaggaggcactgttgagagcaaggctcctactaagggatttcctagagttgggccttctagaacattccgcagctgtcctgggggatggagtttgctgcaggactcctcagtctgcaaacaggtcatctacattttggtttgggatttttttttattgttttggttttgttttgttttgctttgttttgtttttggagacagagttctcaccgtgtcacccaggctggagtgcagtggtgtgatctcagctcactgcaacctctgcctcccaggttgaaacaattctcctgcctcagtttcccgagtagctgggattacaggtgtgcgccacgacacccggctaatttttgtatttccagtacagacagggtttccccatgttggccaggctggtctcaaactcctgacctcaagtgatccacccgcctcagcttcccaaagtgctgggattacagacgtgaaccaccacgcccggcctttttattgtttttttatcacgatttacctacattcacagacacctgcccctcaacaggcattagtgggaagatacagaaagaaattctacattgctctcaattgtaggaatgcaaattaaagcttccaaggaactcgaagatgcacaaaccgtttcttgggtggcattatttcctcatagaaacatgcatatactattcattttcttttcaaaaaagatgagggtaaactttagctcagtctctctgaataaacatatcagacaaacagaattaatgagattttaatacctataatttctcaactctttaaaaaggttactaaaagggtatgaaagttatcaaagaccactggggttgcatgaagaggactcagcagccaacttaaaggggctcccatgggccccaaatgggacaatctgagcatcaaaaatcatgtatctgtaatggaatgaaatacatcaaataagctaaaatccaagagtttatattgattcttgaaaaaaatcacctttggaggacgttaagaaaccatctcagctgggtgccttggctcacgcctgtaatcccaacacttcgggaggccaaggcaggaggatggcttgagcccaggagtttgagaccagcctaggcaacatggcaagaccctgtctctctcaaaaatttgaaaaaatcagctgggcgtggtggtgcacatgtgcagtcacagggaggctgaggtacgaggagcacttgaccctgggaggttgatatagtttagctctgtgtccccacccaaatctcatcttgaattgtaatccccatgtgtcgagggagggacctggtgggaggggactagatcatgggggtggtttcccccatgctgttctcgtgagagtgagggagttctcacgagacctgatggtttaaaagtggcagttcccccttcgcatgctctctctctcactctctctctctcctgacaccatttaagatgcgccttgtttctccttcatcttctgccatgattgtaagtttcctgacgcctccccagccatgcagaactgtgccaattaaacctgctttctttataaattactcagtctcaggtagcatcttttttgtttgtttgtttctgagatggggtctcactctgttgcccaggctggagtacagtggcgcgatctgggctcactgcaacctccaccttctaggttccagcgattctcctgcctcagcctcccaagtagctgaaattagaggcgtatgccaccacgcctggctaattttttgtatttttagtagacacggggttttgccatgtcggacaggctggtctcgaactcctgagctcaagtgatccgcccgcctcagcctccgaaagtgctgggattacaggcgtgagccatgcacctggcctcaggtagcaactttatagcagtgttagaatggtctgatacaggtggaagctacagtgagccgagattatgccactgcactccaacctgggcaaaggagtgagactcttgtctcaaaaaaaaaaaaaaagaaaagaaaaaaacaaactcagtctgtaaatggtatagaaagggaaagaaccaagcaaataaaagcatctaaacacacacggctcccaggatcctaggatttcacagtggctgagacagcaggatacgtgagggcagggtacatgacagcagggtaaatgcagagagctaaagacaggtatcgttgttttggctgttgctgccactgctaagaaaattattccaactttcagtaacactagctcttctctactgacaggtattatgtgccaagaacttttctaagaacttgtattttctcatttaatcctcgcagcaattctgtgagatgggtactagtgttttctaatacagcctttgggtttaaatactggctccaccatttagtatccctttctggctgtgtgatcatcacaagttacctaacctctctgtgcttcagtcttctcatctataaaatagagatcatctcaaccctatctgtaatacagtcaggaagtctagtacaatatttgttcaggtgatttttttttttttttttgagacagagtcttgctctgtcacccaggctgagtacagtggtgcaatcacagctcactgcagcctcgaccacctgggctcaaacgatcctcccatctcagtctgccaagtagcttggaatacaggcacatgccaccatgcacggctaattatttattatttttagagacagggtctcactatgttgcccagactggtctcgagctcctggactcaagcgatcctcctaccttggccttccaaagtgctgggattatagacatgaccactgcacctggcctgtacagattatttgatcactgtctacttccctttctaggcgtcatgccccaagagggcaggggccacccctctatctccagaacctagtcctcgccttgccaatggtaggaacccattcaatatttaatgaataaacaaatgagtttacagtaggatacagtacagttgaaaaaaaccactctagttcaaaccacggccaatagctggagttgcacagctgaagatctgcttataattcctcaaccatcgaggggcccatcatcttaagaacctccaggctctggggaactgaagcagcctaggaacgagcctgctgaacccccgagggttttcagtaaagaggctgccaagttcggcagctagagtttaaccagggcgagctatcagtattttgtattttggacacttgccctttttattacgagaaactgacacaatcacagtccctagtgtgttctaggtttcggtactgaacgacacaagatgtgcgccagattgagcgcaggaagaaagaaacaccctttagtgcaatacgaaatgtgactcagccagcggggagcgttagttattgatggaatggctgtccaccatcgagtcactatgcaaataagtgcttttcttgcattatcccagttgattctcccaacgaccctctgacagagacaccatcattcctataaattgcagcgcccctaggtagcttgcccaaagtcccacagttaggaaaccatacaaccgagaattaagcccgaatgtatcagaaatcaaaatccaagcacccaaccattcaagggtgagcccttccaaaaaaaatttacagaaacaaagttgatggttgtttctttgtttgtttgtttgtttttgagatggagtttcgctcttgttgcccaggctagagagcagtggcatgatctcagctcaccgcaacctccgcctcctggattcaagcaattctcctacctcagccgcccgagtagctgggaccacaggcatgtgccaccatgcctggctaattttgtgtttttagtagagacggggtttctccatgttggtcaggctggtctcgaactcccgacctcaggtgatccgcccgcctcggcctcccaaagtactgggattacaggcgtgactcactgcgcccagccatgtgtttgttttttgaggcagagtctcgctctgtcgcccaggctggaatgcagtggtgccatctcggctcactgcagcctccgcctcccaggttcaagtgattctcctgcctcaacctcctgagtagctgggattacaggtgcccaccaccacgcctggctaattatagtatttttaggagagacggagcttcaccgtgttggccaggctggtctccaactcttgacctcaggtgatccacccacctcggcctcccaaagcgctggtattacaggcacgagccatggccagctcgaagttgatggtctttatcacacactttgaacatgagcaacaaagatttaccagaatcacaaaagatttttaaggattttgtaagaaaaggtcaatgtatgaactaaggtcacttgctatttccacaggcaatatgtaatgggtgtgacaactccaattggcgttgtttcacacacatgagaatgcgtgtttgggtggcacatacaaaaccctcagtcttcccatcttgcagcccagctagcgaagcagtactcaaagtgtgatccgcagatccctagaggtccttgaggcctttgcaaggcatctgtggagtctaaactatttgcacaatgacactaagacagcatttgccttcttcagtgttgacacttgcagtgacagtgcagaagaagccatgggtgaaactgctagtgcctgagcaggtcccgatgcagggaaaccaaactgcactagccctcagcttgtccttcactaccccacacttacgaaaggaaaggcagacagcttcacttaagaatgtccctgatgggccgggcatagtggctcacgcctgtaatcccagcattttgtgaggccgaggtagggagatcacctgaggtcaggagttcaagaccagcctggccaatatggcgaaaccccgtctctaccataaagacaaaaattagccgggcgtggtggcacacatctgtaaatcccagctacttgggaggctgaggcaggagaatcacttgaacccaggaggcggaggttgcagtgagccaagatcacaccactgcactccagcccgggcgacagagcgagactctgtcacaaaaacagaaaaaagaaaaaaaagaatgtcccagatgaagctgtcaacatgaatgattggttaaatcgcaagcttgagtaggtgtcttctgaatagtctgagtgatgaaatgagaagcacgcctacgacgacgctgctgcccatcaaagcacagcggtcctggagaaaagcagctgtgcagctgtttggattgcaagctgaactggccacctttttggtagcacattatttacacgtgacctacagacaaaccacggtcgttcaggcttgagtacgggcagaccattcctgggaatatgaatgagtctgtcgcttcaaggaaaataactgacagtatttgccgccaatgataaaaaattccagttttcaagtagagttttggaaaacttacatcagccactgtgatgaactcaacatcttcagactattagactttactgacgtcaacatgtggaagagctgcatcattcaagagaccaatattttccaaatgactagtgcatgacgttataaaatcacacctgggtaaaaacccaacagcatttaatataatagtgtacaaaaaaagataataaaatttcagattccatattgcaactaacatttaagaaactaccactcaaaataaaaaatcagcggggtgtggtggtgcatgcctgtagtcccagctacttggtaggccaaggcagaaggatcacttgagcccaggaggtcaaggctggagtgagctatggtagcaccactgcactccagcctgggtgacagagtaggaccccatctcagaaaaagaaaaagaaactactactcacttgttgaatgtttctacagaatcaaagaaaaatatccagaatcacataaaaaggctatgaaaatgctcttccaactaaagccagattttctacacatttttcaacatattgcaacaaattgaatgccaaagcggttaagaaaattcagcgaacacacttaaaagtgttttaacacggtagatttctgttgtgtacattttatcactcaaaaaacctcagccgtgggtcgggcgcagtggctaacatgctgaaaccctgtttctactaaaaatacaaaaaattagccgggtgtggtggtgcgtgcctgtaatcccagctactcgagaggctgaggcaggagaatcgcttgaacccaggaggcagaggttgcagtaagccgagatcgtgccactgcactccaatgtgggcaacaagagggaaaaaaatccaccaaaaaaaaaacaaaaaacttcaaccgtttattaatccagacattaaagagatttgcaaaaatgtatggcagtgccacccttctcatcaaattttttcattttacaaaatatagttacttttataaaaatgttacttacattaacatgcaatgggtgaaatgaattactattttgaaataaatttagaaaagatttttaagcttctcagtttgtttcaatttctaatactgtaaatatcaatagacaacctatataaataatgcacataagcctgggaaacatagggagacgtcatctctacaaataatttttaaaattaggccgggcatggtggctcacacctataatcccagcactttgagaggctgaggcgggcagatcacttgaggccaagattttgacaccagcctggccaacatggtcaaacaccatttctactaaaaatacaaaaaaaaaaaaattggccgggcatggtggcatgcatctgtaatcccagccacacgggagactgagacacgagaattccttgcacccaggaggcagaggttgcagtaagttaagatcacaccactgctctccagcctgggcaagagtgagactccgtctcaaaaaaaaaaaaaaaaaaaaattagttggatgtggtggcatgcgcctgtgtcctagctactgaagaggctgacatggaaggatcatctgagtgcaggaggtcgaggctgcagtgaactgtgactgcacactgtactccagcctgggcaacagaggaagaccctgtctcaaaaagaaaagaaaaaaaacctacagaaacaacaatttctactggattagaggaaggcatataagctaggtgcagctatccctgactgtcggggcccagcatttcaccctgtttcccagcttctgccctctaggtcacactactgccaccactactgctacaactcattctgcctccactgccaccagcagcctctagcgggtttgatgttcccacctatcccagaacattgagccttcccacttaactccgcagaaaggatgccaggaattttttacaagtgcaatgctagcaaaggctggggaaaatgagacaaaaaacctgatttccaagagcagacaagttttacaaggggcagtcttcttcgctgaagttgactaaaatttagccacgggttggcttggctggtgtggttcactgggtacatccacaagactacaagaatatcactgctgtctgcagtcttcccaggggaggaccaccctacccttggcccacaccacggatggcggccccacatccaccctctgatgcagcccagtcccttcccttctgttccgcggcagcaccggtgcctggccacttcccttgccagttcccttcctgtttcaaaaactctcatctcttcacaaaattccctccagggatgctagttcctgttggaaaaggtcttgaggtgtgtcacaggcaaagtacaaatgatatgcccagggccagatggatgacaggcccctaagctcagctagtccagagtcaggaggggacctgcagaattctaatggtgaatgattacactcttacagttttggaattccagcaaaaacaccaatactaaaatcaccaaccaagacaaagacgagacttacggcccacgcaggcttctgcacactctgtgcccagacatggacagattaatgtgggttggttggttggtttttttccaagattactattccacagcaaagtacataggcaacgctgaccaatatgcagaaacataattactatctcaccaagctggccagaagacaaaaatcttgaaacttcttgacttgctctaattgttccttctccatgtttcccttccttaggcattctacctgaaaagacagccctcccttccttcttcatcccattggcaattcagcaaaccttaaccttctcttgctttaccagaggttacttctactcgaaagcttgtcttcagaattaacagctgtgtccttgtcactgtaagccaggtctcaaagagcctgaacaaatggtcactgggggcagcttgagtgtcgactctactgctgttttctgtctcccaccccagctgtggaggggaactgtgtgcctcatctcatctctgccatttgctatctgagaggctgtatttccacgtgcataacagatcctgctcaagaatgcaggtcaaggctgggcgtggtggctcacgcctgtaatcccagccctttgggaggctgaggctggtggatcacctgaggtcaggagttcaagaccggcctggcctacatggtgaaaccccatctctactaaaaatacaaaaattagccgggcgtggtggcgcacacctgtaatcccagctatttgggaggctgaggcaggagaaccgcttgaacctgggaggcagaggttgcagtaagctgagatcacgccatggcattccagcctgggtgacacagccagactctgtctcaaaaaaaaaaaaaaaaaaaaaaaaaaaagaatgcagtgcaggtcaacacagaatttccaagcaaggagactgagctctgctaacgggttagcatcccagtggcaagggttgcaggcttaggtggggacaagctaacgggggaaggaaggggaacacctgagcatgcaactgaaccccaaaccaacacctggctagggttctgtcagctggcaggcccgtgctcagggttaatggggcgcccagatttccggcatgagacaggtgtttgtttgcagaggctaacgcatacagaatgcctccgtccactgtcggtctgtcggcccaccagacagggtctacataggaactcctctaaggcaaaggtctcgatcacagaggtggccaacaggtgacaatctgcccaaatgcataccagcgggtctcctccccaagttgctccacaagcataaagtttggctggggaaaaaagcttttttaatttctgcatctgacaatgtgatcactccctggtattcccctcttcagagatatgaccatgggtgtggatgagagcggaggagcatcttcattctgtcttcctaatatttacacgggaaaagaagatgcctgtagatattttctaacagtttcattttctgtctttgtgaccctgtatctatgacaggaaaagccaacagctcgagataacacgtctcaccattttttgcttgtggcccaaggcagaatacaacagccacggttccctcaggcctagcggtttcatcccaaatgctgtggaaggtccctcaccttaatcagaccgtttcttcattttttttttttttttttttttttttttttggcgacaaagtctcgccctatcgcccaggctggagtgcaatggcacgatctcggctcactgcaaactccacctcctgggttcgaacgattctcctgcctcagcttcccaagtggctgggactaaaggcgcctgcgaccacacccagccaatttttgcattttcagtagagacagggtttcaccatgttggtcaggctggtctcaaactcctgacctcctgatctgcccacctcggtctcccaaagtgctgggattacaggcatgagccaccacgcccggcccatttctccatatctttaataactgtccctcacacttttttttttttttttgagacagggtctcattcttgtcgcccaggctggagtgcaatggtgcaatcttggctcactgcaacctccgtctcccaggttcaagcaattctcctgcctcagcatcccgagtagctgggattacaggtacctgccaccacacctggttaatttttgtatttttagtaaatatggggtttcaccacgttggccaggctggtctcaaactcctgacctcaggtgatccgcctacctcggcctcccaaagtgttgagattacaggcatgagccaccatgcctggcccctcactttttagattatttccaaaatcctagcagtatgctaaaaattcctgcaaccttctcccagtgactggccaccctagataagatttctcacactcgtacaccccatctgctgtatccccttcctgctttatgtttgttcacaaaacactttttctattttacttatttatggtttgactcccctgttgtcccctctattagatctcccctatttgaaggcctggtttttgtttcttagagacagggtctcactctgtcgcccaggctggaatgcagtggtgcaatcacggctctctgcaacctcgacctcgtgggctccagcgatcctcctatattattgacttaaaaattcttgtcccctattacaagagcaggaattgttgtctgttttgtttacggctgtattgccagaacccagaaccgtgcctggcacggagtaaatgatttgctgaatgagtaagcaagccaggggttccgggcctctgtactctgcaagtccatcctgcattctccattcataccatagcaacttcaaaggcccctcacccattcctgactccacattgtcgccaagtcacttccagaaacttaaaatgccatttcccattcacatggtcaagcccttcccctcctgccagtcgtttgtttaaatctggcttgcagtcccatcaagctgctcttcctaatgccactcagatcccatcacctccatcactgctactgtaactttggattgggccaccatcacccctacctgggatttactcgacacctcattaatctctttccaacccacactcactagctctgaaagagtgaactttctaaaactgcaagtcagatcacctaagccccctgttgagtggttccctgacacctatggggtcaaatgcaaactccttcccacgctacccatggccttccttgtcctgatgaacaactaacaatcgtccgcccccacagagaagcacagggcccagccatacccacctctccgctctgccctggtgctcttctgtccacctggagagccacagcctgatctcaggacccagctccagcaggagccccctctaaagcgctccccactcccgaacatactccacaacatttttaactgtgagctcacggaggttgggaactattaacgcaggtcagacgcgccccaaagtggggccgagcccaagagggttcttggctttgcccaggaaataattcaagggtgagccggtggcaggaaagaaaacacctttattgaagaggcaggcagtgttatacggctccatgactgctcctgcagagctgggctttcccaaaggcggaaagtagcagctcagggcagttttgcaatcatacttatacctacttttttttttttttttttttttttttgagacgcagtctcgcctaggctgtcgcccaggctggagtgcagtggacatgatcacagctcactgcaacctccacctcctgggttcaagcgattcttctgcctcagcctcccgagcacctgggattacaggcgcacaccaccacaccaggctaatttttgtatttttagtagagacggggtttcactatattggccacactggtctccaactcatgaccacaggtgatccacccgccttggcctcccaaagtgctgggattacaggcatgagccactgcgcccagccttaccttatacctacttttaatttcctgtagagtaaaggtaggcttaggcagacacttctaggaaaagggtggtggcttttgggttgtcaggtcacggccatggaaagaggcagtaactccgggtgtggccatggcgacagtaaactaacaaggcacactggtgggcgtgccttgcagaacgctgcttctgccccatccctgtatcagctagtcctcaattcggtctggcatctgaaccccgcctctggagtcgagtcccacctcctacctcacgatcacggatcctgctccacgatcacggatcctgctccacatccacagtgccaggtgcacagtcagtgccaggggcacgacacagatttcagagtgaaggaatgtgcagaaatcatgaaactacccttctgcaaagcctgttcggataaatttgaatgagaggagcttccttctgtgctcccaggctagttctagaagccccttctcattctatggatgcccattcctgcagggccgctactggctgctttttaaccctgggatcagaaaagggggtaagagggaaaggctaatacacccagtattggggttttttttgtttttgttgttgttgttttttaagacagagttgctctgtcgcccaggctggtgtgcagtggcgcagcctcggctcactacaaccttctcttcccgggttcaaacaattctcctgcctcagcctcccgtaatacccaatattgtatagagaaaacatctgccaccagcccaaaggcagaggctaaaatcgatcttacatgtagataagcttaactatgtgtgtgaaagggtcttctacaaactgtgctgtcatctcaatttagctttgtaaggacagtttccaaaagggccaggaagttgtgtagacatactctattcctggagtcctatccacaaaggtttgtaaaatgagctcaagaaaacaaaatcgtggtctcagagaaagagctaaaggaaagaatatcacttttaaaaaatcagcagctaagctaagccttctatcttccctactccctacagtactaaaacttttataaatatacaatgtacacaaatgtcaagaaaagttaatttaccaaatttacactatttgaggtttaaaaaaaaaaaaacacaaactcactctagcattttttttttttggctctgtgtctgagacccctgatctacaaacttaaaaataaaactactcataaattcacaaaataggtattcaatgacttggcaatttccaaacatatttaataattacaccctcttcatttttgaaattcgagtaatacagcatacaaagtacagcttacaaaacgttctcattgtcctctgggccaacatatttaatttaacgtactgccgcccagctccaccgtcccacagtctccaaggacagagctcacaacacctgggccctaaaaatgccaaggtggcaagcagggggttacacccacagccccgtccactgacaccttcagactcaagagcgagtgccaccgccctaaacggaaagacactcatcacggcagcatctttcaagtgaacagaaagtgtagtttctgaccttgttaacatagtccttaaagtgctctaggttaggggaattctcgggtgaaaatagttttcgtctacatccataaaatcttcaacagcaaagttagtaaaataaagaaaaatcagaagaaagatgatgttcccttgccagagaacaaatacataaaagatacaggagctcagatcacaagccagagaaagagaatgccaactggacacataggatgatctcacaccaacgacctatgcaggccctacctcaaccactggacgtctctgactgacactattacttctgccgtctctgattgaaactattacttctgccatctctgattggaactattaattacttcttccgaggattccctttcctgaggcttttaactgtttaagtatgcagtgtgtggggaccacaaaatacaatacagcttcacaaaagcaggcttttaaaaaaaatcagtgttattttctctacatacttccacaacagatgttcccctcaatcctgaagattttagtaaaacataaggactgtttaaaaaggaggaagtgggggaagaaatgtagcagattacttaaaatctttctttttcgtcctacttattttaatatcattttccagatctcaaagacttttgtcctatattagaaaaaacaagcagcccagtaaaaacatcaagaatagcagtaaggagcttcaaaccagggaccaggcaccagatccaaacctgagaggatgagggaggggaataccagctctccggcaggtacgtttctcccttccaaatcacctggtggctggagaagctcaatatgaagctcttcacttaaggcaaatactatgataataaaatatccttaaacaaatgatggctgaaagctgaaaatgcaaactttttttaaaaaaaaaaaaagacctagataaaagacagtgtgtactcagaggtaagtaactccgtctaattctccagagacctgcaggactgcgccgacttcctatccctattttgaggataagcaaagtgaggcctagagaggagaaagattttattctccacgttttcgcaaaaagggcagagagaaacatttggatgggacttcagggtgaccaaatgaatgcaaaggcaatttccttaagtgctaaacagtgctgaatgctgaagggctccatacccttacattcaccggacgtgcccccacatttcagccaaccagtggttatgcacgttcaaagttctccttccttctaaaggtcgcgtctaggtcatctctgcacagcgtccctttctgcagtgtgaacagatctgtgatatttgacccgctgaaagaaaagtcacactgaccctgagatccccccatggtaaggcattctgagatacctgagctgtctgcagacactgaggctggaagcttttttttttaatttaatacaatcaggatcagggaggggggatgccgaggtaaagcagtgcacatacctttcaactggtcagcaaccacgctctggcccagccgttcaataactttcccatcttccatttcgtaccggtcatctaagtattttgcggtggcctcagaaatgtgaactttgccggccactcccagctgctccatgagattggccaggttcacatcgttggaccacacgtcaaatttaaacctcctcatgcccaggatgccgcaaaggacggtgcccgtgtgcaccccgactctcatgttcaccatctccttcttctcctggcagaactgctcgatggccttgatcatgcccaggcccatctcgatgcagcagtaggcatggtcggcccggggctcgggacagcccgccacgcagtagtaacagtctcccagggtgctgattttctcacacttggtctcctcacacaggcggtcgaagcgaccgaacagatcgttcaggagacccaccagggcgtgggcagacttgttggcactcatcttggtgaagcccacgatatctgcaaataaaatactgacttcttcgatctgctgcatcttaaaagggcggaaggctataggagctttttggatggaagactttttcttcctgttcttggggctcgaggtggcatgcctcttgacagaattctcactctcctcatctccctgcttcattaagtcatcggctatgattcttggcatcacggaatgaatcatcctctctttgagggctttttccacttccaggtccttcccgtgcataatggattgccccaccttgaggaaggtgctcctggacctcacctgggacatgacgaacaggtggaccccgatggcgtggatgcagccgtggagcagccccctgctcagcagctcccagtgcagggccccggctccgggcgaggggaagcaggcttcatcccggaaatggtagccaaaggtctcgaaaaggacagagtaggccacccccagacacaaactcaggtacaaaggtaagtgcatgacggtatagagcaaaaagagcacttcgatgcacatggagaagctccccacttgagataagcaagtatctgtgggccgggctgtggccgtaaggttggagctgtcgccgcgtcctgagacaggcgtcaagacctggaactgcgcagccagggtcagggcgaacaccagcagggtgagagccagcgaggtccacgcgtaatgccgggcgtacagcttggtgaaggtaaacagaaagaagcccacacacaccaggaggaagcacagcgcgggggcgaccatgacgatcagtctggatctcatgtggaccgcaaaatagatgctccacagaaggcaggcgaagccgatgtagaagagcgcataccggaaccggcgctgggtctgcgggaagcagcgctccaggcaggcctcctccaggttcaccgagtcgaacttggggtcccaccagcggctggaggccctctcgaacagctggggcagcttcttctgcctgcgcagccggcctccgccgcccactcgccgggggacgcccccggagtccccagagctgctgcagctagaggagatgctgtatttgcagtgcttggggtggctgttggaggacagctgcttggggttgatcttgacgcgcacgctgttgctgtccccgctggagtcgcagctcacctcggtgctgtggtgatgcagcagctgctggtggggtggggaagccatgttgtcgagtcccggggcctgccccggccggggtcaccagtacctgccagcaaaacggggagagttagcggcgctcccacctaggcatgcacgcctagaggcccgggacctgctcctgtcctaaggggcggctccagcacgcgacctggacaggcaccatctgttcctgtggttcccggctcagcggtgctcccaccgcccccaccgcccccaccttcgaggcgcacgagaaccgctcgggacggacctagaacgcccgggggtccccgccgcgtggccgccgtggctccgggaccgctttgctcgctcgccttccgcgcctctcgccccgagggtggcctccgcgccgcgcggcttctcctcctcgcgcgctcgcctcctccagctgcggctccggagggaagttcagaccttgagcgctcccagccccgcgagccgcctgcgcacaaacaactccgctggcggcgcggagccctccatcctgcaggagccgcgctccgatgcgtcaaaggcggcgcgcggccggccccgggcccggaccccgacccggagcagcgagcttcggcgggcgcccccggctcgcgctccccggccgccccccgcgctccgggccggccctgcccgcggcggcgggcgctgggggtgggggcgccccgggctgcgagtgcgcggagcccgtcggcgcggcccgtctagtggggcctgcttccccccgagtgcgccgccgctcccgccgcggccgcagctgtcccgggaccgagcgcgtggaaccacggacgcgggcccctcgccgggcggcggtgcagacgctgccgcagagccgggctcccgcgacgccggccgggacgcccgcccgcccgcgcccacgccgggggccgcctccccgagctagagatgcggccgccgccgcgcccgccgccgtgtcccccgcggccgctgcctcatgtcggaagagctgccgccgccaccatctccggcccctgccccgcccgctgtcactgacagacgcgcgcccgcgccgcccctcgcccagccgcagcgcgcacgcgcggcccgcgctcgccgccaccgcctcctggccccggacacgcgcacgggccgcgcgccgccccgccttggtgcgcgcgctgggctggggctgcggggcggggcggggcggggcggggcgcgcgctcggctccgccccccgccccgggcggcgccgcttctaggcggcgggctgtggccgctgtccgcgctccgggcgctgtgggcccgccctccctcggcgtcccagaggccgcgcgccgcccggggtcccgaccctgcggagagacctgaaggcgcctgccgtggaagaagccgctggccgcaacgtttgggaaatcaaaatgttgccttcccactcggcacgcctttgggataaatcgaagtttccaaccgttggatttccctcccgggaggctccccttgctctgtaagcaatgaatgcgggccccggggcactcggcctgccctggacctgctcacggggcgaccttcacgggcctagcctccaaagctgggcccaccgacgaccacgttcccccgccccaggggtagtttaccttgctgtccttgagcccttctccccctcctcatgaactactgcttttccttttacacaaatgagactttcaaaggagtccgcgtcccataatggcagttgtgcattggcctccataaacattgccacgtgtaaataaaatcctattctctctagcatgcagatcccgaccccttctccccacactccacagtgcctcctgccagtcacggggctctcttccatcccctccctcgcctcccaggcccagcgccggggcccacaccaggtctcactgttgaattagaaaataaaagtaaaatgtgatctgtccatgcaatggaatattattcggctacaaaaaggaatggagcaccgatgcatgctgcagtgtggaggaacccgggaaacgttatgctagtgaaagaagccaaacaaaaaaggccacatagcgtatgattccatccagatgaaatgtctcgaattggcaaatccgtagaggcgacacagattggaggttgccaggtgctaggggaggaagataagcagcttggggtttcgttttaggatgatgaaaaagtctagaaatgatccaacaggatgaatctacatactgcccttgaatcatacactttaaagtggtttaggccgggagcggtggctcacgcctgtaatcccagcactttgggaggccgaggtgggcggatcacctgaggtcgggagttcgagaccagcctgaccaacacggagaaaccccatctctactaaaaatacaaaaattagccggacgtggtggcacatgcctgtaatcccagctactcgagaggccgaggcaggagaattgcttgaacccgggaggcggaggttgtggtgagctgagttcgcaccattacactccagcctgggcaacaagagtgaaactccatctcaaaaaataataataaaataaaataaagtggtttaaatggtaaatgttatgttgagtgtattttaccacaataaaggaggaaaaaactaaaagcaacatattgtggtggtattcctgcagaagtgtgtaatctcaatccaatcgcaagaaaacaccagacaaacccagattgagacctgttctacaaagtgattaaccagtacccatcaaaagtgtccttggacactttgggtcttgaaagacaaagactgagaaactgtcacaatctaggaatcgtccctaaggggatagatacaacaactaaatggaacatgggatgctggttgggaacatggaacaggaaaggacagtagcaggagagcgggcaaaattcacataagatctgcaatttcctggttctgatcctcttactatggttaggtaagacgttaacatttttaggggaagctgggccctgtgcagtggctcacacctgtaatcccagcactttgggaggctgaggcagacagaccacctgaggttaggagttcaagaccagcctggccagcatggtgaaacccccgtctctactaaaaatacagaaattagttgggcatggtggtgtgcgcctgtaatcccagctactcaggaggctgaggcacaagaatcacttgaatccaggagacggagtttgcagtgaaccgagatcatgccactgcactccagcctgggcaacagagcaggactccatcttgggggaaaaaaaattaggggaagctggatgtaggatacagggaaactcgctagtatttctgcaactcttcaagtctaaaactatttcaaaataagtttatctaaaaatttaaaaaataaacctttaatgaacatcaattctatgccaggcactctcacatacgaggttcagaaacgcatggtgtgtcacatgcattcgcttagtaaatgggataacaatagtgaactaacattgaccgaacacgtcataaatgccagaaactactggacattttcacctgtgacacatttggtcattgccacaaccctctgaggtagatactattgtcccttgtttagagaggtgaaacccaggattgaagagaaacgcaccctaggtctcccactaagggtgatgagttcagatggaaaaccaggtctcagaattctgaggccatgacgccttgtgtgaccctggcactaccctctgcaagcctcacgatggcccagcacagactgtacctgtctcatccatcagcccaactggatgggaggccctcagagccaggactcacagcttccgtcttcccttgctggctgcaacgctgtgctccctgcttcctggtttcctgaaacgatctgaaagcttgcctgtctgcacttctttcctcctccctaaatcatttgtggtaacttatgtgtttgtaagttagtcacgtcggatttttagacacaagtaatggtcatactcacctccctacttctctggaagcaattcggccacattgcctgctgtggaaacctataagctgacaagcctccccagtctccaggtcagggagtgaatcatgccatcaaccccgggggactggggctgtggtgccagcactgtgtgtcaggccctggaggtacaaggatatgccatccatatcttttcttttcttttctttttttttttttttgagacggagtctcgctttgtcacccagactagagtgcaatggtgcgatctcggatcactgcaacctttgcctcccggggttcaagcaattctcctacctcagcctccagtggagctgggattaccaccatgcccagctgatttttgtatttttagtagagacagggtttcaccatattggccaggctggtctcgaactcctgacctcatgattcacatgccttggcctcccaaaagtgctgggattacaggcgtgagccaccgtgcccagccgccatctgtttctttaaggggcttaggaacgatgtccaggggaggggttgggttaagaagatgggatcaattaggctttctgaaggattggatgtgaaggagagttctataaaggaggttaaccatcttctcataatgccaagacccaaagggaagtcactggagggttctgggttcttcttgacctcccagaagcataaaggtacccgattcacagaagatacggggcagatgcaatagctttcttcaaacatccaatccagggtgctgccaaatccacagagagtttcttttttccatctgtgatgtgtacagaactcccacctggacacagtgggaatcagaatgtgtccatgaaaactctgcaaaagcttgcagaatgccttgcctgcctcagtgtctcctcctcaccctccctcacatgcaaattcacatgatgggtgaggaccttggctccaggatatcagaggtcagactgggtggcaaccatgacaggctttgagataagttgcataatgattgagttgtagccattctcatcacaccggcccctgaggactcggcagtgcctacgtgatttcatttgtcaggtggaccacaatcttggagaaccatctgctggaagatgggattccctgctatggcctgatcatgcgtccaaaactgcagttacaagctttgagtctttttctctttcaactgatgagggtgagtttgtaggaacgtacctgcttttttttttttttttttttttttttttttgagatggagtctcactctgtcacccaggctagagtgtagtagcatgatctcagctcactgcaacttccatttcccaggttcaggcaattgtcctgcctcagcctcccaagtagctgagactatgagcatatgccaccacacccagctaatttttgtatttttagtagaggcagggtttcaccatgttggccaggctggtcttgaactcctgacctcaagtgatcctcctgcctcggcctcccaaagtgctgggattatagatgtgagccacacgcttggcctttacccacattttttctctaccattgactgctgttcacaagcctccagcagctaccttcacattgacaggaagatcaggcgtctcagcaaagcaaaagatcctttggagaagatcaccaaaatacctgcaggtgcctccataaccaggtgtattccatctagccacatccatagattctacatccagccatgcccagtttagaggccaatacaaattcattgaatgactgcatatgggagttatattaatatatttttatttttttttaatgggttcaaccaggaggcggagcttgcaatgagccgagatctcgccactgcactccagcctgggcgacagagactccacctcaaaaaaaaaaaaaaaaaaaggtttcaagaaattctcctgcctcagtctccaagtagctgggaatataggcatgcgcccacacacccagctaatttttgtatttttagtagagacaaggtttcaccatgttggccaggctggtctcaaactcctgacttcaagtgatccacctgtctccgcctcccaaagtgctgggattacaggtgtgagcacccagctggcaatcacattttaaggcaaggaggtgccgattggtggccccaacaagatgagcttggttgaaagagcagatgggagattcgaagtaaagcatggtgtctgtcactcagctttgtcacctggcacagctcctgctggagcttccatcccatctgtgtggaataatggtgaggagcccaggattgggtgtaggaaaaactctgcaggagctgtgaagtgggttgaacggagtcccctcaaaattcaggtccaccaggatcctcagaatgtggccttatttggaaatgggcttttgcacacataattagttaagaaacagttgtactggaccacgatggcctaaatctgatgactggcatcattttaagaagaggaaccgggcacagtggctcatgcctataaccccaaggctttgggaggccaagacaggaggatcacttgagcccaagagttggagaccaacccagacaacagagtgagccctgcgcttttttttttttttaatttgagatgaggccttgctctgttgcccaggctggagcgcagtggcgtgatcttggctcacggcaacgtcctcctcccaggctcaagtgatccctccacctcagcctcctgagcagctgggaccacaggcaggcaccaccatgcctggctaatttttgtatttttagagagatggcgttttgccatgtcacctaggctggtctcaaactcctggattaaagcaatccacctgccttggcctcccagagtgctggaattacaggtatgagccactgcacccagcccaaaaatgttttttaaaaattagctaggtgtggtggcacgcacctgtggtcctagctactgagaaggtccaggtgggaagatcgcttaaccccaggagttcaaggctgcagtgagttgtgattccgccactgtattccagcctgggcaccctgtctcaaaataaaaaattaaagttaaggccagcgcggtggctcacgcctgtaatcccggcactttaggaggccagggcggctggatcacgaggtcaggagatcgagaccatcctggctaacacggtgaaacccatctctactaaaaatacaaaaaaattagcagagcatggtggcaggcgcctgtagtcccagctacttaagaggctgaggcaggagaatggtgtgaacccgggaagtggtgattgcagtgagctgagatcccgccactgcactccagcctggggaacagagtgagactccgtctcaaaaaaaaaaaaaaaaattaaagttaaaaaaagaaaaagaagaggaaaagacacagagacatgcaggggaggagaagacagataagacaagacagaagacatataaagacagaggcagagataagagtgatgcagccaccagccacggaaccccaagcggtcctgggagactccagaggctgacagaggcaaggcaggatcctgccctagaaccttcaaaagaagcgtggctccacggacactttgatttcacacttctggcctctagaaccatgagaaagcgaaataagagagatggggccaggcacagtggctcacgcctgtaatcccagcactttgggaggccgaggcgggtggatcatctcaagtcaagagtctgagagcagcctggccaacatggagaaaccccatctctactaaaaagataaaaattagccaggcgtggtggtcggcacccgtaatctcagctactagggaggctgaggcaggagaatcacttgagcccgggaggcggagattgcaatgaactgagattgcactactgcactccagcctgggcaacagagcaagactctggctcaaaaaaaaaaaaaaagggagtaatggaattttcttgtctctacaagaaaatgagaagaacagcccaagaaacccagcatccaaataataaagggtttcagaaagaagagagaacacagaagggagaaactgctgagcaaccattcaagaaacgttttcctaaatgaagaatgtgattgaaaaggaccagcaagtggccaacacgatgactggaaacagacccacaccaagacacagcgcagcgcaacttcagaactacagagagctacagggagaagctccggcaagaaaaagcaggtttcaaacagagtgtggagaatgaggatgacacctagatgcaaccatctggggatggggaaggggcgcagacaggcatgtaaatctcccagggtgattctcgtaatcacgtgttgtttagaataatcaggccaggtcattttgtcggggatcccacccccgtgtcaccatctgctggtatttttccttggattaattagtcaggttttccagagaagacccttcaggcttgctgccactcagctgagaggggcagaaggctggaagtctcagccttcagtatcaaaaccttcgctcagcaaaccatccgtagggatagtttcaatcctattggcgtgctgccaacccttaccctgaagtcctatggcagtcacttgcagatggggctggatctaccatgatgaacctgaacttcctcggaagcatgcttctgtagccagcatgggagaaacttgcaggcttgttaggaagatgcgtgtttattttagccacggggtagtaccaaaataccattaacattactcaaaaataagtttgccggctgtgggcggtggctcatgcctgtaatctcagcactttgggaggccgaggagggcagatcgcctgaggtcgttagttcaagaccaacctggccaacatgatgaaacccccatgtctcctaaaaataactaaaaatacaaaaattaggggggcgtggtggtgcacacctgtaatcccagctactcaggaggctgaggcaggataattacttgaacctaggaggcgaaggctgcagtgagccgagatcacacctctgcactccagccttggtgacaaagggagaccccatctcaaaaacacataaaataagtttgtgagccagacaaatatgatcgcaatgccaatagataataattttttttcaaacagaaaaactccaggagaagccaggcatggtggctcatgcctgtaatcccaacactttgggaggccgaggcaggaggattgcttgatcccaggaattccagaccagcctgggcaacatgatgagatcctgtctctacaaaaaatttaaaaatcacctggtcatggtggcatatgcctgcagtctcagctgctcaggaggctgaggtaggaggatcgcttgagcccgggaggtagaggctacagtgagctgtgattgcatcactgcactccagcctgggtgacagagcgagaccttgtctcaaagaatacaaataaaatcaataactaataaaagtcttattgctctcggtagccataagcttacggttttctaggaatcatgttttcatttggaacagcacccacgtactctcagacacagccatgagcagctatccaggaggaggagacagtggatccgcattctgtattctctctgggtccctccccatcttggggtggtgaggcatggctcttctttggcaatttatagtgttgctgagagacacacacactgctggaataaatcactgggcgtctatgctgtgaattgagccccgaggagcgtgtggttaatggaccttacttcaacactctggtctgtctgagagaagcgttctctcttcccagcatgtagtgggttccagggaggaggtgagcaggggcaggaggtggaagctggatggcttcccagcttctccagggccaggtcttcattagtgtggcttcattattgcatgtgcagtgctttcccagaatatctgacacatccatgctcaaatgtaagtacagaaacgaatccgtaaggcaggtaggagttactaccaactttctgcaagggcaccatttgacccctttgcccttcgtaacctagggcacacatcgtctcatttggagggaacctgaaggccatcacagctggaaatgaaaccgagagtatctcacagtagccccaaatccaagcctcgttctaaatctccaaaggcctaggggatttggggccttgacgggaaaaatcaatccccctgcatcataccaccacgcccaggcactggctgcttcactgtagctcgctctggctcagttcatgggagccgtggaaggagaggtgtgggtctctgggttcccactgtgttgagacaatctattcttactccaaagagctattcaggccaaaaagagttgactagggcttgcaaggtctataacctttttctagtcaacctaatgcttttttttctgagacggagtcctactctgtcacccaggctggagtgcagtggtgtgatctcggcttgctgcaacctctgcctcccaggttcaagtgattctcctacctcagcctcccgagtagctgggattacaggtgtgcgccaccacgtctggctaatttttgtatttttagtagagatggggtttcatctctctcaaactcctgacctcaagtgatctgcccgcatcggccccccagagtgctgggattacaggcatgagccacaacgcccggccaacctaatgctttttgggccttaattccctgataaaaactggaactctacttttaggctatgtctacagtactttagagactatcaaaatagctttgtattgatgtcgaaaaaagaaagtctgagttctaggaatgacagctgagtaccacagaattcttcctagaccccattctccgccccagcccttcaagtagattaaccccatttaatgaaacaaatcctgattgtacttactatgtcaaagcaatgtggtaaattgctgaatactaaagataaatgtaaaactaacctgctttcctatgtataatattgtttagtcttaaaaaggaatggaattctgacacgctataacatggatgaacatggaggacattatgctgagtgaaagaagccagacccaaaaagacagacactatatgattcctcctatacgaggcacttagagtagtcaaattcataaagacagaaaagaaactgctggttgccaggggccaggacggggctaatggggagttatttaactgataaagagtttcaggtttgtaagatgataacagttctggagacagatggtggtaatcactacacaacaatgtgaatatacttaatgccactgaactgtacacttaaaaatgtttatagacctggcagggcgcggtggctcacgcctgtaatcccagcactttgggaggccgaggcggacggatcacgaggtcaggagatggagaccatcctggctaacacggtgaaaccccgtctctactaaaaatacaaaaaaattagccgggcgttgtggcgggtgcctgtagtcccagctactcgggaggctgaggcaggagaatggcgtgaacccggaaggcagagtttgcagtgagccgcgatcgtgccactgcactccagcctgggcgacagagcgagactgtttctcaaaaaaaaaaaaagggggttatagaccagatgcagtggctcacgcctgtaatctcaacactttgggaagccaaagcggggagtatcgtttgaggccaggagttcaagaccagcctgggcaacatggtgagaccaccatctcaaaaaaatgataattttttttttttttttggagagatgggggagtctcactctgttgcccaggctggattgcagtggcacaatctcggctcagtgcaacctccacctcccgggttcaaacaatttcccgctaatttttgtatttttagtagagacagggtttcaccatgttggccaggctggtcttgaactcttgacctcaagtgatccacccgcctcagcctcccaaagtgctaggattacaggtgtgagccaccacgcctggctaaacattttttttttaattagccagatgtggtggcatgcatctgtggtcctggtgcctcaggaggctaaggcaggaggatcatttgagcctgggagtttgaggctgcagtgagctgtcatcacacctctgcaccccaacttgggtgacagagagagaccctgtcccagaaaaaatgttttaatggttatggtgatgttaagagcagaattgtgtccttccaaaatccagatgacgaagtccccaaccccggtacctcagaatatgactgcatttgcagatagggtctttgaagaggtgattcagttaaaatgaggtcattaggatgggccctaattcagtatgactggtattcttttttttttttttttttttttttttgagatggagtctcactctgtcaccagcctccgcctcccaggttcaagagattctcctgcctcagcctcccgagtagctgggattacaggcgcatgccaccatgcctggctaatttttgtgtttttagtagaaatggggcttcaccatgttggccaggctggtcttaaacacctgacctcgtggtcttaatcacgaggtcaggtgtttaagaataccacccatatgactggtattcttctaagaggaggaaattagggaccaggtgcagtggcttacgcctgtaatcccagcactttgggaggcagaggcaggcagatcacaaggtcaggagttcaagaccagcctggccaacatggtgaaaccccatctctactaaaaatacaaaaattagccaggtgtggtggtgaatgccagtagctgtggtctcagctactggggaggctgaggcaggaaagtcacttgcacccaggaggtagaggttgcagtgagccgagatcaagccactgccctccagcctggcaacagagtgaggctccgtctcaacgaaaaaaaaaaaaaaaaaagaggaggaaattaggacatacagaggcacagaaggaagatggtgaggagacacagaaaagacagccatctatgagccaaggagagaggcctcagaagaaaccaaccccgtccacactgtgctgtcagtgacaacagaactgtgacaacatacatttctgttgttcaagccacctcatcaccaatacttagatatagcagccctaacaagctaatccaggtggtaaactttctggtatgtgtattttaccacaattagtaataataggctgggcatggtggcccatgcctataatcccagtgctttgggatgtgaggcaggaggattgcttgaagccagttgaagaccagcctgggcaacaacacaagactccatctctacaaaaaaaaattttttcttctttttgagataaagtctcactctgtctcccaggctggagtgcagtggcaccatcttggctcactacaacctccacctcccaagtagctgagattacaggtgtgtgccaccatgcccggctaaattttttttttgttttttttgacatggagtctcactctgtcacccatgctggagtgcagtggtgcagtatctgctcactgcaacctctgcctcctgggttcaagccatccttccaacctcagcctcccaagtagctaggattacaggcgtgtgctaccacgcctggctaaattttttgtatttttagtagagatgggatttcaccatgttggccaggctagtctcgagctcctgacctcaagtggtctgcccacctgagcctctcaaagtgctgggattacaggcatgagccactgtgcccggactaaaaaattaaaaaacaacaaaacaaaacaaaacaaaaaaaacttagttaggtctggtggtttctgcctatagccccacctactcaggaggctgaggcaggaggatcaagtaagcccaggaattggaggctgctgtgagctatgattgcaccactgcactccagcctgggcaacagagcaaaactctgtctctaaataataataatgaaaataaaatcataagcctaagaacatgcaagtggaaaacaaccaccacctgccttcctagagcgcacagacttcccgcagctcagaacggagcaggcatggtgagtgttattagaaaggcacccgggagagtgcagaaagacaggaggttcatgtggacagagcagatttggaaaagcatctttgatacaggaagggtgagaacggtgtcttgaaagaggtggtaggaccctgccaggcagccatggggctaagaggaaagagttccagaaagaaaggcactgtgggccagggagcagggtgcattgtgagaaacagcacgtggtgtggcccgggcagataagtggccaagccagaggtgcagggctagacaagcaggcaaaggggtcggtaggtagggccaggctgaaaggtcaggatgaaagtcattccaaattctgcccctgcaaggaaagctttttatttatttatttatttatttatttatttactttttttgagacagagtctcactctgtcacccaggctgagtacagtggcacgatcacagctcactgcaacctcaacttctccaggctcgagtaatcctcccactttagcttcctgagtagctgggactgcaggtgcacaccaccatgcccagcatttttttttttttttttttggaagaggcgcagtctcactatgttgcccaggctggtctccaactcctgggacacaagtggtcttccatcctcggcctcccaaagtgctgggattacaagcatgagccactgcacctggcctgagaaacactatttttaaatttctatttcctgagcagggttggagagcgtggggctgcgcctctcctaaaggcacttgccagtgcagtcctagtaatcgcttcctgctccttgcctcctccgctggctccctggagtccttgcaagccagtctcaggctgagtttcagaaagctgtggagggctgggtgtggtggctcacacctgtaatcccagcattttgggaggccaaggcaggcagattatgtgaggtcaagagttccagaccagcctgtccaacatggcaaaacccatctccactaaaaatacaaaaattagccgggcatgggtggcatgcagctgtaatcacagctgctcgggaggctgaggcaggagaatcacttgagctgggaagaaaaaaaaaaaaaaaaagatgtgcagggtattaagcactttaagaccaagccagcagatgatgagatgcggttcctctacggccactacaaacgagcgactgtaggcaacataaagacagaacggcccaggatggtggacttcaagggcaaagccaagtgagatccctggaattagctgaaaggggctgccagggaagatcccatgaaagctaaagcttacgtcaacaaagtagaagagttaaagaaaaaattcagaatacgagagactggaattggttgccagccatgcctttgtcctaaactgagacaatgccttgttttttctaacactgtggatggtgggaactgatggaaagaatcagctaacccatcctcaaggctactcaggataaagttctaatagattaggggctaaaacgattactgaccttccctcagtagtttttatctgagatcaattaagtgtatttgtggctgactgtggtgcctcacgcctgtaatcccagcactttggaaggccgaggcgggtggatcacccgaggtctggagtttgagaccagcctggccaacatggtgaaaccccgtctctactaaaaatacaaaaagtagccaggcgtggtgatgtgcgcctgtaatcccagctactagggaggctgaggcaggagaatcacttgaacctgggaggcggaggttgtagtgagccgagattgcaccactgcattccagcgtgggggacggagcgggactccatctcaaaaaaaaaaaaaaagggtatttgttactttaaattaaaaatatctttttctacttccactgcacagtcatttttctggctctccccaccacacccctcaccctgcacaattacccctcttgcatgtacctctctagccgtgaatcttcagggatgggaatatgaggttcttgagatgggattcatcgcgggaatgactccaagaaaagctgccaagtgaggctttcattcacttccccaagatgaaagagctgatctctcgcctgtgttcccctcacagtcaggacctgcgtctgttatttaccaccatgcaatttaaaattagatgcgtgtcacctgaggctctaacagctggaaggctttaaaattagatgcgtgtcacctgaggctctaacatctggaaggcggtgatccagtcacatttatgccacctgagggaacaatcccgggtaagtagtcccagcggggctcagaggttcaggcttgtcccacacagggtccaggaagggccggcactggggcagcctggctcctgggccgtggggcttcaatgcaggctgtccgcacttcattgtccctcaccacacctgctactagaagcccatcggtgaccacagttggagagagggaaggccacacgaagcaagaagtgctgcaaaatcgtgcgatgctgaaaagggaatgcttgtttgcagtttcgttctccctggttgagagccaactttctttaataagcacagttcaaatcctggtaaaatccaaagcctgaaaccaccttttcccacctcttgagttgcacaaacgtgcattcacagataccagggtgcaacatgctgggacgttatattacgtgtaaatcatcatacaaacaccctgggcttttgaaacatggcttgcaagagggttgcacccaaactcttgggccaggcacagtggctcacgcctgtaatcccagcactttgggaggctgaggcgaggagttcattgacatcaggagttcaagaccagcctggccaacatggtgaaaccctgtctctactaaaaatacaaaaattagctgggcatggtggcaggcacctgtaatcccagctacttgggaggctggggcaggagaatcgcttgaacccgggaggcggaggttgcagtgagtcgagatcgcgccactgcactccagcctgcgcaacagagtaagagtcagtctcaaaaaaaaaaaaaaaaaaaaaaaaagagcccagacacggtggctcatgcctgtaatcccagcactttgggaggccaaggtgggtggatcacctgaggtcaggagttcaaaaccagcctggccaacatggcaaaaccccctctctactgaaaatacaaaaaattagctgggtgtgctggcacgcgcctgtaatcccagctacttgggaggctgaggcaggagaattgcttgaactcaggaggcggaggttggagtgagccgaggttacgtcattgcacttcagcatgggcgacaaagcgagactgtctcaaaaaaaaaaaaaaagggttgtacccaaagtcctgtgagtctcacagtagtcctgcaagtaagaggacaggacaaaccggccccctcggacagacagatgcgggctccgagactcagagccagtgtaaatgcctcctggaaagtcacagccatcccatgatagaagaatctggggctcgaaccccaggtttctatcccagtgttcctctctgcttgacccttagaataataaccaccatttatggtcacttactctgtgacagtcattttccacttattatttcctttgatccacaccacgctttgaggaaatcaaatttagccaataaatactagaggaagcattgaactcaggtgtgtcctaaattagaaggccaccttctaattcagctgcattcaattacttctcttccttccagttcagttccactctttatttttttttgagacagagtctcgctctgtcacctaggctggagtgcagtggcacgatctcagctccctgtaacctctgcctcccaggctcaagcaatccctcacctcggcctcccaagtagctgggaccacaggaacgcaccaccacatctggctaattttttgtatttttggtagagacggagttttgccatgttggccactcttaaaaggacacctgtcattggatttagggcccacccaggtaatcacatcgcgagatccttaggttaattatatccacaaagacctcatttccaaataaggtcatattcacagggactagatttaggaattgcacatgtctttttggggggatactgtccaacctaattcaaggacgaggcagattcaggcctacagtatccccagtcctcagtggtagctgcctctgccacaaccctaggaagggtcaggcctggggcaggcagcgggaagcagaatcagccctgggcgggtctgggcaacccatccgtccaagaatcagagacaagggccagcatgctggttccctgggcagcaagtgagtagaacacagggccaggcagggccgaaatcgtggttcatgaggctcggggaggtcgaggaaagcaagcgaaacccagagaactagggcagcactgccaggacagtgctaacatcacattcctgggctccttaagtctcccgagaaggtgcaaattgcgttaattgccactgctgaggccaggccatggcgccctgctgggggctaaccttgcgtgacccgtcagaccagagctgggcttcctcctggtttggtatccgctggagctgtaagggcccgagggtcacagtgcctcttgcaggaggtatggcctcaccagtgcccaggcagggacagtggccattcaggagtgccctggtttccaaagtgatagaggtcagatgtgcctggccacacgcaatcctgggcttcatttatatgcaacaaacccattatctgctcccaacaaatagggaaggaggctaagacgtaggcggatgaagggaaagtgcctccaagacctgcaagttaggatagagctggcagccaggggttagggaagtggaaggaggccctgcgggttctggaagaggactgtgtgcagctacagcagcgggctttgcagtgggactgcctggcttcagaccttggctcttcagcttgctgtgcaaccttgggatagttactcaacctctctcgacctcagttctcttccctgtcaaccgaagaccaaaatagaacctacattatagggctattatgaggattaaatcaaacaagccaaaaaaagcacttcacacaatacctggtatgtagtaaatactcaactaatgcgggctattatcaaccagccacactggagggaagccttgaaggagggtgtggttttctgtgtcagcttggccaggctatggtatttggctgtttggtcaaacgccagtccagatgctgctgtgaaggtattgttttaggtgtgattaattaatatttatatcagtagactttcagtaaaggaaatcacccttcacaatgtaggggggctttatccaatcagttgaaggccttaagagaaaagactgaggttcccagagaaataagagattctgcctccaggctcaaggctgcagcattggctgggtgtggtggctcatgcctgtaatcccagcactttgggaggctgaggtgcgtggatcacctgaggtcaggagctcaagaccagcctagtcaacatgttgaaaccccgtctctattaaaaatagaaacattagccgggcgtggtggcacactcctgtaggcccagctactcgggaggctgaggcaggagaattgcttgagcctgggaggcaaaggttgcagtgagccaagatcacgccactggactccagcctgagtgacagagtgagtctccatctcaaaaaaaaaaaaaaaaaaaaaaacaaaacaccaggactgcagcatcaactcttccctgagtctccagcctgctgggctgctctacagatttcagacttgccagccccccaatcccatgaaactatttatttatttagagacagggtctcactctgtcacctaggccagagtgcagtggtgtgatcatagctcactgcagccttgacctcccaggctcaagcaatcctcctgcctcagcctgcagagtagttgggactataggtgcatgccaccatgctcagataatttttaaattttttgtagagatgggatcccattatgttgtccaggctggtctcaagcttctgagttcaagagattctcccatctcagcatcccaagttgctgggattataggcatgagcactgcacctaactgacaattcctttaggtaggtaggtagctagaggatagggatggatggaggaatggatggatggatggatggatggatggatggatggatggttggttggtggttgggtggatggttggttggtggttgggtggatggatggatggatggacggttggttggatgggtgggtgaatggatggatgggtgtgtggatggatagacagatatagatctagctatctatccttctatctgtccacatatcctatcagttctgtttctccatagaactctaatacagtcagattagtggccagaagacacaaggacaaatgtcccaggcaaagcccaagagtgtgggctgtgctatggaggatcaaacaggccagtgaagccaccgggcacaaggtgcaagagaagacatcaggaaatgaagcagaactgcaggttgtagtcatggtgcaaggtggctcagcagccagctggaagcctttggaagatggagaggcagagagtgagcgtagggctgtccttgaggaagaggcatgcacaaagccagccatgcacactccccagccgtatctgctgccaaagcgaaaccaggatggctgtagaaatttgcttcaaatgaagaaacctgtcccttgacggggacaaatgatgtcaagcacaagtgcagaagcagaccacattcctgccacaccatggctcaaagtcacaaggcagaaacacctgagaaggggggaaggtctgaaggaggagccaggtctggccacgttctcctttggaatctgggtgtggccaccctacatggggatctggaatgtgccgtgctgcaaagtgaattcctggtgcatttttgaggctcaggtgatcccgaagttatggctgtcatgagaaagcagcaccctgcagacaaaaggttctggaaggtgggcagtacaagctggcttcatccaggagccctgctcacagcctggtgctcaatggatatcatccccaccggaagttctaggagctgcccttggttaatgagcctggcagctaaatggcgtcacttgccaggtcacatgggcaaatggccagcgcctcgttcctggagacaaggcggagtcattcagttcttttgttattgttgctagagatggagtttcactcttgctgcccaggctggagtgcagtggtgcaatctcagctcactgtaacctctgcctcccaggttcaagcgattatactgcctcagcctcctgagtagctgggattataggcacccgccaccacacctggctaatttttgtatttttagtagagatggggtttaaccatgttggccaggctggtctcgaactcctgacctcatgatcctctcacctcagcctcctaaagtgctgggattacaggcgtgagccacagcgcccagcctaacttttgtattttcagtagagacagggtttcaccatgttgtccgggctggtttcaaactcctgacctcaggtgatctgcccaccgcagcctcccaaattgccgggattacaggcttgagccactgcgcctggcctggagtcattcagctccaggggcttctttcttccttactaaacggctttgtgcagggagcagaagttctgcctgccctttctaattgccggtcgcaataatatcattcctatttaagactgaataatattccattgcatggatagagcgcattttgtttattcactcatttgttgatggaaatttgctttgtttctaccttttggctactgtaaagattactgctatgaacatgcatgtatagatatctgttttaagtctctgctcttttttggcttggtgaggtggctcacgccgataatcccagcactttggtaggctgaggtggaaggatcacttgagcctaggagtttgagatcagcctgggcaacacacaaagacctcatcaaagagagagagaagaaagaaaagaaagaaaaagagaaagaaagaaggaagaaagaaagagagaagaaagaaaagaaagaaaaagagaaagaagagaaaaagaagaaagaagaaagaaagaaaaagaaagagaaagaaaaagaaagggcacttcaagatgatgcaggttggaacaaaaaaaaccagattattattaaacttgttattaaacagcacctagtttgacaacacttggagtttgcaaaatatacggactctcttggttgacaaacagaaaggggattcttccccagttgcttccactgtccacaggacagcaagtggctgtgactgcctaaacgccctcctcccaagtcacatccagcagtgccctgcctgccacaccacgtcattcgtgtcatttctcccacaggcagccccttcctttgtgtcaatcaaaagctgatgggcacccggcaggcagccggtttgcttctgtcggcagcaaatgctgtccacatttcagaccactagtgaaagtggaaaagaaattattaccatatgaagtttccttgatgaaagcagatttaaattcagccttcatccccaaattttcaacactactttgacagtggtttatctattccattttattttttatttttttgagacagagtttcactcttgttgcccaggctggagtgcaatggcgcgatcttggctcgctgcaacctccgtctcccagtttcaagtgattctcctgcctcagcctcccaagtagctacgattacaggcgcccgccaccacacccggctaattttgtatttttagtagagatggggtttcaccatgttggccaagctggtctcaaactcctgacctcaggtgatccgcccgccttggcctcccaaagttgacagtagtttattttaatacgtaactttgagtcatggaataactgcagaatatgcaacatatttttaaattgtttatctgatcgtggtgtcaaaatcccagtgatcaattcattaggtttgcttgactcccagaattaatacatattaataaatattttgttgagtaccactatggtctgaatgtttctgtctccaacaaaatctatagcctcagaggtgatagtgttaggaggtgggatttttgggaggtgatcaggtcatgaggttgacgcccttatgaacaggattagtgcccttataagaggctccagagctgccaagccccgcccaccatccgagatctcagcaagaagtcacctctatgaaccaggaagcagccctcaccagacactgaatctgccagcacttaatcttggacttcccagcctccagaacctcgagaaaaaaaaatttaagagataggttccggctttgtcccccaggctggaatgcagtgatgcaatcattgtggctcactgccgcctcaagctcctggactcaacagatcctaccacctcagcctccccagtagcagggaccacagaaatgcactgctgcacccagctgatgttttttattctttatttttgtagagatggggtcttgccatcttgcccaggcctacaggcatgcaccaccatgcctggcttccaaccataattaattctatcaagacaagcagaaaactcacttggacatgggtgctgttttttcgtttattttgccatatgactagactgggttgtcaagaaacatccattcctctgtgctacctgtgttcaaggaaaggaagataacaactgagataaagtctgacttttcaatctagaaaattccccttctggcagcaaatgctagtcaggaagcaaggctggaaaacacacacacaaaaggtgtgagatcagttggtagaaaaaggcaatgcagaccacgtctgtgtgcaaggctgagtccaagaccaagtgttggctcctcaccctgtggtcccagatacacctgccatccccgccagggcaatgacagaaacaccacaaaaggctgtatcaggccaggtgtggtggctcacgcctgtaatcccagcactttgggaggctgagggaggtggattgcttgaggccaggagttcaagaccagcctgggaaacatgatgaaaccccatctctacaaaaaatacaaaaattagctgagcgtgatggcgtgtgcctgtagttccaggtgctagggaggccgaggtgggaggatcaccagagcctggggagttagaggctgcagcgagccatgattgcaccactgcactccagcctgagcaacagagtaagaccctgtctcaaaaaaaataaataaataaaaaggtaggcttgtgcaaaactgaagcacatgaagtccatctgtcccttttgcttctgtgtgtctgtctctctcaatgagttgattgcccgttgatcacacccagccagtggggtccagaagacaggacactggacctgagattgaatcccagctctgaaagttgccacctagatacctcaggcaaagcctggtttacctctctggggaggtaaactctggggaggatttccccctcctgaataagatggtaaggacttgctaagggaaagcccttcattccttcacccttcctcttctttctgcctggaacatcagtgtgaggtgtggaggtacagcagccatcttgcaaccatgagacaagaggcttgagaatgaggtctatgctaaggacagaggaacagaaaaatgagaagagcctgggttcttgatggcatcaatagtcattaatactgatatggtttggatctgtgtccccacccaaatctcatgttgaaatgtaatccccagtgctggaggtagggtctggtgggaggtgattagatcatggggcggtttctcatagtttaacaccatctcgctttggtgctgttgttatgatagtgacagtgatcggtggagcaggaacaagagagacagcacctcccctctctctttctcctgcttctgcttcaaccatgtaggacaagcctgcttcgcttcaccttccaccatgattggaggtttcctaaggcctccctggaagctgagcagatggcagcaccacgcttcctgtacagtctatggaactgtgaacaaattcaatctcttttctttataaattacccagcctcaggcatttctttatagcaatgtgagaatgaaccaatacagataccagcaccaaagtgcctaccgtgaactttttcctacccaggaaaaaggaattctttattatcatcagcctctaaaacagggctttctgttacttgcctctgtatgaactccaaactgacacgctatctaatttatgctgagagcacagctagggaacatgcccaggcatgcggcttttacctactgagctggacaagattgtggaagtgaaagtaaaatttgaagattggatgaaagatgttaaaatcatgggaaggctgaataatttgagaatactcagacatctcataggtgaggaaaatgacagtattaacattaatacaaagaaggtgatcagtcaaaacattcctcacgagaaaaggtcctttggcaaatactttcctttaaagtaaatgaatataacaggccaggcacagggctcacgcctgtaatcccagcactttgggaggctgaggtgggcggatcacctgaggtcaggaattggagaccagcctggccaacatggcaaaaccccatctctactaaaaaatacaaaaattagtcaggagttgtggcgcacacctgtagtcccagctacttgggaggctgaggtgggagaatcgcttgaatctgggagtcggaggttgcagtgagctgagatctcaccactgcactccagcctgggcggcagagtgagactccaccacagccaaaaaaaaaaaaaaaagaaagaaaaagtgaatgagactgactagttaatcaagcctttccagccttccacatgagcccaataaattgacctctcagcctgaagacgcatctgtggaaatttccaccaatgataacctgaagagtttgctcctgccgcctcgtgggcagcacgccaggcgtcttccctcagtagttaagtcaacctggctcataaagcaatggaacaaatgcgatttgtgtccccatatcttgcggaagccaaagtagagaaaatagcctagatcttttcaccgattttctgcgtcaatcctctttgattaagtatccgcgctatccacttcaatgaagctatggccccatgaataatactgtggtctgttgccatactcataatggaaggacataaaaatgtccctatttggaattcataaaaatgaagatgcaatttttttccatccaaaaatggctaatagaggttcgtgagttgtctccattttcctccctcaacggtccgttcctgagcaaatcatttctttgggctctatcacatttacgtcgttcatacatgatacccaagcaggtgcgagaatgcaccatctttcattgatgaaaatgatccaattggccaggcgcggtggctcacgcctgtaatcccagcaccttgggaggctgaagcaggcagattgcttgagcccaggagttcgagaccagcctggacaacatggcaaaaccccatctctgttttttaaaaatatatttatttaaaagaaataataataaaatgatccaattgccttccaaactgcttttccaggaagcagttggatggatcatgttgagatggtgtggtttctgtggcaacaagtcaaactgtgacacccaaaggattagacttctcacctgggccccaatatggtaacccatgaaagaaccagccttaggcttccacgacgtcaacactcatgcttgctgccacctccaagccccacccatcccctctgcccttggttccacacccccagctacacgctgacaaagatgctgggctagagacacccagctcgccagacacacccaggatgctctcaccacttcccagagccaaatgccctggctgcaaaacagagaagcgaaacctagaaataatcaaggcttgtttccagaccttcagagttctcacaccctgccctgtcttgtgtgtgtgtagatacagatatagacaagatatcatctgtaggtagagatgtaaatatagacatagctcagctattactcgggaggccgaggcatgacaatcgcttgaacctaggaggcagaggttacagtgagccaagattgcaccaccgcactccagcctgggcaacagagtgagactccgtctcgaaaaaaaaaaaaagatgtatctcagctagacactttacacagattttctgatttaatcctatcaatgtgagaagtattatctgttttattgatgagaaaaacagatttacagagtttcgtttgttcatttttttggtgggtggacagtgtcttgctctgttgcccaggctggtgtgcagtggtgtgatcacggctcactgcagcctcaaactactggactcaagagatcctcctgtctcagcttcccaagtacctgggaccacaggcatatgccaccatgcctggctattttttttttattttgttttgtagagatggggtcttgctatgttgcccaggctggactcaaactcctggccccaagcaatccacctgccttggcctcccaaagtgttgggattacaggcataagccaccgtgctcggccccaagagatttttttcttcaaccttaccaagctcaccagctgacaggaggtaaaggtgagggtcgcagtggctttgaggactccgcagtcaccacggtgcactccttccatctcactttcatcaagcacctagagccccaccctaggccatgtcaggtctcctgctatttctcaggctggcccgacaccgtcacgactccatctctgtatccagggctggcaccaggttcctctcccaaggctctctccctgcttcttttgagatcctcctcatataagaggcttcagataagtgccgcctcggatgccaggccggatgttctgccggaagcttcactcaccgagtcagaggttcatgggctggctcttgatcctcaccctcagaacctagttctgaaagagtaggcatgtgagtgattctatttttttttttttacagacgggatcttgctatgttgcccaggctggtctcaaactcctgacctcaagtgttcctccacggcctcccaagtggtgggatcattgactttatatcttcaagtttagctcaggaggctccgacagagcaggcagccaaggcatgctggttgaataaatgaacaaactcagcaatgtttttgcaccccacaaacactggtggacagtatcacctttgaaaaatcattgattatatcataattgcaaaaatttaggtcaccaactagattacaaacacacgattttgataaaatatatgtaacctaaaatttaccattgtaaccatttttaaaatgtgcaattcagtgacattaagtatattcacattgttggccgcgcgtggtggctcacgcctgtaatccagcactttggtaggccgaagctggtggatctcttgaggccaggagttagagaccagcctggccaacatggtgaaaccccatctctactaaaatacaaaaattagccaggtgtggtggcactcgcctgtaatcccagctactccggaggctgaggcaggagaatcacttgaacctgggaggcagaggtcgcagtgacccgagatcgcaccactgcgctccagcctgggtgacagagagagactccatatcaaaaaaaaaaaaaaagaaaaagtatattcacattgttgtgcaaccatcaccaccatctatcttcaaattttttcatcatcctaaactgagcccttgtcctcattaaacactaactcctcacccctcctccccattccctgacaaacattccattttctgtctccatgagttggactattctaggtccctcctgtaagtggaattatacaatattgtccttttgtgcctcgcttatttcacttaccacagtgtcctcaagttcattcatcttatagcctgtctcagaatcctgtcatttttaaaagatgcttactggatcatcaaaaaacattgatgagcttctgctgtaggcagggcctgtactctccagtccaactaaaaagaggtaaatgacagagtctctgctccaaggtgtcagacaaccaatttcacttttaatttttttgttgttgttgagatttctggaatctgtcttctgcaattaataggttcacctggagaaatagtctgtagtctacaggctagtgtggaaagccattttcaaaggtgaagaggaaggccaggtaggccaggtatgttggctgcctctcatatagtagcatgggaccccttaaaagtgaaattggccgggtgcagtggctcatgcttgtaattccagcacttcaggaggccaaggcaggagaattgcttgagcccaggagttcaagaccagtttgggcaacatagtgaggccccatctctaaatatatatatatatatatatatatatatatatatatatatatatatatatatatatatatgtacacacaaaaatcagccaggcgcgggccaggcgcggtggctcacacctgtaatcctagcactttaggagcccaaggcgggcagatcacgaggtcaggagatccagaccatcctggctaacacggtgaaaccccatctctactaaaaatacaaaaaattagccaggcgtggtggcgggcgcctgtagtcccagctacttgggaggctgaggcaggagaatggcatgaacctgggaggcagagcttgcagtgagctgagatcacgccactgcactccagcctgggtgacagagcgagactccatctcaaaaaaaattagccagacgtggtggcatgtgcctgtggtcccagctgctcaggagactgagaaaggagaatctcttgaacctgggaggcagaggttacagtgagccgagatcacgccactgcactcaagcctgggtgacagaatgagactccgtataaaaaaccaacaaacaaacacaaaatgtctttcagcagcatggtggctgacacctataatcccagaactttggcaggccaaagtatgagtatcgaggccaggagttcaacatcagcctgggcaacatagcaagactctgtttctatacaaattttttaaaacttaactagaccaggcatggtgactcacacctgtaatcccaacactttgggaggctgaggtgggagaatcacttgagctcaggagttcgagaccagcctgtccaacatggtgaaaccctgcctctactaaaaacacaaaaattagtcaggcatggtggcaggcacttgtaatcccagctactcgggaggctgaggcaggagaattgcttgaacccaggaggcagaggttgcagtgagccaagatctagcaactgcactccagcctggggaacagagagactctgtctcaaaaataaataaataataattaaccagaccacaggcctgcagtcccagctactcagggaggctgaagagggaggatctctcgagcctagggtgtcgaggctgcagtgaaccatgaccccaccactgcattcacttccgtctgggtgacagagacagactctgcctccaaaaacaaaaaattaattctggggggttcctcccctgaagagcttttcttgagagatcatgaattgactcatggtaaagtgttagaaacagtgtcaaatggatcttgaagagctcatgaccctgcccaatgcaggcgtctctgtagcatctgcttgtttattccagggatacagaaatcagagtcccaggaagcctgtcccgtggctgtacagctccttgaaagctcctcccctcccaatatggcattgggagcaaatattctcctacttcaaggcagtattgaaagctccccaagcacctctcctgcgaaccccagctttcccaggtcttccttgcagcctttctctcttttttttttttttgaatcagggtctcactctgtcacccaggctgaagtgcagtagcatgaatgtggctcactgcagtctcaacctactgggctcaaggagatattctcctgcctcagcctcctaagtagctgggaccactggtgtgcaccatcacatccagctaatttttttttggtgggggtgtgggtggagtttcgctcctgtcacccaggctggagggcagtggtgcaatctctgctcactgcaacctccgcctcctgggttcaagtgattctcctgcctcagcctcctgagtagctggggttacaggcacgcgccaccacacttggctaatttttgtatttttagtagagatggggtttcactttgttggccaggctggtctcgaactccttagctcagattatccatttgcctcagcctcccaaagtccctcagctgggattacaggcatgagccaccacacccagccccagctaattcttaaaattgttatagagatggggtctccctatgttgcccaggctcgtctcaaactcctgggctcaaagatcctcccacctcagcctcctgaagtgctgggatgacgggtgtgagctgccatgccgggcctggcctgcctttcagactccccgctatccaggatgcctctgattggcccctccaaattatcagtaagacctctgcctatgtgagacaaaactgcaaagacaaagtatggtgtcccaattatttttgtgtatgcacccacacattgacgtagcctagtaacctagagaaaacaaaaggcttccaactgagggagcacaagagctccaagggcagtcacagttgtgtgagggtggcacccctggataccagcggcagcgattccgagtcagttctcacagtgggtaggcattacggtggggaggcttgtggaataaggaagagaggaagcttagccacggcgccagccctcaaaggagccttgggaaagtcaaaacacctaagccttctggggaaagcaagagtcccaggagagcgaggccccccaggcaccggaagtggaagtccactggaaacccaaggctgctccgacagcagcctgtctggtagaccctcaggcaactgccattcatgggccccttccacagtgctctgccattaaagccactcagcttccttctctgcctcttctcatccatttcttggcttctcctgtcctaccaaatccgtggttggtactacattttctagtcccgtagggcagggctgtccaagcctgggcctcaccaaggccactggccactgttgctcagggggaagcctcacactgtgcatcagaagctggagacactgcagcttctctcaggaggggaccgtaagcacaggcagcctgtggctgatctgtgtgggacacccagggtcgagaagggaggaccaaggtgttcactgcaatggaacacagccttactagctgtcatgtcccccagacagcaaattggcttgattgcaataaccagttggagaggacaaagtgagaatcaccccatgtgaccagctgcttcttgacggtgatcattttgggtgctgaatcgagctccaaccccaaacatcagccccataattgcccatcaaccatttcaccttcacctttctggggcttccaggttccttcattaaaataaaaaatgctatttgggaataaatttaacaaaagatatgcaaatcttttccactgaaagctgtaacacattattgaaagaaattacagaaaatctaaataaatgaagaaatgtaccatgttcatggattagaaaattcaatattgttaaaatgtcaattgtctcaaattaatctatagactcaatgtaatcccaagtaaaattccagaatgcagactggcatggccaaagcagaaggatcacttgagctcaggagtttgagaccagcctaggcaacatgacaaaacctcatctctacaaaaaaatagaagtgttagccagtcatggtggaatgtgtctgtagtcccagctactcaggagactgaggtgggaggactgcttgagcccaggagggtgaagctacagtgactatgatcatgccactgcactccagcctgggtgacagaaaaagaccctctctcaaaaaaaaaaaaaaaaaaaattaaaaaaaaccagaaagctttttttagaaattggcaagcagattctaaaatgtaagtggaaatgagaaggacctagaatagccaaaataatcctaataaggaaaaaattcagaggacttacactggctgattttaagaactgctataaacagcagtagctaagaccatttggtagtggcgttaggatacacaaaatagaatcaatggagcagaaaacagagtccaaaaatagacctacataaatatggccaactgattcccaacaaatgtaccaaggtaattcaatggagaaagaaaaacctttcaacaaatgggctagaataattgtctatttgtaaggaaaaacaaattgcctatttgtaaggaaaacaaatgaacctcaactcctttttttttttttttaagacagagtctcactctgtcgcccaggctggagtgcagtggtgccatctcggttcactgcaagctccacctcccaggttcacgccattctcctgcctaagcctccctagtagctgggactacaggcacccgccaccacgcctggctaattttttgtatttttttttttttagtagagacagggtttcaccgtgttggccaggatggtctcgatctcctgacctcgtgatctgcccgccttggcctcccaaagtgctgggattacaggcgtgagccaccgcacccggcccctcaacttcttacatcacaccaaaaaattaaattgaaatagatccaagacctaaataaaaaattaaattcataaagcatctaaaacataggaaaataacttcatgactttgagatgggcaaatatttctaaggcaaaacacaaaaagcattccataaaaaattaataaacaaattcatcaaaattttaaattttgagtacagtcaccagaatggctacaattaagcagactgacaacaccaaatgttggcaaaaatatggagtaactagaaccgtcgtatgttgttgatgggagtgtaaaataacaaaaccgctttgggccaagcacggtggctgacgcctgtaatcccagcactctgggaggccaaggcgggcggatcatgaggtcaggagataagaccatcctggcaaccaaaaattagccaggcttggcagtgtgcgcctgtagtcccacctactcgggaggctgaggcaggagaattgcttgaacccgggaggcggagcttgcagtgagccaagatggtgccactgcactccagcctggcgacagagcgagactccgtctcaaaaacaaaacaaaaaaaaactgctttggaatactgtctaatggtttccttttttttttttttttttttttttttttttgagaccgggtctctttctgttgcccaggctggagtgagatggtacaatcactgctcactgcagcctcaacctcctggcctcaagccatcctcctgcctaagcttcccaagcagctgggactacaggcatgcaccaccaggcccagctaaatttttctttttcttttcttttcctttttttttttttttttttgagaccgagtctcgctctgttgcccaggctgcagtgcaggggcatgatcttggctcacagcaacctccacctcctgggttcaagctattctcctgcctcagcctcccaagtagctggaactagaggcatgcaccaccacacccagctaatttttgtatttttagtagagatggggtttcaccacgttggccaggctggtctcgaactcctgacctcaggtgatcagtctgtctcggcctcccaaagtgctgggattacaggcatgagccaccgcgcccggcctttctttttgtgttttgtagagatggcatcccactatgttgcccaggctggtcttgaactcctgggctcaagtaatcctcctgcctcaacctcccaaaggaggcatgtgaaccactgtgcccaacctggtttctttactaaactagaaagtaaaatcttatgacccagcaattcggttttttttttccagcaattccatttcaaatgtccatgaaaagccttgtgcaaaattatctgtaatagtcaaaaaatggaagtggcccctggtgtctgtctataagaaaatggataaactgtggtaaagtcacatattcgggtggtgggaaaggcaaaaggtacgtcacaatgacacagacaaatctcaaagacataatgcttggcggggcacagtggctcacacctgtaatcccagcactttgggaggccaagatgggcagattgcctgaggtcaggagttagagaccaccttggccaacgtggtgaaaccccatctctactaaaaaatacaaaattagctgggcatggtggcacacacctgtagtcccagctactaggcaggctgaggcacaagagttgcttgaacccgggaggcagaggttgcagtgagccaagaacacgccactatactccagcctgggtgacagaataaatgagtacctaatgtatatttccaactatacgaagtttgggaacaggtacaatgaatcaatgttggaaaaaaaaacaacagaacaatggcaggctttggggcgtgggaactgactgggacacactgtgaaggcaatttcagggatgacaatgatgttcaatattttctaaaaaaatcacagcttttggccaggcacggtggctcatgccttaatcgcagcacattgggaggccgaggcagaaggatcgcttaagcccaggagttcaagaccagcttgggcaaaatggcgaaaccccatgtctctacaaaaatacaaatctcggctgggcgaggtggttcacacttgtaatcccaacattgtgggaggccaaggcaggtggatcatctgaggtcaggtgttcaagaccaccctggccaacatggagaaaccccttctctgctaaaaatacaaaaataagcatgacatggtggcacttgaatctgggaggcagaagttgcagtgggctgagatcacgccactgcactccagcctgggcaacagagtgagacgtcatctcaaaaaataaaataaaataaggccgggcacagtggctcacacctgtaatcccagcactttgggaggccgaggccggcagataacctgaggtcaggagttcaaggccagcctggccaacatggtgaaacttagtctctactaaaaatacaaaaattagctgggcatggtggtgggtgcctgcaatcccagctactcgggagactgaggcaggagaatcacttgaacccgggagacagaggtttcagtgagccaagtccactgcactccagcctgggctacagagggagactccgtctcaaaaataaaataaaacaaaataataaaaacaaataaaaattaaaaatatataatatccattctattgtaagtaaattacaattagaaaaaaaaaaagagcccccaaaggaaaggaataaagacagaacacaggaagaaaggaggagagacagggagggaaggagggccagcatgagttatttcaggggtggaaaatcacccaagtcaaacaccacaggtatccccagtaggttgcagcaaactgctctctgtagggaccaagctgtgcccaggatcaccccacaaccctgagattatctggcatgctcaccaatcagttctcatgatctgcagcagggcacattcggtcctgcagagacgacccagctgtcaccctatcctccttgctgaagaagggaccctgcggggctgcagctcatctgcctcaggctggcccatccctgcacaggccgctgagtctgagcatgtaccctgggagttgcttacagagcaactttgtcatgtcaagttgacctccagggtagattttcctgctgcaagagagagatgatatctggttagcctggcggttctatttctcaatgtgaatcaggaaattgacatctgatttaacatttcaaaaacaatttgtgttcagccagaatggaggcagtgtctgggagtggtgagggatgtgaagtgcagcagcgcacaggacctccagcactgggaaggaggcctgaggccaaggcccctggtcaggacacctgagcaatgaatactctgtctccttgtccaaagacatttagcattatggaggttaaaaacagccaaattcacatgtatacatatgtaactaacctgcacattgtgcacatgtaccctaaaacttaaagtataataataattaaaaaataaaaataaaaataaaaacagccaaatcggccaggttcggtggctcacgcctgtaatcccagcactttgggaggctgaggcgggcagatcacgaagtcagattgagaccagcctggctaacatggtgaaacgcagtctctactaaaaatacaaaaattagcaggacgtggtggcaaacactgtaatcccagctacttggaggctgaggcagaagaatcgcttaaacctggaggttgcagtgagccgagatcatgccattgcactccagcctgggtggagctagactctctcaaaaaaaaaaaaaaaaggccaggtgtggtggctcgtgcctgtaatcccagcactttgggaggctgaggcaggtggatcacctcaagagttcaagaccagcctagccaacatactgaaaccccatctctactgaaaatacaaaaattagccgggtgtggtggcatgtgtctaatcccagctattgggaggctgaggcaggagaatcacttgaacctgggaggtggaggttgcagtgagccgagatcgtgccactgtactccagcctaggtgacagggcgacactgtgtcttggggaaaaaaaacaaaaaacagccaaatcgtggcattttcatgcagctcgacctagtagacatctagtggctgcaagcgcctgtgtgcagcgctggagacctgagtcctgttgtgtgtgaaggtggggcagggcagcagggcaaatgccgaaaacaaaaactgatcaggccgggcgcggtggctcatgcctgcaatcccagcactttgggaggccaaggcagacggatcatgaggtcaggagatcgagaccatcctggctaacacagtgaaacccaactctccaaaaaaaaaaaaaaaaaaattagccaggcatggtggcgggcacctgtattcccagctgaggctgaggcaggagaatggcgtgaacctggcaggaggcggagcttgcagtgagccgagatcccgtcactgcactccagcctgggcgacagagcgagactccgtctcaaaaaaaaaaaaaaaaaaagaactgatcaatgagccgccagatgccgagcaccacaccggcaagggctgcggatcgtgaacactggagattcaaacagcagagagaccacctcacaccattctgtcaacccgtgccaagtgcccaggcctgtgccaacgcttggcacacaatgattcaacagaggcagcctcatgcttcacggcccgatgctcgcttgttgtctatggccgtaggctaacctgcaaataaagaactggactgcacggaggtggtcattcaaatggagggatgcgctgggcgctgtggctcacacctgtaatcccagcacttcgggagaccaaggtgggtggaccacttcaggtcaggaattcaaaaccagcctggccaaaacatggtgaaaccccatctctactaaaaatacaaaaattagccagacatggtggcgtgcgcctgtaatcccagctacacaggaggctgacgcaggagaattgcttgaacccaggaggtggaggttgcagtgagccaagatcacaccactgcgctccagcctggactgcaaaatgagactctatctcaaaaaaaaaaaaaaaaaaaaaaaagaacaagaagaaagaatgtcacagctctgccaatctaagacacctgtgcaagactgaggtgggcaagaggagtttcgtagaagaagacaggctggggtcaaactgggaaatttccagggaaaaagagggctctcagagtaaaagagtaaaggtggaaatgtgcccagaccaaagaggggcctctgtttgaccacagacctgctcacggtggagggcagcagcaggaaccaaggctgaggagcatccagatggagggactcaaggaagacttcctggaggaggcagtcgaggtcttgaatgatgggaagactttagacatgtacagataagcaggcatggcagggccagggaccatagcacatgcctgcaatcccagcactttgggattacactttgggattacacttagcactttgggaggccaaggtgggcagataacctaaggtcaggagttcgagaccagcctggccaacatggtgaaatcccatctctactaaaaaaaatacaaactattagctgggtgtggtggcaggcacctgtaatcccagctactcaggaggatgaggcaggagaatcacttgaagccaggaggtggaggttgcagtgagctgagatcacgccactgcactccagcctgggtgacagagcgagactctgtctaaaaaaataaaataaaataagaaggcatgccaggagctttctgaatgtggtaaactggacaacggccttctcagagatgtgcaacttccaatccccaaaacctgtgaagatgtcaccttatatggtcaaagggactttacagatgtgatcaagttaaggatcttgagagatcagccttcattattcagctgggcccaatttaatcacaaggacccctacaagtgggaggcaagagagcagagtgagtactagcaagagactggagccctgtgaggaagggtccatgagccaagaaatgcaggcagactctacaagctgcaaaggcaaggagcttgattctctctgaagcctccagaaggagaacagacctgcagacaccttgattttagctccataagactcacttcagacttctgagcttcaaaactgcaggacaacaaacgagtgtgtggttttttgttattgttgttgttgttgtttgagatggagtctcactctgttgcccaggttggagtgcagtggcatgatctcagttcacttcaacctctgcctcccaggttcaagcgattctcctgcctcagccttccaagtagctgggattacaagcaccctccagcacacccagcaaatttttgcatttttagtagagatggggatttaccatgttggccagcctggtctggaacttctgacctcagataatccacctgcctgggcctcccaaagtgctggaattacaggcgtgggccactgtgcccggcctcatgttttgttttgagccactccatttgtataatttgttacagtgccagtggaaaactagtaccccgcagaatcagtggaaattcaattcacacatctcccctacacatctccatacctcaggtacatacatttccttctggagatttcattagatcagaaagggctggaatgcacatgcatgtttggcaaatgtgggtgcattcgccattccattcattcattcacccagcaaatgacaggaatggagctaagaccatggttcatatcaatacccctgccctcagagagcccagaatctagtcggggacacagacaggtcaacaggtagttgcaatacaaggagataaaagcttttttttttaaagctcatcatcactggtcattagagaaatgcaaattgaaaccacaatgagataccatctcacaccagttagaatgacgatcattaaaaagtcaggaaataacagatgctggagaggatgtggagaaataggaatgcttttacattgttggtgggagtgtaaattagttcaaccattgtggaagacggtgtggcgaatcctcaaggatctagaaccagaaataccatttgacccagcaatcccattactgggtatatacccaaaggattataaatcattctactataaagacacatgcacacgtatgtttattgcagcactaattacaatagcaaagacttggaaccaacacaaatgcccatcaatgatagactggataaagaaaatgtggcacatatacaccatggaatactatgcagccataaaaaaggatgagttcatgtcctttgcagggacacagatgaagctggaaaccatcattctcagcaaactaacacaggaacagaaaactgcacaccacgtgttctcactcataaatgggagttgaacaatgagaacacatagacacagtgagggaaacatcacataccagggcctgttggggggtggggggctaagggagggatagcattaggagaaatacctaatgtagatgacaggttgatgggtgcagcaaaccaccatggcacatgtatacctatgtaacaaacctgcacgttctgcacatgtatcccagaacttaaagtataataacttttttttaaaaaaagccttttttttttttttgagacagattctctctctttcaccaaggctgtagtgcagtggcacgatctcggctcactgcaaactctgcctcccaggttcaagcaattctcctgtctcagcctcctgagtatctgggactacaggtgcacgctaccacacccagctaagagataaaaactttgaagaaggtaggcagaggaaaatgcagcacagaaaagagccaacgaatccagcttcccagatgacagagtgttgcagtacaacaggtcttactcagctaggcaaagagctgagagagcaaagggaatccaatcagatggaaccatatatttttttctttttttgagacagtctcactctgtcgcccaggctggagtgcagtgcaatgatcatagctcacagcaaccttgaacttctggactcaagcaatcctcccacctcagcctcctgggtagctaggactacagacgcatgtgcctggataatttttttttagtttttatttttttgtagagacaaggtcttggaccttggaaccatgtttaccaaatggaggctagaggagatatggggaactatggactaattgggtatgaccagaacagaggtcagaggctgggataagttgtttctgattacaaagtggagacaattgctgcatagctgcttcttggactctttcttggtcaaataaaagggccagcccaggcacggtggctcacgcctgtcatcccagcactttgggaggccgaagtgggcggatcacctgaggtcaggagtttgagaccagcctggccaacatggtgaaaccccatctctactaaaaatacaaaaattagctgggcatggtggcgtgcgcctgtaatcccagctactcaggagcctgaggcaggagaatcgcttaaacccaggaggtggagactgcagtgagcctagatcgcaccactgcactccagcctgggtgacaaagtgagacttcatctcaaagaaaaaaaaaaaggcaaataaaggggccaatgcagggaggttcatggcaaagacagggaaggctctggggacatctttcctacataacctgaatctatgttcatcgtcatgaaaagaagctccaggtggaaaaaaaaaacactgggctgagcacctctgcccctgtttctcctgggtgacaacttgcctggaatttctctccctttgaatgtcagtgccactaccggggacacctccgtgtgcattgctcccgtcacaccctgcgccaagaggcaacaaaaccctttcattgccaccctcatgagtaaaataaagagaaagagattcccgccctgggaacagcctaatttctccagctggtttctggtctgagacattgtcagatggtttgtattccaaatgaaatgaacgagccaactgtattatcatagtggcatgcagaaaatagccacatctttgagacagcattacccatggatactaactggatgatgtttggtcacaagggtgagaaaatctggagatgaaaagaagatgccagcctgggcaacatagtgagaccccatctccataaaaataaacaaaacattagtcaggcgttgtagtgcacgcctgtagtcccagctactcaggaggcggaggttggaggattacttgagcccaggaggtcaatgttgcagtgagctatgactgcaccactgcactccagcctgggtgacagagcaataaataccctgtctcaaaaaaagaagaaggagaaggagaagaaggaggagaagaaagaggaaggaaggaaggaaggaaggagaaagaaaaagaaagaaaaggaaagaaagagaaagaaagaaagtgaaagaaaagaaagaaagaaagaggaaagaaagaaagaaagaaaaagaaaaggagagaaaaagaaggtggagttgggccaggcgcagtggctcacatctgtaatcccagcactctgggaggccgaggtgggtggatcacttgaggtccggagttcaagaccagcctggccaaggtggttaaaccccacctctactaaaaatacaaaaattagccaggcgtcatggcatgggcctgtagtcccagctactcaggaggctgaggcaggagaatcgcttgaacccgggaggcagaggtagcaccactgcactccagccagggcgacagagcgagacagcatctcaaaaaaaacagaagaagaagaagaaggaggaggaggaggaggaggaggagaaggagaaggagaagaagaagttggagaggagaggggatggagtatctcccctttgcacaaggactgagttacaggccagactttccaagactatgtagagctctctaggactcctgacttcagagaataagatcagggctgtggcagaggaacagtctaagaggccgaggggacagaatcgcccaccttgtagcccagggatcgaacccctttaaaccactgaccttgtccctatgcagatctgggccaaggactgtgtgtaggcagaggaggcccgtagttcagaccaaggggaagattttgcaaacttgttcttaactgtcactacttatgtgcaaggattctgaagcttgacaagcagcattgtttcctccctgagcaatcagaaatcaataaaagcagaactctctgtacttaggagatctgcgttggtgtgggccgacacgcagcagaacatggcggagcgggtgggcaaagtgatggagagccctagccacgttccagatggtgcaggaagggtgttgcagctgagcacaaacaggggagaaagctgctccaacaaaaaccgccggagccacatgtggggaaagtcagacatttgcggtgcacgtggacggaggccctctggagagggctgcggttggtatccgtcatccccgctcctcatcagcagctgatgctctggcgacagaggctgttggctgggctagattggacgcgtggagcttaaatgaagctgcccaggcaagggagctagaagctctggctctgctgctaattggccatgaacctagggccagttatttcttgtctctggattcatttcctcattttgttttttggggtgtttgttggttttgagatggactctcactctgttgcccaggctggagttcagtggcgtgatcttggctcactgcaacctctgcctcctggcttcaagtgattctcatgcctcagcctcccgagtagctgggactacgggcatgtgccaccacacccagctgatttttgtatttgtagtacaaatggggtttcaccatgttgaccaggatggtcttgatctcttgacctcgtgatctgcccaccttggcttcccaaagtgctgggattacaggtgtgatctactgtgcccggcctaatttttgtatttttagtagagacagggtttctccacgttggccaggctggtcttgaactcctgacctcaggtgatccactggcctcagcctctcaaactgctgggattacaggcatgagccatggcacccagccatttcctcattttgaaaaggacagagaggaggtgtgaaggggcgatgttctcttcggtaacacctgaggtctctggtggtatcactgttggaaaggggccttgacaccctccaccccaaactctactaaaatgtgcttctagcaactctaaacttaaatcatttgtgatctttcctctagctttattagtcactgatctttctcactgggccaggaaataagcttgcaagggggcactcctccagatttcccaaggagagtacctctcggttgtaaattcaccaaaaatgtggaacatcccctcctactgggtaaagttggccaatgaagtggcaacctttgctaccatcactgctactgttttaggtctattttccaagaaaaagcatattaaaccagttttattgagacattacagaacataaaattcacccatttaaagtgtacaattcaatggtttttagtatgttcctagaattgtatagccatcaccatcaccatctaattcactacattttactatttccagaaagaggccctgcccattactagtcactctcattttgccccagccctaggcaaccaccaatctacttcctctctctagagatgtaaaacatagcattttgccccgttagggacatttcctacaactacgtatagcatcatcatatagcactgactaatcaagaactcatgacccatatataaatagccaacaaaaacatgaaaatgtgctcaacatcaccgatcattagggaaatgcaaatcgaaaactacaatgagataccatcttgcatccatccgggtggctactgtcaaaaaaaacagaaaataacgagtgttggccaggatgtggagaaatcggaacccttgtacattgttggtggaaatgtaaaatagtgcagctgctgtgaaaaaaagcatggtggttcctcgaaaaactaataatggaactatttatcagcgattccacttccgggtatatacccaaaagaatggaaagcagggcctctaggaggtatctgtataccctgtccctagcattattctcaatagccaactgtccatcaacccaactgtccatccacagatgaatgaataaacaaaatgtggtctatacatacaaaaaaaattcttttattttttatttttttggccaacatggtaaaaccccatctctactaaaaagtaaagaattttttttttttttttttttttgaggcagagtctcgctctgtcgccctggctagagtgcagtggcacgatctcggctcactgcaacctctacctcccaggttcaaggaattctcccacctcggcctcctgagtagctggatcacaggcatctgccaccacgcctggctaatttttatacttttagtagagacggggtttcaccatgttggccaagctggtctcaaactcctgaactcaagtgatccgcccacctcagcctcctaaactgctgggattacaggcgtgagccaccacgcctggccaaaaagtaaagaaattctgtggccaggcgtgggggctcatgcctgcaatcccagcactttgggaggccaaggcaggcggatcacttgagcttaggagttcaagaccagcatcctgggcaacaaagtgagaccttgtctctagaaaaaatacaaaaattaactgggcacggtggtgcacacctgtagtcccagctactcaagaggctgaggtaggaggatggcttgagcctgagggacagaggttccagtgagccaagatcacaccactgcactccatcctgggcgaaagagccagaccctgtctcaaaaaataaccaaaaaagaaacaaacaggctgggcaccgtagctcacgcctgtaatcccagcactttgggaggccgaggcgggtggattacccgaggtcaggagtttgagaccagcctgatcaacatggtgaaaccctgtctctcctaaaaatacaaaaattagccgggcgtggtggcgcatgccggtagtcccagctattcgggaggctgaggcagaagaatcgcttgaacccagggggcagaggttgcagtgagccgagattgcgccattgcactccagccaggacactaagagcaaaactccgtctcaaaacaaacaaacaaacaaaaagcaaggaaattctagctgggtatggtggtgcacacctgtagtcccagctactgggatggctgaggtaggagaatagcttaaggccaggagttcaaggccagcctgggcaacacaacacatgctacaacgtgcatgaaccttgaggacattatcttaaatgaaataagacaatgctgtatgattccatttgtatgactctagttacctagaagagtcagattcctagagactgaaagtaggatggtgattgccaaagaggaggatggggagttattgttaattttattttatttttgagacagggtctcactttatcacccaggctggagtgaagtggtacaatcacatctcattgcagcctcagcctcctgggtccaagcgatcctcccacctcagcctcccaagtagctcagactataggcatgtgccaccacacttggctaattatagactttttgtagagacgaggtctcactatgttacccaagctgatcttgaactcctgagctcaagggatcctcctgcctcaacctcccagctgtgcagcacgcggctgagttatggtttaatgggtagagagtttcagttttacaagatgaaaagagttctgaagacagattggtgatggttacacatcaatgtgaatgttgttactaccatttagctatacactttaaaatgcttgagttagtaaatttttttgtttttttggtttttcttttttgtttttgtgagacagagtcttactctgtcacccaggctggagtacagtggcacaatctcggctcactgcaacctctgcctcccaggttcaagcgattcctctgccttagcctcctgagtagctgggcctacaggcgtgcaccaccacacccagccgagttagtaagttttatgtcatgtgtactttattataatttaaaacaaaaaacctggctgggtgtggtggctcacacctgtaatctcagcactttgggaggctgaggtgggtggatcacctgaggtcaggagttcgagaccagcctggccaatatgacaaaaccccgtctctactaaaaatacaaaattagctgggcatggtggttcatgcctgtaatcctagctactcaggaggctgaagcaggagaattgcctgaacccgggaggcagaggttgcaggtagccgagattgcaccactgcactccagcctgggcaacagaacgaaactctgtttcaaaaataaaataaaataaaacaaaaaatctcatgacccacatcaaaaggtgtaggcaaggggtgcctttcttatgacacataaaacgcccactttttttccttttaaaaatacaaatataactttttattaaacagctaaacatagacaacattagcaaaatgctttttaaagaaatattattcacagaatatgctttaaaaaaattaacattcaagcacaatttgatcttttctcattaactcttcactaatatcaaacaggcgtaatcatttttgtaagactattttctgaatgcttaagcgcaaagaagaatgccaagtacataaatgtgcattaattcatctactcttcctgacaccaggaagtagattttaatatgatacttatcccatttctcagaattagaactgagagttagagatattaaagaacttgcccaaagccacaaacccggtgtcagagttgagacccaatctagtcttctgactccagaatcgatgctgtcttattaaaagacgacggttctcaaggaacatgaaaacagccattctctcatcagttaggggcctgtttaaacaaatccaccccaaaaagctttttcttagcattctctactaatagcttgcaaactgtcttccaaaaataatttttaagtctgcatcctttacaacaacaacaacaaaaaaccttcaaacaattcagtgtaaggacctttttttagtagaatgtggttttggagcagaagcagacgatgagttcttggccaaatcttacatcttttaaggcctcttctataaaatcggacaactcagaagtgataaggaccagaaacacgccaggtccatgttttttacatggcccttccagacatagatcccgcctccgccaccatctctacagagtcgtctagttccttctgagatagaaaggtcatcccaacagcaatgattctggtttagcaggggggatatttgaagcaggtccctttggaggaagtgggcccctcctacaagccaagctttcaacagccggagtttgtgttttgcgactccaaactgatcaccgttgactgtactaacgttggttctccaggacacatttggaaatgagacaaacagatcctcactgagtcttcgctggtctcctgatctattttttttttttttttttttttgagatggtcttgctccatcacccaggctggagtgcattggcacaatcactgctcactgcagcctctgacttcccaggctcaagcaatcctcccacctcagcctctcgagtagctggaactacaggcatgtgccaccatgcttagctaaattttttgtattttttgtagaggtggggtctcactatgttgcccaggctggtctcaaattcctgggctcaaatgatcctcccaccacggcctcccaaagtgcttggatgagccatgagccaccacacccggccttggctgttctcttgaatgaaggggattacaaactgggggtctcaggctggccctttcttgccttctgggtggtctggaagcagggacagccactctgcacagagtgcacgtcgcagcaagcacactgaggggatgcctggcttcttgatggctttcctcttcctacttaaagtcccttcctgagacacagttgtattcccggccttagatctcatatgtccctgaatcttttaaataaattattctctttggcttaaactacttccagatcattggggtacatgtcataagagaatcctaactgatacactattaaattcatttcttcatgacttgtatgaccactgaagttaatttgtcctattgtagtccagattcaaagaagaggaaagaatctccagacaagtgtggcccaccagcatgaagaggaaagctctccaagccatgaggaccaaaaatgagccccatcctcctatgctcctctagaaaatgtgcaacaacaaaatatataaaatatagtttggttgccaaagagaggtcaaatgttgaactatgacagtgatggcattcaaatgcattcatctttaatgctgcatctgtctacaaaaacgaaaacaaagcaagtaaagctccttggttaaaaatagtgctttttaattggctgggcccagtggctcacatttgtaatcccagcactttgggagggcaaggcaagcggatcacctgaggtcaggagttcgagaccagcctggccaacatggtgaaaccccgtctctactaaaatattaaaattagccaggtgtggtggcacacgcctgtaatcctcatctactcaggaggcaggagaatcgcttgaacaacaacaaaaaaaaatagtgctttttaaagcaaacaggtaagggcaagggaaaggacattgactgggaggcaaggagtaaacttaaagggaaaacagcatcccacagatgtgcccttgaggttgacgccaagccagaaagggtggttccctacaattcatctggacccctaggaaggggcaaaagttcagaaatcctaagctttaatataagggagaaggaagagtggagggcagggagtcattttcttttttttcttttttttaaaattattatttttttttgagacacagtctcgctctgctgccaaggctggagcgcagtggcgtgatatcagtgcaccacaacctctgcctcccgggttcaagcaattctcctgcctcagcctcccaagtagctgggaatgcaggcatgcaccaccacacccagctaatttttgtattcttagtagatatggggtttcaccatgttggtcaggctggtctggaactcctgacctcaactgatctacccgcttcggcctcccaaagtgctgggattacaggcctgagccaccgcgcctggcccattttcttagattaagaagcaacacctcccatggtccaagccagccgcctcacactccgtaaataaaccatgctgattcaaacccaaatggctttgctcagctctcaccaagcctggaagatcttcccttctcctgtctacttaatccagtcccagccatcccttaacacctagtataaaaggttccttcctcgctgtcatctctctgatgtccctctcaaccagattcccacagcacagagaatcacagctggaatggccctgatggaaagcatccaacttggccatccctcctgctgaagctcttgattatgtgtctgatgtcgactgttgtgttgagatgggcaagaacagaaccacaaagaagttccctcctcctctgagtgatcaagccccagccatctggagaaaccaaggtgaaaaagtgactgagaagcgtgtcaacagataaattacccaacttagcaagccacactcgcagatcggggtcttgtctttacagagatcccatattttccatgaaaccacctttattatcatcacctgttggaaacagaatgggtaaagagagatagggaaggaaaaatatgaatgaccaatgatctaatttgcagcagataggcccaggaacagctgcggaggtgccatgactgctcacagccccaccgacattgcagtgtgaccgtctgcgtgagctcctaggcagcgtccaaaaagtcaacccgacctgcacatggatgctgcccggaacatttggccaagaggggtctctgtattcagctccagatgctgacattggctggtggtgattctgaccccctcaccctcaccccatttggattttaacacgtgcagggtctcagctgttcttaggcctcaaaacagtaaccaggagtcaaggcataaagctgggtggccctgacggctccttgctgatggaactgacttctctgaagacaaaagacatggattaacaaagcctgaggatacagaatatttgaaatccacacagaaacttggtgcccttcctgtcaccacggaattagccctgggatttacagtcatgcactgcatactgatgttttagtcaatgatgaactgcgtatgcaacggtgttttttttttcctgagacagggtctcactctgtcacccaggctggagtgggaatgcagtgtggcacactctcagttcaatgcagcctcgacctcccaaggctcaagcaatcctcccacctcgatctcccgagtagctaagactataggcatgcatcaccatgcccagctaatttgtgtatttttgtagagacaggggtctcactatgttgcccaggctggtctcaaactcctggactcaagcaatctgcccatcccagcctcccaaagtgctgggattacaggcataagccaccacgcccagcctgcaacagtggctctataagcttataatacagtatctttaccgtaccttttctatgtttagatgtgttcagatacacaaatacataccattacattacaattgcctacagtactcagcaccgtagcctgctgtacaggtttgtattgcttgccatatagcatcggtgtgtagtaggctgtgccatctaggtttgtgtaagaacactttgtgatgcttgtacaatgattaaatcacctaaggatgcatttcttagaacatacgtattcccatcattaagcgatgcatgactatatttctattaatgatcctgccatcttcttccccatcctctagacttgctgatcatcttggattccacttttttttttttttttttttttgagacggagtctcactctcgctcaggctggagtgtagtagtgagatctcgactcactgcaaccgtcacctcccgggttcaagcaattctcctgcctcagcctcccgagtaggtgggactacagttgcacaccaccacgcctggctaatttttgtatttttagtagagacggggtttcgccatgttgacaagactggtctcaaactcctgacctcaggtgatccacccacctcagcctcccaaagtgctgggattacaggcgtgagctaccatgcccagccgaaattttcttttcaaaaaacagactgttttctccaggtggtaacagaagagcaagtcaggtacttaaaataggagggggatttgatgcactgttgctagattggaaatggaggggccacaaggaaaggaccagagagtggcctctaggagtggagagcagcacccagcagacagccagcagggaaacgggggcctcaacctacagctgaaaggatggaatcgcccccacctccatgagcttggaagtgggttctttcctggaacttctggatgagtgcctggccccctcacaccttgatttcagcctttccaggtcctgagcggggggcctggtagagcctgcctggacttctgacctatggaactgtgagatgataaatggatgctggtttatgctgccacattgtgtggtcatttgttacgcagcaacagaaaactaatacagtctcctaactggggccagttaccaaaagaagacatttcggcggcagaggggagtctccatgactaactttgtcttcttcacacatctcctccccgtctagaaagccttcctagccccagtgggtaccgtcctctgttgctgggtatctcccactcccttggccctgggcaaacactgcctgtcggcgggaattccctgctcctctatgacttcaccttcttcttcttctccaaagcattcaacacagagcaagcacacaataaatatttgctgattcagccattttctttcagctcctatgaccagcaggaccaatgaaggggttcaaaaactgcctggccacaggcagacagagagcctttcccctcagactctggcttcatggcttcccaggattcacaaagcgcctggatggtaacatgccatttccgaagcttggccttttttttttttcattttctttttctttttttttttgaggcagagtctcactctgtcgcccaggctggagtacagtggcgtgatcttggctcactgcaacctctgcctcccgggttcaaggaattctcccgtctcagtctcccgagtagctgggactacaggtgcatgccgccttgtccggctacttttttgtattttagtagggacggggtttcaccttgttgcccaggctgctcgtgaactcctgagctcaggcaatccacccgcctcgaccttccaaagtgctgggattacaggcttgtccaccacgcccgctcagccgcttggcctttgattaatactggctagtcatgctttcaagctccatttctgtgaattatgtcctgggtttttaggctgatgtgcaactgactttgtaaaacaaaggaagtgagaatgaggtctcacaaatgcattacttgtatttgttcaacaacaaacttatcctgaatatctgttgtgtccatgcaccaagctcaaccctggagacagagaaaaaaactagagtgacccttactgtagagctttaatcaaagtaccccctgatcacagaggtcactgcagtctgtggcagtttggaaacgaggagaccaaatttcctcaagtcagacaaatgagtgacaacagaatcaggtcttctccaggcagacagtgggtggggttcccttctgtgttcttccctgcccccatgactctgggcctgtcttctgtgccccaccctggacctcaataacatgtatatgatgtcactgtctagatgtgcaacagccttggcaaatttcatccagagccctcaaacacagattaaaaaacaaatctaggccaggcacagtggctcatgcctgtaatcccagcactttgggaggccaaggcaggtggatcacttcaggccgagattttgagaccagcctgggcaacatggtgaaactctgtttctactaaaaatacaaaaattagccaggtggggtggcaggtgcctgtaatcccagttactcaagaggctgaggcacaagaatctcttgaacctgggaggtggaagttgcagtgagccaagattacgccactgcactacagcctgggcaacagcacaagactctttcttaaaaataaataaattaattaaaaataaatccatagcatttgcacagacccttataatttacaaggcagtgtcatattaattctcagttaaccctcctaagtagcctaacaagttaggtggcgtagagattattatctccattttacaaataagaaaactgaggctcagagactagaagcgatttacccaagtcacacagtgttcttctctttttaccatttggatctagtcttgggactagatgggaattcaaatggagattggccaagctcaagccgaccttagtagctgatgatctgagagctttcaaagaactcacatctttcttatctcacttggttctcagaacaatctcataggattaacaaagcaaatataatgtcaccagagattggatcagaattagtccccaattctgattccaatgctctttccatacactaggggaggccttcccaccactcatactctactgctgctcctttagtcttaaagggtcaaaaccaaaagaagatcgacacccttcttttgtgtgtccacacaagtcctacttaaaatgacttttaatatcactatgtgctcccctgccaaaaactggccctacaaacagcccttctcccttctggttttaggattactttactgtcacccacccaagcgggagtgcagtggggccatcatagctcaatgcagcctcaacctcctgggtaaagggatcctcccacctcagcctcctaagtagctagaactacaggcacgtaccaccacatccaggtttgttttgttttgttttgtttttgagacaagagtctcactctgtcgcccaggctggagtgcagtggtgtgatcttggcttactgcaatctccgcctcctgggttccagcgattctcctgcctcagcctcctgagtagctggaattacaggcacgtgccaccacacccagctaatttgtgtatttttagtagagatggggtttcaccatgttggtcaggctggtctcaaactcctgacctcgtgatccacctgcctcagcttcccaaagtgctgggattacaggcgtgagccaccacgcctgaccaacaccctgctaattttttatttttatttcttgtatttttattattttattctttgtattgtttatatttgttgcccaggctggtctcgaatttctggcctcaagggaacctcctgcctcagcctcccaaatcactgagattacaggcatgagccatggcgccaggcctagaactgattctttagaactcaaataccagagagaatagaatctgttcactcatttagcaaccattttctgagcagaataacacactaggctagtcatcaggagtttaagaaatgaatcagatatagtccctgctaacaagaagctcacaatctcgtggaactgatgaaaacactcttaaacacatgatgagataaaataaatgtcacaataaagttgtaaacaaaggactgcagaggaacagagaagacagcaataatcctaactgatgagaagaaagtgtcttcatgaaaaaagaggcatttgggctgggccttgaaggatgaatggggactcctgacgagtaggaagatgcaggctgagaaaagagcataaatatttggataacagggatgtctccccaggaaggccacacaaagtgctgcttggccctcaacctcacagtaacactagctgggatccagctcagaccctcaggctagatctaggtggatccaacccccaacttgaggaaacccaagacacctagagacaactagacaccacttgctcctttctcttttctcttttgttgagacagagtctcactctgttgcccaggctggagtgcagtggcacaatctcggctcactacaatctcctcctcctgggttcaagagattctcctccctcagcctcccgagtagctaagattacaggtatgcaccaccacacctggctaatttttgtatttttagtagggatggggtttcaccatgttggccaggctggtctcaaactcctgacctcaagtgatctgcctgccttggcctcccaaagtgctgggattacaggcatgaaccactgcgactggccacttgctcccttttttagggctctgcagtatctacagcctataccatcaaattcttctttttttttttctgaaactgagtctcactctgtcacccaggctggagtgcaatggtgtggtctcggctcaatgcaacctccgcctcccgggttcaagcaattctcccgcctcagcttcccaagtagctaggactacaggcacttgccaccatactcagctaatttttgtatttttagtagagacagggttttcattatctggtcttgaactcctgaccccatgatctgtccacttcggcctcccaaagtgctgagattacaggcatgagccaccgcgcccggcctcaaatttttttttttttttttttttttttttgaaacagggtcttgctccatcacccagactgcagtgccagtggcgcgatcatggctcactgtagcctcaacctcccgggtagctgggactacaggcatatgccaccatgcccggctaatttttttttttttttttttgagatggagtctccctctatcacccaggctggagtgcagtggcgtgatcttggttcactgcaacctcagtctcctgggttcaagtgattctcctgcctcagcctccctgagtagctgggactacaggcgcatgccattacgcccagctaatttttttttttgtatttttagtagagacaaggtttcaccatgttggccaggttggtctcgacctcttgacttcaggtgatccacctgcctcagcctcccaaactgctgagattacaggcgtgagccactgcgcccagccaatttttgtattttttgtagctagggtttcaccgtactgcccaggttggtctcagactcctgagctcaagccaaccacccaccttggcctccgaaagtactaggattacaggcatgagccactgtgcccaccgtgtaccaccaaattctaaccgccctcttaactactttcattttctcttctatagttagcttttgtgttttgctttcccaactactctaaagtaccagtctccttattccttgagaacatagccagggggcgtatatatcctgtcacagctactatcaggctaggcacaccacagacactcccaacctatttgttgacagctaaagtctacaggcctaagaatcacaagatggacagggcacagtggctcacgcctgtaatccctgcactttgagaggccgagggtgggggggggggtgtggatcacctgaggtcaagagttcaagactagcctggccaacatggtgaaaccctgtccctactaaaaatacaaaaattagccaggcgtggtggtgggagcctgtaatcccagctactctggagactgaggcaggagaatcgcttgaacccgagaggcggaggttgcagtgagccgaaatcatgccattgcattccagcctgggtgacagagcgagactctgtctcagaaaaaaaaaaaaaaaaaagaatcacaagatgactgtcttacaagcaagtagagcaagaaaaggcaggatgtgtaaccctggccaggaatagaaacagtgaaggaattaggagaagggatatacttctggtttttggattacatttcatagaaatggtctaaatttaaggtgctcagacttgctcgatgactatgtggcactgccctgtatctcaccttctgctcttagaccaaggtcacaagctcagtctttaatccattttccgacttcctgcttgtcaatatctcccattgagacatggtgtctcatctttcctcctaaaaagagtaacgggaaggatggcatagatgccagtgccaatctggagacctcaaatccaatgccagaggagagagggggctggaggtgggggtgggaaggactctgagacagataacagcttcctcctagttggtctccagtgagctgagactcatctgaagtaagacttcagggatgaacagaacagataaacagggaaatcggattggttcaaaacccaaacaggtcaccatcccccaaggatgggtcatgaacaaccaattaggacaatcagctaggagtagggtggggaggaggcaggtataaaaagcgccaaagcagcctggcctggtggctcatgcctgtactcccagcactttgggaggccgagatgggtggatcacgaggtcaggagtttgagaccagcctagccaacgtggtgaaaccctgtctctactaaagatacaaaaaattagccaggcatgttggcacatgcctgtagtcccaactactcgggaggctgaggcaggagaatcgcttgaacccgagaggcggaggttgcagtgagccgagatcacgctgctgcactccagcctggctaacagggagactctgtctcaaaaaaaaaaaagatacaaaaaaaatgagctgggcatggtggcgtgtgcctgtaatcccagctacctgggaggctgaggcaggagaaccgcttgaacccaggaggccagaggttgcagtgagccaagatggcgccattgcactcagccctgggcaacagcgcgagaccccatcacaaaaaaaaaaaaaaaagaaagaaagaaagaaagaaaaaaaaaaaaaagaaaagcgccaagcactggtgggttcaggagcataaaactttgattttaggtattatccagtccagctctcttctgtaataccgtagtggaggtcctcaaactttccttcctgtaatagtctaatcttcttctaaccggtgtctctctcttcctctttgacccttttaattcatcctccacgttgcagccacagtgatctttctacaacacagagctgatcatgtcttgctgccctcaggataaggtccgaagttcacatgttctaccaaggcccttgactcctgagaccacacggaccttcaaatcttgtctctcttcaccctcacccttctctacattcctctgacaatattccccaaagatgcaacagacttactccagtctgccaaaggaattccagtttcaagggctagctcaaatgtcatcttttcaattaaatctaacctgactcactcacttcccctaggatattagtttctcttccatacttcaaaccaccttagtgcagtattgcattcattaccctgacttgtattcatttgcagagactgagagaccatcatggtgagggacagattttgacttctcataaccctttctgtccttagttagcacagcagaagtcagcggtccaaaaaaaaaaaagtttaagccttgtgcggtggctcattcctgtaatccaagcactttggttggccgaggcaggaggatcgcttgagcccaggagttggagaccagcctgggcaagatggtgagaccccacctctaaaaaaaaatttttttttttttttaattagccaggtgtaatgggactgtagtcccagcttcttgaagaggctgaggtgggaggatcgcttgagcccatgatggcatcacttcactctagcctgggtaacaaaacaagactctgtctcaaaaaaaaaaaaaaaaaaaaaaaaagtttacttaaagaatgaatgctcttagactaggcgtggtagctcacacctgtaatcccagcactttgggaggtcgaggcaggtggatcacctgaggtcaggagtttgagaccagcctggccaacatggtgaaaccccgtctactaaaaatataaaaattagctaggcgtggtggcatgcacctgtaatcccagctactcaggtggctgaggcaagacaattgcttgaacccggagggtgcatgttgcagtgagccaagatcgtgcaattgcattccagcctgggcaacaagaacgaaactccatctcaaaaaaaaaaaaaattgaatactcttcctttataaacacacagtgagctcctggaagagcccaggtgagacctgggtcatctgatacccagatcagggcactgctttctgaagctgctgattctgcctgttctccatggccattcagctggatggctcctcactgacctggactttgaaacatcagtacggtgacaggcatttgcagaagcaggaacccaaactgctgtctctaaggagagcctctgtgcttgtcctagggaagtgttttgattcccaagggctttgagctgcactgtaggcggccacagagcaggtgagtcatcccagcccacacccgttctctgcggaagggccctagcatctgtctgtgttgggtgttatgggaaataggtgctctgaactgactggggtcccagggagggaggactgccactatggccaaggtttccctcatccccagtggtgaaagcaggaggagtgatggccttcgtctatcagaacaaacataaagggacttgggagcacaagtgatggcctcagaaaagctgcagcatgtgataaaagtctagggacacagctcaccactctgctgggccccatctggagagtcgaatatgtagggtctggggggccttttacctaagcagcctgttccccactgcctgccctcattagtgtctcttcacttccccaaattcaaagctctcttgccagacacagtggcttatgcctccaatcccagcagtctgggaggccaagacgggtggattacctgaggtcaggagttcgagagcagcctggccaacatggtgaaaccctgtttccactaaaaatacaaaaagtagctgggcatggtggcgtgtgcctgtagtcccagctactcaggaggctgaggcaggagaatcgcttgagcctgggaggtggaagttgcagtgagccaagatcatgccactgcactccagcctgggtgacagagtgagaccctgtctcaaaaaaaaaaaaacaaaacaaaaaaaaacccaaaaacacaaatttgaaactctcaaggaaaacacaaggaatttctccctaggagtgccctaccatcacgctagactcaaccaggacatttatcatacagctgaatattgtttttaagcaaagttaacatgtaaagtagaggaagatatcttcactatacaaacccttttccccataaagggctcccctgatgcgtgcattcactggcggcttgctagtttaaggtcctggaaagattcaagtactattgcagaataatccctgtcccccacaacaaagaaaataaatcacatgcccaaattactgtaacacaaggagtaacgtaagaaatccttcagggaagggtaacaaaggtaagtttgggaatctggaggcaaatgagatccaagggacacaatgggggaggtggcactggaactgggcttggatgttgccattcagaaaccggtgaaacggcctcccagatggaggagccatcagcagcaaaggaatagatggatggaatgacagacgatggatggaatgaaatgttaggcactccacgtggaaacccacaagggtgagctgaaacagcaccttccacacactcgagccccggggatacaagtaacggcacaaggaaaaggctctgacttgcaaaggtataagataaacccaaatactgcagcagcagggtttattctttcttttttttttttcaagacggggtcttgctatgtcgcccaggctggagcgcagtggcctgatcacggctcactgcagcctcaaccactgcacccggccacgccctgctaatctgtttttaattttttgtagagatgggggtctcactgttgcccaggcacagggtttattctgagtgtgaagggtgttagaatggactttgggattagaccagagttcaaatgccagctctcctcttaacagctgtgtaatattccacatgttccctaaccagccttagttttctcagctgtgagctctctgacttttttacctaataaattgctatgaaattaaatgaaatctagatatgaagcatctggcacagcatgtcaggcacatagcatgtgatcaatacatatcaggttccttttccatgcttgaggggcttagattatgaacaacaactgaaagacttcatgggaccctccaggaaagaagaggccagtaaaaaggggacacggcagtaaagcaagaggaaggcatggaagaaatggctcggcgctttccagcagaggtttctgctccacagcaggccacttgcagggtgctggtgaaactcacccaccaaactggttgttggctcatccctgaatgctgtgttccaacagcagcaccagtgatgcaatcagcagaactgagctcgtgggtggagccgtggggaggagttgagcagggagagaggtagcaccctgggcccctgcccagactgtggggtattaggaataaaggtgtgggtaaagagggcttcagagagacttttgtttgtttgtttgtttgtttgttttgagacagagtctcactctgttgtccaggcaggagtgcagtggcacaatcttggcacactgcaacctgtgcctcccgggctcaagcaattctcctgcctcagcctcccaagtagctgggattacaggcgcccgctaccatgccctaatttttgtatttttagtagagacggggttttgccatgttggccaggctggtctcaaactcccgaccttaagtgatccgcccacctcgggattacaggtgtgagccactgtgcccagcccatactcttttttaaattccaaaagctaacctccactaggaaagccaagcacaagtccaaggcttttttcagactttcatgcctgcccttttcacctgaagaagctggcctattacaggccaacaggagacacagcaaaaggcacagggctcatctctgcagagaccctccgagtcccaaggagaagaggccccgctaaggctcctcagggaggtttactatctaaccctatttatgtctgctcctcattcattcattcattccacaaacattcacaggggaactactatacaccagataagactctggacgggaaaatgacagcttagctgttcatacctccgtccctcaagctgtttcactagtcagtttctttatctgtccaatggaggaaaccgggtttatgggaagatgcaatgagataatggacatgcctgacacagactaagtgtctaagaaacgtaaactatttttatggtagtagaagcaagattgcctgtgacgctgtatatctttcatttgcctcttcaggtacatttctccttttccatgctgcactgcaccctggaattggcctgtatgcgctgcatcgagatgctcttgccctctgactgccagctgggtttggtccatgtggagcctggaatcaaaaccagagggagaaggtggggacagggtttatggtttttattcctccaagtccctttttgagctccttgacttaaagtcccagctctagtgagatcgccctccacacaacctgcctccaggtgcagaggtggtaagatcccactgtcaccagccccagaatattccacattccatagcagtttccctatatcctgcctcaaagcccccactttaaatgtccccaatttaatctgttttctgctggatcctgactaatacaaagagtgtagagaacaagggcaggcctgggaatcgggagacctgaatttaagtctcatctttgccaccagctccctccgtgaccctgggccacatttttccatttccaggcctcaaacttcctcaattttaaaatgagtgggttgggtccggacacagggcctcatgcttgtaatcccagccctttgggaggcggagacaggggtattgcttgaggccaggagtttaagtctggacaacatcgtgagaccctgtctctaaaaaaaaatatatatatctatatatatagatatataatagacatatatagtatctatatagatatatagacacatatatagtgtatataaagatatatagacatatatagatatatatagacatatatagacatatatatagacctatatagactatatatagacatatatatagacctatatatatagactatatatatagacatatatataggcctatacatagactatatatatagacctatacatatagacacagactatatatatagacctatatatagacatacagactatatatagacatatataagacctatatatagacatatataagacctatatatagacatatataagacctatatatatagacatatatagacctatatatatagacatatatatagacctatatgcatatagacatatatatacctatatatagaccaatatagacctatatatatagaccaatatagacctatatatatatagacctatatatatagacctatatatatatagacatatatatagacacacatacacacacacaaatgagtaggctggactatatggctctttcatgatccaattccctgccacttctaggtgttaagttacaggaggaggacacagatgagaataaaagctccctagtgaatacggcaatgatggccaggttggccactaagcagctctccccactctccaccattgtatcagctcattcttacccagaagtcacctaactcctttccaaggactttccttctcttctcaggccatcagggtaccagatgtctaaatgatctccactccaaagcaacagccaagaaaacccaggaaattaaaaataaattcctttttcctttcagtaactccctgcccagccctgggttagctggagaggtcccttcccaggttccagtatacccagggggccaaacagggaagccgttccacactgacaccaaaacactctcacagggagtgatctatctctgccctgggaaatgctggggacacagctggcttgcagggcagagggagtgacctaaaccagcatcctgtcagaagacatgcaatgccctgcattgagatccctgtcactgggcaggtttcaaagagaggccaggcagggtgcggttgctcctacctgtaatcccagcacagaggctgcagcgggagaatcgcttgagataagacgtttgagaccagcctggcgacagagcgagaagcccaatttattttattttatttttgagacggagtttcactcttgttgcccaagctggagtgtagtagcacgatctgggctcactgcaacctccacctcctgggttcaagcgatcctcctgcctcagcctcctgagtagctggaatcacaggcctgtgcctccacacccggctaattttgtatttttagtagacgggttttaccatgttggtcagactggtctcgaactcccaatctcaagtgatccacctgccttcgcctccctaagtactgggattacaggcgtaagccacagcgcccggtaaacttttttttgttcgtttttgtgtttaagacagagtctggccttgtcaggcaggctggagtgcagtggcttgatctcggctcactgcaacctctgcctcccagcttcaagcaatcctcctgcctcagcctcccgagtagctgggactacaggcgcccgccaccacgccggctaatttttgtatttttagtagagggtttcaccatattgcccaggctggtctggaactcctgactttgtgatccgcccgcctcagcgtctcaaagcgctgagattacaggcttgagccaccgcgcacggcgttagcaaaaattctttcaaataaaaaattagccaggtgtaatgatgcacacctgtagtcccagctactgggaaggctgcggcaggaggatcgctcgagcctgggagttttgagattgcagtgagctgagatcaggctactgcactccagcccgggcgacagagcgaggctccgtctcaaaaaagataaaaaagtaaaaacctaaattagccgggcatggtggcgcgcgcctgtaattccaagtactcgggaggctgaggcgggaggatcacccaagcccagggagttcgaggttgcagtctcaaaaagaaaaaagagtagaaaagagaggaagaaggtaggaaggaaggaaggaaggaaggaaggaaggaaggaaggaaggaggaaggaagggagggagggagggagggaagaaagagaagctaatgaccacttgatcctcgtaaggccttttcagttcctaaaatgactgattcaggaaaccccaagagccacaagagtcattctattcagatgatgaccctccctgaccctcctggtttctggagttttcattcgctaagggctgcccttcggttttcaattactggcggagagggcggttcgtttctggcggggaagggaggtgacattccggtaggagaatctcctaaaactcgcatttcctgtttgccctgggcgccggcctcaggtggaaacctcaccccgataactgagggcagcagtcggccttgggcgttcttccgtcacccaggtctccagaacctcccggactcaatggcaagtcactgcacaagttcagggccttttcggtcccgatcgaggatctggagatctcggggcttcccggtcgtctgccccacagcccacgaggcggaccgacctgcggggtgaggcaccgggagcgcatggcagccccggcctcggcctcctggcgccctcccagccacgcggtgaatgcctgagaggacagaggttcgcggccctccccatcccaccggcagcgaccgcaaagcccgggagctgagtccgcggcgtgaagcggcggaggtcagcagcgagggggcagggccggcgctggcggccacggagcttgcgcgtcgctgggctcggaacccagggacgcgagccagcgctgggagctggcggagagacggctctgccatccggctcaggcagtgggcgcccgccccgcccccagcgcccacgcgactccggccccgaggctctcccgagcgcagcgttctggaagcgccgccgctaagcgtctgcgtctgcgcctgcgctgaccccagtcccggactcggtccgaggcgcgcagcccggagggggcggggccgagcccgaagggaaggcagtgcgcatgcgcggggcgagccggccggcactgtcacagctgagcggccgcgagatcggtccctgtccgcagggtcgggtagtggccccctcggggacagcgtgtgaggattcgggcgcgaaggacggggtcagattcagccaggtgcccactttccccacggtcacgaccctggtccagaactgccctgccccgggcctcagtttccccactaaggagaggaggcgtgccggggaaatctgaggccctccccagccgcgaccttttccctcagacgaaggaagagtggtcgtacccggccgcgatcaccgaagcctccagccctgtccccgcacggatgctggaagcccgtccacgccgcgcggggagtggtggcccgggtgctcctacgacctgggggccctgtcaccgcgatcttaattgattcccaaaggatccagaaaagggacacattggcgcccgcccagggcgggcggggtcccccgggcggccaggccgatggggtggatgggcttctgctcgcggccgccttgtggggcgctggcatcggattggagtggggcagcatcgggggaggacagagaccccacgctccccccaacgcagcagacccaggggcaggcccttggctcctgcatgccacgctccggcctccccatatcgccctagcaccgctgcccgctggtcttcccttctcagaaacctgcagtggcctcaggcctagactccctgggcttcccctgaaggcccagtattccctaattcacctcctctcaccttggctgctcttccattcccttatccccgccacacacagcggtcttcccttgtctgcgtctgggcgccctcgatcttcccgtgctccacccccctaatctgtgacccaccaaacctgcccatccctcaaagtgtagctaaaactccactccttccccaaccaaactccatagccccacagtgtgtctcagtattctctgaagagccctgaggttgtgtcaattgattcttctcaacagaagtaatccattacataatttatcaacttatatgcattgatcaggctttgcaaataattacatttgcaaatgagaaagacagtcctttgccagacccctgtatcctgatttgcaattgtgcgctgtatcccttactagatggctacatcccccaggggagagactatgccttaatatgcagaatatctaaatttttttggaatcgtggtgggaaaaaattaagaagtttggaaaaaatggaaatataacatctttttgcactcttcacaatacaaaatctcatcttttagtgggtctgaaaaatatacagtgcacaatatgctgtcagctctagattaccgcaaatcaatgtgatggaatagagtagaaaggatattgggatgggtacgaaattggccttttggtgtggtttgtcttgcattagcagagtgaactcaggccgaactcaggcaaaactgcacctctgtagatgcagtttccccacattagatttggatttaggaataagaaatatccctgcccccatctactttacaagatcatggtaaagatcaaatatgaaatggagatggagttaagatttttttaaagtatttttttgttcaggaaataatcctcagtaaattttctaatgaaaattactttatatatatatatatgtgtgtgtgtatatatatgtatatatataattttttttttttttgagacggagtctcactctgtcacccaggctggagtgcagtggcgccatctcggctcactgcaagctccgcctcccaggttcacgccattctcctgcctcagcctcccaagcagctgggactacaggcacccgccaccacacccggctaatttttttttttatatatatttagtagagacggggtttcaccgtgttagccagggtggtctcaatctcctgacctcatgatccacccgcctcggcctcccaaagtgctgggattacaggcgtgagccactgcgcccagcaaattttttatatattttatatataaaaaatataaaatatatatagatatatatagagatatataatatatatatatttttttttgagacagagtttcgctctgtcgcccaggctgtaatgcagtggcgcgatctcagctcactgcaatctccacctcccaggcttaagcgattctcatgcttcagcctacaagtagctgggaccaccggcatgcaccaccacgcccagctaatttttgtatttttggtagagacggggtttcgtcatgttggccaggctggtcagcattctacagacaacctcatgtcacatcacactactctcagtttctatttgttttgttttttaacggagacaggttcttgctctgtttcccaggctggagtgcagtggtgggatcatggctcactgcagcctctacctcctgggctcaagcgatcctccaacctcagccacctgagtagctgggactacaggcacatgccaccacacccagctaattttgttgttgttgttgtagagaggaggtctcactatgtttcccaggccagtcttgaactcctgtcctcaaatgaccttcccaccttggcttcctaaagtgttaggattacaggtgtgagccacctagcccagccagtttgtttttctaatgcttttttattgcctttactttcttctaaagaaaaatgatctgaggtgagaggatcacttgagcccaggggtttgagactagccggggcaagatgacaagatcccatctctctaaaaaaaaaaacactcagcctggagtgtagtggtgccatctcagctcactgcaacctctgcctcctgggttcaagcaattctcctacctcggcctcccaagtagctgggatgacaggcaccctccgcaatgcctggctaatttctgtatttttagtagagactgggtttcaccatgttgaccaggctggtcttgaactcatgatctcaagtgatctgcccacctcggcctcccaaagtgctaggattgcaggcatgagccaccgcacccagccaaaaaaaaaaccttttttaattagctgggtgtggtgatgtgcacctatagttccagctacttgggaagctgagctgaggaaggaggatcgttagaggccagtaattcaaggctgcagtgagctgtggttgcatcacgtcacccagcctgggtgcagcctgggtgacagagtgagaccctgtctcaaaaaaccgcacagacaccttctttactcccccaaacccacttattcactctgatggcacacgggtgatgagctcctgtgtgtcaggcactgtgctaagtacctggccacctgtttccccacactcatggactttacatatgtatttgcacacaccttttgcatataaccatgtgtaacccccatggattcagatgatacatccacttacccttaaaaatactccattcatgcccctcactttatctatgtttatcctggtcccggattgtgctttctccgttttctgtttctgtttctctatcatcttaatggcagacaatgtgaagatggtgaggcttgtgaaacagtacaattttgaggcagattctggcatattacttaacatttatctttaaaacagtcctccttcttccaggcaagagctctggatttctcccgggaaagggtggaagagggacgcagggttgggtgggtgaacaggagtggccttagttgggtcatgttgctcagttgctcaaagaccaaggactgcagactctccctttctccccagggcccagttttttccctttcaaaacccgctgtctacctgcaagatggctcacatctctaatcccaacactttgggaggctgaggcaggaggatggaataaggccaggagtttgagaccagcctgggcaacataatgaaacctcatccctacaaaaaaaaaaaaatgtttttttcaattagtcagacatggtggcatgtgcttgtagtcccagctactcagaaggctgaagcaggaggattgcttgagcccaggaggttaaggctgcaatgaactatgatcgcgctactacactccagcctgggtgccagagcgagactccgtctcaaaaaaaaaaaatgggtagatgtggtggctcaagcctgtaatcccagcactttgggaggccgaggcaggcggatcacttgaggtgaggagtacaagatcagcctggccaacatggtgaaaccctatctctaccaaaaatacaaaaatgagccaagcatggtgttatgtgcctgtagtcccagctactcaggaggctgaggcaggagaatcgcttgaacccgggaggcggaggttgcagtgagctgagatggcgccactgcactctagcctgggcaacaatgcgagactccatctcagaaaaaaaaaaaaaaaaaaatcgaaaacaacagaaaaccagccgggtgcagtgactcatgcctgtaatcccagcactttgggaggccaagatgggcagatcacgaggtcaggagatcgagaccatcctggctaacgcagtgaaaccccgtctctactaaaaatacaaaaaattagccgggcgtggtggcgggcgcctgtagtcccagctactcgaaaggctaaggcaggagagtggcgtgaacctagggggcggagcttgtagtgagccgagattgcgccactgcactccagcctgggcgacagagcgagactccgtctcaaaaaaaaaaaaaaagaaaaagaaaagaaaacaacaaaaaacctgttctcaagcaagatgtgaaactccttcgaagaccccagaagtaaaacataaaaattaaacgacctctgctctgaagaggatactagaaacaggaaaatgtgatagaaagggctcagggagtcaaggacgcgttcaggtttctctaaagacaggtccaagcgggaggctcacgtccacacttcgtggaggaggagaacactttctggtgaagccaaggggaggtggcagccttaccattcaggaaacctttgtgccctcctccactggagccctcagttatctaaggcagctgcgtggatgcccaggggaatgaggcattgaggtgctgaggagagagcagttctttaagtttcagaggacaccacgccttcctgggcggctgagagagcaactcagcctcagtcccaaaaaaggtcctggggcatccagctaacacaagggtgggcaatttcttaatttccagtctctccccaaggaacttacacatgagttaactctaccagataaaaggaggatgaagagagtaacctagctggagaccatgagaaagcacgcggtgttaaagagagatcggaactttattgagactgatgaaatcagaaccaaaagaacactggaaaggttctgccactgtccaggcacagatccttccagacactcctcttgggggaatctctggatcattaagtttcccccagttcctaatcccccaccccaaagagtcagaattctgcttaaagccccctccacggagctggccagaaaccagacactgagtatctgtactgactgatgggcaggcctgtgagcagcagagacaagagaaatcagagaaggaacacgaaaaggaaaacatgacggaaagaaaagcccaaggcagggagagcatgctgataacgcagccccctgaaaatataaatattgcatgaatgtattagcctcatcccagccatttcccccaaagcagtggtgacaccaacagctatgacaatgcccacacagttgtgcatctttttttgtttttcccctgactacacagaaaaacagatctgccaaagcagctcacagcatggaggagcaggcaggggaaagtgggagggcccatcccccaagagggcagacagtacagagatgaggcgaggggttctggggtttgcggagggtggttaatgagaagaaaagtccaggacagattccatctcatcagcccctatcacaggctccgtggatgccccttgcagaactcactgttctttcctggtcgactcgttccttggaaacattgtcctgagtgccctggaacctcgggtgttcttgtggaagggtccaggccctccacaaagccaaacgcaacggcccctgtgacagcatgcaccagagtgataacaattctgagaaccgggaattcctaactcgaggttctcctcatagacctaacctgactgccaactggcttaccctgcctgacctcagagtgcctctccctctgcctgcctttccactgtcctgggtccaggatgacttcctggtgctgagctggtgcatcctgactcctgcctcgtgggtaaggcccccaggacagcttgttcccaagagaagcggctggctgtgtacaaaggagcccctcgaggcagcccgggctgggtctcctgggcatgcacagactgtgcaccatgcacatttcaccatccaaaggctgcttcttccctgcaggtcctgcccctctgctccccaccacctgctgtggagccgtgcatgctagccttgcaagactgttacaagttctctactccctagagtctatgtgatctccctaatctctcttggacaacatacacacatattcacacttattggtattgaaggccctggctttcctgcggtgtgttcagtggacatctgcatcaaggtcaggcgggaaggtcaatgttaagccttggtggccaccgacaccgagtggctggtgctggttctgactcctaggaaattgctccaagtaagtgttgatgcatcagggaatggagaagaaaggaaaggaaaagccatggtgtggaaactgcaaaggagcaactccgctgccaagtgtttccacaggggagttgtggaaacagcctcctctgaaatttgagagactggcggcctaaggaaaaggagcaaggtctccactgtcctctctgaaacccagcgcctttgggatctgagttttccaagacatgcaatagacaaagacgcactgcaaaccaattaaccctctgagcccttccacgaccttcactacagtcacttccaagagtaaattacctggatacaccaaccagtcccctcctgggtccgatgaagggatcgagccctcgagccagctttgaggaacacatcagagaagtggcagtgggggaggcagatccttgtccttcctgggaactcctgttcttagttgtcgagtgtcctaaaccactgccccaccccttgaggaaaccaggagcaagtccgggggattggctcaaaacccaggtggaggccgggtgcggcagctcatgcctgtaatcccagcactttgggaggccgaggcgggtggatcacttgaggtcaggagttcgaggccagcctgggcaacatggtgaagtcccgtttctactaaaaatacaaaaattggctgggcatggtggtaggcctataatctcagctactcaggaggctgaggcaggagaatcgcttgaacccaggagggggaggttgcagtgagctgagattgcaccactgcactccaacctggccgacagagcgagactccgtctcaaaaacacaaaaacaaacccaggtatattcagacccaagagactattcactgttgaaagtcaacccaaagttaagaggcagccgagggctggggaacaaacgcgagactgtgggtgtggaaagaagccaaaatggacctgacaatctctacgactcaggccttcgctgttttcccagctcacagggaacaaaggaatttcagctgcttttagcttatttgaccctcactgatttaagatacactagaatttagctgctctctgtccttccaagacaggacccaggaaaagcaggtggaggctgacttgcctcaatcaggcctcctcattgaagcaacaagacaagcacacaggaattcacagtttccactctcctccctagacccacacacctgccccgacccctggcctcaatgaactcccaactctccactgtgtaataattcctgccagtgtggctcaaagggttaataaaccaggacctctcagacagttaggacacaagctgattcaccaacaggaacccaaggaccgctccaccacctagtgcttcctgtagcgattttttggtgtttcgctacaccctgttttgtcacagttgagagcacctggattcttcccgagcccgaggctacccaggaggcccggaagctcctgagtgatggcccgctcaatcttctccagaaagcaacctcccatgtaggagcactgctgggagagcagtttgaaactggaaatgggattgatgccgaagaagtccttataggcctcgcggttgggaaggtcaaatttgctgacattggtctttgccaggatggtcttgaagatgtagaatttatcgggatcttccacaatgtccttaaagaccagttctccatcactgaagaaggtcattttgtccttgtaagtctgcaggtagcggtcaaccaggagggcgtggatgcggacccggatggcgtgctggcggatgaaggcaatcttgttctccagtctgttctcgatcacctgattcaggtcttctaggagggagatctcttcttggaggaacagttcctgatgggtgtccggcttatactcttgtggccagaaggagctgacgtaaacccttgggggctctgtgacattgatgagaggggccaagctccagaagagggccccgtaaacccgcatgagcatttgggtggccagattgtcagccttgttcaggatgatccttatctgggattcacgccccttcaactggcggaagagcatctccagctctagacccacatccagctttgttgggtcaaagacgacaaagatgaggtcagctctgtcgatgaaccactggcacacgtcgttgaaggggtagcctttgggagacagaagtgagaagtcaaactgagtaggcctccctcaaagcccgcgcacctcctttcagaactaaaccattctgggggttgaaagaaggaacagcgctacggattttctgggtttctacagactattaaaaaatcaattgcatatctcctgtcccttgccaatcttcaaccaagaacagcctgatccttgtttttcttgttggtttgttttttgagacagggtctcactctgtcacccaggctggagtgcagtggcatgattatagctcactgcagcctcaacctcccgggtttaagaatcctcccacctcagcctcccaaagtgctggggtaataggcgtgagccaccatgccccacctgatcattgttttaatctactgtgaaatccaagtttccaagaaagctaaatacctgttcaaaatggagattgtcctattgtctaaaaggatctggggcaatggcaaagatgctgagggagagaaatgaggaattagaagaacatgaaagaatgaatgcattatttacggggaaggaatgtgggcttagcattgagacctggactagaatttgagctttgcccctggcgagctgtatattaaatgcctctaagctctacctttttagctccaaaatgacaagaagaacaatatcaacatctgaactgatataaagattaccatgttgctgtaaatataggacagcacctaaaattccagtcatacagctggtgcagaatacattttaattccattagcttcttatttcctagttttctttgcaaataagaaaactgaggagatgaggactacctgtcttaaaaacattgaaatctttttttttttacaataatgtataaaattatccaacgtgtagtaggggtacaatttactattataattattaacattattaacattactaataatactactaatgtcattataccataataatataattaaatatactataatattattactaatattactactaatattattaattgcttctaatattactgctaatatcattactacaagatctatttataaccacaattggagttgtaaccataaactgagatccaccgtctgctcacacattcctgcactgccctgttcaggactcactgcagacagccttgcctcatggcaggactcagtggcctactccatagccacatgcctggtggatctggcttctagtcttgtggcctggttgtcagccttgttcattaaatacattcacactgttgcacaaccatcatggccatccctctctggaacttattcatcttcccaaattgaaaattctgtacccattaacagtaactgcccatctccccttccccccagcccctggttaaaaccactctggtttctgtctttctcattttgcctactctcatgtaagtgaagtcagacattagcattcccctgctacctgagggcaagtagggctttgaagaagcctgctaaaggcttatggggaagcaaccctggaaaagcagaaaccgggaataggaggagttgaaggtcaggttcaacctacagcaggcccaggagcaccaaacccaatttagccagaagtcaaacatactggtactgggatccaattagtccaggcccttggctacacaggacacacagggcctcccaaagacaactgagccccagcttgaacctctcagagctgcttgcagagaggactaggcccccactttggaaaatattgccgtctccaaaccaaatcagtccttggggaggtaggagcaccaggcactccaaaacccagatggcatcgcagtaacgacaagaagggtggaagttaagaatgcctctcctggtcttaggcaacactgggcacacttcctctccctgcctgcctaccacccactgtcaaaagtagttttcttttcttcctttttttttttctgagacagagtcttgctgtgtcactaaggctggagtgcagtagcatgaccacagctcactgcagccttgacctcctgggctcaagcaatcctcccaactcagcctcccgagtagctgggactacagtcatgtgccaccatgccaacctaatttttatattttttgtagaggcggggttttgccatgttgtccaagctggtctagaacacctgggcttaagtgatccacctgccttggcctcccagagtgctgggattacaggtgtgagccactgtgcccagccttatttattcatttatttatataagttagggtctcactcttgcccaggctggagtagagtggcacgattacggctcattgcagcctcaacttcctcagctcaagcaatcttcccacctcagcctcctgggtagctaggaccataggcacatgcgaacatgcctggctattgtttaaatttttttgtagagatgaggtttcactatgttgctcaggctggtcttgaacctccggcctcaagggatcctcctgtcttggtctcccaaagagttgggatcacaggcatgagccatcatgcctggccaaaaataattttttgaaacagagcttacactgttcagaaatgagggctaaattacctctttcttgctgcttgcggttctcgatgatgcctggtgtatccacaaaagtgaccctctccagaagtttgtggggaacctcaatgccaatcagcttctctaggaaattctggccaaacttctcaaggggtgagaaggaacgggcgctgtcagcagccatgacgatgccctcgatggttttcagcttaggcccatgcatgaggaccgtgaactcagaggtggtgggttcagcgcctgggcacacggggtgagaggtgaaggaatacatgatctctgtgaaacagatctactgagaagcatgtgtatatgcctggtgtcacagggagacttttgcaacagaattggatatgtttgccaagctattggggctttcttttaattgtggtaaaacatacataacataaaatttaccttttttttctttttgagatggagtcttgctctgtcacccaggctggaaagcagtggtgcaatctcagctcactgcagcctccatctcccaggttcaagcgattctcccacctcagcctcccgagtagctgagattacaggcactcgccaccatgcctggctaatttttgtatttttagtagagacagagtttcaccgtgttggccaggctggtctcgaacttctgaccttaatgatctgcccaccttggcctcccgaagtgctgggattacaggtgtgggccattgctcctggcctaaatttaccattttaatcattttaaagcatgcagttcagtggcattaagcacattcaccctgttgtgcaaccatcgccaccatccaggtccagaatgtttttatcttcccaactgaaaactctgtatccattaaacagtcattccccatttcctcttcccccagtccctggttacaagcactctggcgtctctctctctgattttgccttctttttttttttttttttttttcctttttggagcagagtctcactctatcgcccaggctggagtgcagtggcatgatctcagctcactgcaacctccgcccccgggttcaagcgattctcctgcctcagcctcccaagtagctgggattacaggtgcccagcaccatgcccagctaatttttgtatttttagtagagacaaggtttcaccatcttggccaggctggtcttgaagtcctgaccttgtgatcaacccacctcggcctcccaaagtgctgggattacaggcgtgagccaccgcgcccagccgcctactgtcatataagtgaaatcagacagtatttgtcctcttgtgtctgtcttctttcttttagcataatgtcttcatggttcatccatgtagcagatatcagaatttcattcctttttaaggctgaataataatttatgtatgaacagaccacattttcttgatcctttcatccattgatgaacatttgactggtttccatgttttggctattgtgaataatgctgctatggacattggtgcagatgtctttttttgttttctgttttttccaaattttcttttttttttttttttttttttttgtgagacagagtctcactctgtcgcccaggctggagtgcagtggcgcgattttggctcactgcaacctctgcctcctgggttcaagcaattccgctgcctcagcctcccaagtagctgggactacaggcacccgccatcacacccagctaattttttgtatttttagtagagacggggtttcaccatgttggccaggctggtctcgaactcctgacctcaggtcatcctcctgcctcagcctcccaaagtgctgggattacaggcataaagccaccatgcacagcctttttcaaattttgtattttaacacgtgcatgtggcataacttttctttccttttttttttttttttttgagacggagtctcgctctgtcacccaggctggagtgcagtggcacaatctcagctcactacaatctctgccttctaggttcaagcaattctcatgtctcaagttcctgagtagctgggattacaggaacgtgtcaccatgcttagctaatttttgtattttttttttagtagagatgggtttttgccatgttggccaggctggtctcaaactgacggcctcaagtgatccactgccttggcctcccaatgtgctgggattacaggcatgagtcataatgtccggccagtgatttaaattttcatggtgcttttacatacaacattcaaatcccaacaatcacacaagaatattgattacctgtatagagctgatagcgagtattttccagcccaaggaggtagtttatcatggtagatttaccaacactccacggtcccaggaacagtaccatgggcttggaggtaatctctccatctgtgggcaacaggaagtagaaatggaataaaactaacaaaagttcacacaaggggtatggcaccgtactccaaagcatctcaccgtccatccaactgagttgtggaattctccatgaatcagacgtgtgtagcccccagtggcgcttctcttgctacgtaagtgtgatcacccagtaaaaagacacagaagtcacttttgggccttgcccagatccttggcacgtctgcccccaccacaagaaggatctcagtgaattcaacaaaccctgactccgaactcactctgggtgaggtctcctggttaaatctggaggagaaaagcccatagagaaaggaggacggagcttccacatggagagaatctgggttgagaatggaggatggatgtggagcagcttgtataatcttgggtggtctggactcagacccttcctgtctccagcctctgcagctctcctctcctccagcctggggctccccaaattcccaatacagcctaatcctggactctgaggccagtgtctctctctctctttctgccctcttttgtttagaatcagggtctccgttgcccaggctgaaatgcagtggtgcaattgtgccccactacaattactgggctcaagcaatcctcccacttcagcctcccaagtagtagctaggactacaggcatgcaccactatgcccagcaaatttaaaaatttttttttgtagagatggggtcttgcaacgttgctcaggctggtctcaaacttctgggctcaagcaatcttctcacttggctccccaaaatgctgggattacagctatgaaccattgcacttaccctcttctagggccactctcaaacactagcctctaaagtccatgacaaatttgccagtgcccaaaaccaaacaatgaactggcaattcttgggtcctgcatccaatgtccttccgaaggccatgttggggagatgaccctgcaagggccactccaggtgggtccctaagaggaaaaatagaatgctctcgtgctttcaaatccagtggacagggagggaaggggagaggctttcaacgtggggtgtggtcagtcttattgcagattttcaggcctcagctcttccagctcttctctggactacagcacagagggccagtcctgcataactcagcactgaagttctccagactcgtctccctgaggccagcaggccaccctaaaaacactaggcactccccttttgtttcatttatttatcatgattttaatttatttaatttcttggttcaaagatcaggaatataaaaaggtaaacagtgaaaagtctcccatctccatcccagtctgcctcagccctgacaccccctggaataggtaaccactgctgacttcttacatgttattttagacattttaatgcatatataagcaatatttgtagctaacatattccccatctttttttttttttttttttttttttgagacagtgtctcactctgtcgcccaaaccacagtgcagtggtgtgatcatagctcatatagcctcaacctcccaggctcaagcgatcctcccacctcagcctcctgagtagctgagaccacaggcatgtaccaccaagcccagctcatttttgtatttagagtagagatggggtcttgccatgttgcctaggctggtctccaactcctgggctcaagagatccacccaccttggcctcccaaagtgcttctattgcaggcatgagcccggcacccagcccctccccatcttcttttcttttcctttttttttttttttttttttgagacagagtcttgctctgttccccaggctagagtgcagtggcacaatctcagctcactgcagcctctgcctcctgggttcaagccattctcctgcctcagcctcccaagcagctgggactacaggtgcgtgccaccacgcctggctaatttttgtatttttagtagagatggggttttaccatgttgcccaggctggtctcgaactcttgacctcaagtgatccacctgcctcggcttcccaaagtgctgggattacaggcgtgagcccccacacccggccccatctttttacagagagcgttgccatatgcttcctcttctgtatcttgccttcggatgctctggtcttccttctccgaggctaaagctcagtcctaaccaggtggtgtcttatacatggcaggcacatgtacgttgcctgaaagcaacaccatggccctgccccatccctccctgtctgtgaatacacaggagacactcacatctctgtggaagtcaagccctggctgggggccaggaagggataaggaggctgagagggtggcaggaatccccagttacagccacagagatgtcacagtatcttaacaccggcccaggcgacaccaaggagagccctagatgttccggttctccgagacaaaccacaaacagggccctttcctggtgctgtggtttcggctcctcacagcagggggcaccgctggcctatacaggaggtgggaggtgagcctgggagaggttacaaggaagctggccagagactaggagttaagaaccaagcccaaaaggtgagtgcaggggcaaggaagcgggacctccctgcagagcgccatgccctggggactctggagctcctggccctgctgctgtacacacaagtttcctaggagggccaagactccgggtcttagggccaagagagaaagaaaaacccttcgggaggctctgcaagctcataccaatagctgtgcatccactacaaaggggggcgataattggctgctaggctacaaaaaatagtacaggtagctgtggaacagggtattccctgcttccagctgtgtgatcctgggtaacccagcacgtctctgggcctcaggctcccctctgtagagcaggaagaatacaaaccctattacaccctggccacttacagccatccagagcatcaaatgagatcatatagaaacagcccaattaacacagggaaagatttctaatctcattcaaaaaacaataagataccactgctaaattttttaaagatgagtaacatttttaaattgcattgctgttgggaaacaaggactctcatctactgttattgtgagtacaaattggtatcatgggagacaatatggcaacaactagcaaaatgtttaattccagggttccaatttttttttttttttgagacagggtctcactctgtcgcccaggctggagtgcagtggtgcaatctcagtttactgcaatctctgcctcccaggctcaaatgatcctcctgcctcagcctcccgagtagctgggaccacaggcgcatgccaccatgtccagctatttttttctttttttgagatggagtctcactctgtcacccaggctggagtgcagtggcacaatctcggctcactgcaacctctgcctccccagttcaagtgattctcgtacctcagcttccccagtagctgggattataggcacccaccaccacacccagccaatttttggatttttagtagaggcagggttctgccatgttggccaggctggtctcaaactcctggcctcaagggatctgctcgcctcagcctcccaaactgctgggactataggtgtgagccactgtgcccggccatcggattgtttttaaaagtgctatgagccatcacgctgggcccaatttttgtgtgtgtgttttgtttgtttgtttgtttgtttgtttgtttgttttgagatggagtcttgctctgttacccaggctggagtgcagtggcacaatctcagctcactgcaacctctgcctcccgggttcaagcaattctgttgcctcaccctcctgagtagctaggattacagccgccagccactaggcagggctaatttttgtatttttaatagaaacggggtttcaccatgttggctgggctggtctcgaactcctgacctcatgatctgcccgccttggcctcctaaagtgctggtattacaggtgtgagccaccacgcccgcccctaatttttgtattttttgtagagatggggtctgactatgtttcccaggctggtctcaaactcctgggctcaagccatcctcccacctctgcctcccaaagtactgagattacaggcgtgagccaccaggagggtgctggttttccagagcatggcgtggtcacgcaggggaggagcacacagctgtcagagggaaggagggaggtttccacacacacagctcacctaacaggatcccatgtttgtaaaaacaaaaaacaacatccatctatgtgctcacacatgaagaggaaatgcttggaaggcttcactataacgatgtgtttctctgggagtcgaattaaagaagttggaggtcggctgggagcggtggctcacgcttgtaatcccagcactttgggaggccgaagcgggcagatcacgaggtccgcagacagagaccatcctggctaacatggtgaaaccccatctctactaaaaatacaaaaaattggccaggcgtggtggcaggtgcctgtagtcccagctattcgggaggctgaggcagaagaatggcgtgaacctgggaggcagagcttgcagtgagccgagattgcgccactgcactccagtatgagtgacagagcgagactccatctcaaaaaaaaaaaagctggaggtcaagaatataatttttatttttcaacgtataccattctgcactatttgaatttttgcaacaagtgtgtcttatttttattattttgaaaatcaattttgtaaagaatccaggcccaagggaagcagagtggaagggcaatagcaggaggggaaggaacggagtgatcagaggactcaggcaccacccatgagtagacagggggcacctgtggcctctggagcacaggagggattgaaataggcatcatcgcctttgaaaactcaaatgtgcatgactgaagcataaaggcttaaaaccaaaatgcatctgtaacaccctggtaaagcatcgcgctgtgctggtgaaagggtagttccgtgatggaggtgtcgtcctttccaactcccagggggagcccagacccagacccacaagtccttgcacacatcatgaatgagctcctgaacctgtgtgggtaccgggagagtccaggccggtcagcagtgtggccccgccgacaggcctgcgccgtacccgtaatctcaagccctacctgttatctcaagccctacctgtgatctcatgctgccggagctcattgtacttgtaggactgctccagaggcttgatggatgagtggtagatcttccgaagccgctgcagcaccgctggagacagagagggccgggggaagagcatcacgcaggtgcgatccaggcagctcctccattgtggaggggcctcaccacccagggcagctccacccctgcctggtgggcagcaagtgctgtttgcagcccagcgactgtgcaatgtatttgcatatggggagctggcccacatctcaactcgcagaaacctccaaatgaaaaggcattctcctacccacccccaaagcttcctgaactgtttggttattttattttattatttatttatttatttagagaaaggatcttgctctgtcacccaggctggagtgcagtggtgcaatcatagctcactgcagcctctaactcctgggctcaagtgatccacccacctcagcctcccaaagtgctggaattacagacataagccactgtgcccggcctgagctgtttttttttaaaacctctctcctccttcctcacctcagtagtgtgtctgaaaccttgtctcggcctgctgcctcactgcaagccctttctttggtggatgagaattccatctctgttgcccacctctgtgtgtgctccctgaggcttagaaggcaaagaggcccagcacccagcaggcgcgcagaacagcaccctggccctggcgttggcctgtcagtgtactcccagacactccccggaggggtggggtcagataacccaggtggcctctttctaagagttagctccctgctgggagcccacagtgggaaggcctatggggtgacgagtcaggctagcgagactctacccctcgatccgccaccctctagccgtgggccaggagcaaatcgctgctagcctgagctccagttaggtggctcattgattaagaggagacaagccctgctgcaatccttgggtttcaaagataaaatgaaacagcacacatgaaacggctttataaactaaaaatcacagcgagggagatggcatcagcacagcatggggctgcactggcttcgcccacaccaggccgtctacttggatggcccttcctcctctgtgcccacctggaaccccaaggcttggaccttgctcacagagcctcctccacgaagcctcccaccttcagggctctcctcttccccaacgtcccctccagcctccaagatagatacagccccggcctccaagatacagccccggcacgccctggctctcaggagcctccaggagtctgcccgggccctggtggccgggctctcccagccctgggcatatctccctcccctggttaccagagtagtcatcggatggcttgtcctcattcagcatgagggtcttctcgatgtgggagcggtccctcaatggggcttcttcatttgcatcctccgtctcttctgtggagagaagcagacagccaagtgagagcaaagctaacagccagctgagctctgggccccggcacagcagacgagggctgggcctcaagcaggggctcaacagggtcttgccaagttacactggactgagctctgcctttaggaaggaatttgatcatccagactctatgaagttccatgtgtagtgtattcgcattcggggagctggtccacagctcaacctgcagaaaccttcttatctatttatttcatatattcaacaaatatgcattgaacaccttcgccacgccaggcactgagcatcatgctgggaatacagtggtgcccaaaacaggcacaactccttaggcagctgctcttagtccagtggagtcagagatgatagtctttaaagtaacgctagggccgagtgcagtggctcacacctgtaatcctagcactttaggaggtccagatgggaggatcactggagcccaaaagttggagaccagcctaggcaacatagcaagaccccatctctaccaaaaaaaaactttccaaggagtggtgcacacccatagtctcagctcaggaagctgagacaggaggattctctcagctcaggaggtcaaggctgcagtgagccatgaccaccccactgcactccagcctaggtcacacagcaagaccctatcttaaaaaattaaaacatcaaacatctcaggaggctttagggctaggtaggagaatgccttttggcttgaaccccagcctgggcaaaagagggagaccctgtctcaaaaacaataaaaataattaataaaatgtaatcattacagatgatgaggtggccacagaaggaaacattctgaaagctaagtgcggctcaggagtgtgcctgcaccagtggtctcagcagcacggtcagagaaggcctccccaggtctctgctggggggagtgagttaggtgaccagtggagagaagcgttctgcaaaagccccagacgagccttatttagcaagaagcaggagaaggggtgtctggctgcagctggggaggcctgggtgctggggagctgctgaggtcctcagggctgaccgggcaggaccttccacagggctttgggtttcatcccaagagcaatgggagccagtgaggggctctaggcaggcagcctagcgtgatagtgcatgcctgtagtcccagctactcaggaggctgaggtgggaggatcgcttgagcacttgagctcaggagttagaagctgcagtgagctatgactgcacgactgcagcccagcctgggtgacagagtgagaccttgtctcaaaaaaaaaaaagtatgtaaattaattcttcaacgaagcctgtggggaagccatcttggagagtgaagacttgacctcgacctctaccctgaaagccccactcctggtctaagtccatgtactaagcagatgcagccatgaaggtgcctgaccgaccctcgtattggctgcaattctcacactgcccgagagcttagcccggcccttccccctctgctcctggccccgagccctttgagggcagctttggctgctttaggtgggcacttgagagtcaacagcggtcacagcctgagttctcatctcatgatcctgacccctcagtcctggttctgcaatgcttcctacagcctagtcttcaaggggagaccccagtcctagcccactaagggaatcaccagggaagttcccaacccacccccatccattccctgcacgtccctccacccgctggccccggggcaccaatcattccattagctcgctgctcctttaggctgaggcactggcatgggctacggcgcatcagggaccctaaggggaggttctggggcccctgactcggaagtaccagggcccctctgacccctctcactggcccctccaagctggaggccagtggccaatgcacagcctgaagccacctccccgggccgggactgtgaaaagggcctgccaccctctgccaccttctgtccctgcctgtcccctacacacaagacttccagggagaatgcagctgcccaagggacggggttgctgttagggaattaattcctaccctgggcaacaatgatgggactctccctccccctgatgtccctcctcgggctcctctgccttcatatccagggtctcactgcccatggactctgtattcaattcctccgggccaggctgggcccctctgtccctgtgacttgtggttcctgtggcttccggaagctctgcaccttcctggggttccctggcttcctggggctccctggcttcctggggatccccaccttcctggggctccccgccttcctgtggcgctccaccttcctggggctcctcggcttcctggggatccccgccttcctgggactcctcggcttcctgcagatccccgccttcctggggctccctggcttcctggggctccccagcctcctggggctccgtggcctcctcggaggcgccctctgcttcttctgagctagccccatcgccgctgtcctcttcggactcctcttcggagggaactcctccttcttcctcgcttccacttccatcaccactttcctcttcagaggaggcttcatctgcgtcctcctcagtcatctctggggactggttctcctcagtgtcccctgccttaacgctttgggcgcccccaggctctgcactggcctctgcagctgggccgggctccccctggtcctcggtgccctcactggcttgtgtgtcaatatctggctccgactctcccccaacagccgcgacgtcaggggctccctctggcactgcaggctcctcgccaggcccagggctgccctcggcctctgcgttcagtgggccgaccccatcaccctctgagtgaggagaggccccctctgcctttggctctgctgtccctgctactgctccctgcaccaggctgtccccttggacctcctggacttcctcggggagttcatggcccccagcctgtcctcctgcctctccactggcagttccctccgtggggagcccaaacccagtctcctcctctccttgtccctctccagaactgggctccggccactcctcttccacaggccccttggcccctcctggagggagggcgcttgccactggtgggccattcttttcctccccaggccccgcagcgtccctgtcgtccctttccccaggtggaggtgactctgtggctgaggcattggagaggctggcttcaggatcggggcccgcgctggcggcagacgcgggggtcttcttggggctctcggcctccctgccatctgggtagtgaaggagcagtttcttgtcttgaggggctgtgtctgcataaagcgccctttctttctcctctagacttgcgtctccagcagagaaatgattctccaacaaattgccaacatcttctgtgccacccgacgcggagacttgcagttctaaatgattagaacatgattggtcagtttcacagggttggcaccggctctgtttctcaagagtctataataacctagctcccgtcttctgggatgtggtgttggcctggtgtgcagtgttacgcccaccaacctgggtcttcaggactacctcgtgcgtagcgagcagaataggtgttattctgcctccctcccaagatgtagaagctgtggatcagggagttaaaggactgacccgttgtccatcactaacgaagtgagcagctgtgctaacccgagaaccgcccccgcaccgcgaccctggccctgaccttcaagcttccgggcttggtcctgatgactgtatatggagggaaagttgggcgagcccttccagtccctcaaccttgctcacgggcgtgtgcagctgggctcaaccttggagatgcttccaagaagggacaaatgcttgtgcatcccacctcatggcagttcctactgtcattaaccagcaggcttttaatactgctctcagcgaaggagtgaaaacaggtgtttgcaggccggataatcttaggttacacagcacggtgcttaagggattacttgtggctctcaaccttattaagtcacacatctaaccctgtcccagtaagggcaggcatttgctggcccccctaccttagattagagggtacatggcctgaggaggagatatctaaaacaggccgggcctggcttcccaaaggctctggccaaccccttccaaggggatccccttgtaagggactgcagcttaacccagagagcagagggcccaggaagagagaagagtaggggcctcatctgtgccagagacctctgtcaaggatcaagtttaatatgtttggaaaatggggtcagaaaaggctaagtgtggtggctcatgcctgtaatcccagcactttgggaggtcgagataggcagatcacctgaggttgggagtttgagaccagcctggccaacatggtgaaaccccatctctactaaaaatatgaaaaattagctgggtgtggtgacacacacctgtaatcccggctactcaggaggctgaggctggagaatgacttgaaccgggaggtggaggttgcagtgagccgagatcgcgccactgcactccaggctgggcgacagagtgagactccatctcaaaaaaaaaaagaaaaaagaaaatggggcccattaggcccacccctctgccccctgcccccaggctagggtctgtttatgggggacattgcaggctcatggagatgaggggaccacaggtgtcctgccttggagcagctgaggcagcctctgttcttccttgactctcaaggcccctctccgaggaagagtaccccacctatctgctggatgcagacaacccccctctctcaggccaccacttgctactcccatctctccctcccacaaagaaaagccacttcttggagtaccccttctccctcagggtacccacccttgttccccaaaagctgggtggcctccagggatcaggagcaaatattttctcattagttcccatagacagctagcctgttgtcgaactcagaaagatgtgaagcttggtgccttttattatagaggagccccgtggattgaaatatacaacttttcccccagcactttcatatgcatggccatttaaccttctttacgactgtcagagagatttcagagctgaataagtgaaagtccagagatctttgccctgccctagatacatcaccactaggtagttaatgggtgaccggaacccagaactgcccagtccctgtccaggcttccatgccatgctgtgcttagcagggcacaggggaccccttcctgctggaatctcagctcctgcctgcacgtgccttctcttcaggctcaagctccgtactggtcctggctcctgatttgcaggaatccaatttaattctgtgttcccagggcctggcaccctgcctgacccacagaaagtgctggaagaggtccgcggtcagattggggtaccaaaacgaattcctggtcccttagtgggggacaggacagggagctgactgttgctcagtttaatctcctttcatcaccacctacatacctgtaagtcctgactccttcacctacatctctatctctccaccttccacccctgcagaaaaatctatggtgggaatttggtttaatcagaagagactgaatgtcctctgaacagcaggatacgtataatgtatatgacatacatctgtatgtacatatctgagatacagcctgccaggcaatgcttaagcactttatatataaaacagtatcttcatcatactgaattttcttaatcttacttgttttggtaaaatgagtattactcatatctttttttttttttttttttttgagacaaggtctcactctgtcacccaggctggagtgcagtgaacgcgatctcggttcactgtaatctccacctcccgggttcaagcgattcttctgcctcagcctcccgagtagctggaattacaggcgcatgctaagttaatttttgtatttttaatagagacagggtttcaccatgttggctaggctggtcttgaactcctgatctcaagggatccacccacctcagcctctcaaagtgctgggattacaggcatgagccaccacacccagcctcatatctctatttttacagatgagaagtctggaaccagagacattgaggcccttgttgaatgtcacacagctaataactggcttgggccatgtgacttcagagccacagtatcccccgggagcctgttagagacgcagacttttaagccccagcctggacccattgaatcagaatctgcattttaacaaaatggccaggtgattcctgtgcacattacagtctgagaagcgctgggctacactgcctcacaaactgcccctcagccagcgactctcagcattggctgcatattgaaatcacctgcttcttggtcccatgcttccctttctctgcagttttgatttaaataatccagggtatagcaccagcatcatgattaaaaaaaaaaaaagttcttaggtaacacacaaagttgcaaaccactgcaactaccaaatcaaataatcttgacccccaggcttcagctcccaggccctccctactcgcaggcccaccccactaaggatccccattgtgggctcccacgttggggggggtctcctagggcctggcatttgcctttggaacagcagtagttaaggcttctcctctgggaatccagccctttccatgggctcctgttgtccttcaatgatgatggtgatgaccgtgccgatgatgaggatcgtgatgatgatgatgatggtgatgatggtgatggtgatgaccatgctaatgatgaggatcgtgatgatgatgatggtgatgatgatggtgatgaccgtgccgatgatgaggatcgtgatgatgatgatgatggtgatgatggtgatggtgatgaccgtgccgatgatgagggtcgtgatgatgatgatgatggtgatgatgatggtgatgaccgtgccgatgatgaggatcgtgatgatgatgatgatggtgatgatggtgatggtgatgaccgtgccgatgatgaggatcgtgatgatgatgatgatggtgatgatgatggtggtgactatgctgatgatgaggatcgtgatgatgatgatgatggcagcaatggtggtgatgatgatgatggtgatgacgacgatgacgacgatggtgatgatggtgagagtgatgatgacaatgatgatgagaatgatagtggtgataatgatactgagttgaatgaactctaggtctgatgtcctataacatttctgacagtctcaaaagccgttttccctggtaaaggtgagagggccacacagtcccaagggggatgaaagttccaaatgttggaggttcaccgtgaccatgaccttcacactgctgtgtgtttccactcctgcgccctgggcaggaagcaaggtgtgtgcatatgtgtatgcacatttatattcaagctcttccctggttttcacaacttagggctgagcttcccctgaacttctgctaaacaatttggagtaaaaaggactgaggataatggcttcttacactgtgacctttctcccaggctaaaaataactgctccaacagaaagtctctcaatgaaacaagctgtcccattgggccccagagctcactccccaggaagcagctgtgccactggacccagttctcctcttggaggcgcagacagaggtgtgggagcctccgattacactcacttccatcgcatgacatctcacttcaatcctgggaaatcaaggctggtgtctttcccacctcccttgcttcttgccgaagcaccctattggccctggagcagggaggccgcagaggacccaggacaccctggagaggtgaatccccagtaagatgagtcttggtctatcctgggacatgaagtaccgcactgtatgtgctgctgccagggtggcccccccgactccggccaggccaggcccgggactgacgtcagggcacaggaatagcaggccccaactctgcccagagaccatgggaaggccccaccccactcacacccagtccaagcacaacacacaacaatcctgcttctcccaccagcccctctgccaccagcctttctcggggggccagctttccagcaggtcccaccagccccacagcctcagggcaggcccaggctcagtccctctctcctctctccatcaccaaccaaatgccctgattttgtttcttcagccctgtctctttccaaagcacttctacatggactcagaggactatggagttgccaagggccctcgtgagtccaactgtaaaggaggacgctctggccagataccttcagagacttgcccaagattggggcaggggtgggacagagtccaaatatatgaaccttagtctggagttctttttgcccccatggagttcacaaaccatgtcccatgaagtgctagggttccatagaagtgactcatggggtgaggaaagatcaaacagcagagacagccacccactttgtacttcctgctctccttgaatttgtctgccccagtgtccacagagaaagactgcagggagattggcaagccctgctcctttactctcctcgcttcttccttcaaaatattagtatctgccttgagcctcctatccattattttctccaacgtcccaagacatcctgcttacagcatctttttttttctttttctttttcttttttttttttttttttttttttttgagacaggtcttgctgtcgcccaggttggggttcaatggcacaatgacacctcactgcagcctccacctcctgggctcaagggatcctcccacctcagctcccccaaacagctggaactccatgtgtgtgccaccacatccagctgatttttttcatttttgtagagatgaggtctcgctatgttgcccaggctggtctcaaactcctggcctcaagcgatcctcccacctcagcctcccaaagtgctgggattacaggtgtgaaccacgcttacagcatattttcactttgccagtccacacgtgccaggctctcagctgggtcatctcctgccctcacgtaggactccatctttccaaggtagtttcctgtgcttattcttctctgatgctcctagcagccctctgaggcagaaaaagcaagggttgttaacctctcttgaaatgaggaaacaaacacacggaagtcaagtcgtttgcctcacaagtcattccagggatgggctggaactcaggccaagagacagaacaaagctccctgggagcgaccatgacctgctgagctgttcaagcccagatacccagcttctggggctgggtcaacgtgtacctgtgtgtttcacaaggggattctacagaacaccagcatttcggaccctctgcactagccatcctcagtaccaagggccaggaagctctgtcttgaagttgaaactagagatggagagaatagaggtcaggacctgttttcagcccacctctgggtgttgaatgtattcagtgccttcgtgcaatcaaatgtagattctattccagcccgtccaagtctccttagcacatgtttataacaagtacctgccaaggttattcttccacatgacttctcatccatttgaactagagctagcaagtccaaagtcatgcgtaagtaaaatacctctgaccattactcatacacagttatgcaaatcagtcattagtaacagaatccccagcgggggcaggaatcactctccaaatctctgcctggttcatctgtcccagagagtgaggagcaccagccatggcatacatgtgagccccatgtcttgcccccatccaccccccgccccacgttttggctctcattggctgtatattaagtgcagcagggagcaattcagaaaacagagttcatgccgcagagcaggcagcctgcccccttccttgttctagatcttgtctctgaacactcgtggaccgggcaaacgtgggccagcagcctcttctggtgtcctgtttttccttgactttatcctactgggtaaacattcactgctcaggaccccttgctcttccacttttttttttttttttagacgaagtctcattctgtcgcccagggtggagtacagtggtgcgatcttggctcactgcaacctctgcctcctgggttcaagcgattctcctgcctcagcctcccgagtagctgggattacaggtgcctgccaccactcctggctaatttttgtatttttagtagagacagggtttcaccatgttggccaggctggtctcaaactcttgacctcaggtgatccacccgcctcagcctcccaaagtgctgggattacaggcatgagccactgcacccggcctcttccacttcttagatgaagtcttaggacaactttgcagaaggctgttgcccataaggacccgagaagagaaattctggctggaggaaggcttgtctgcattctcccaggacccctgaggtcctcttctgccattctctcagcctttccctcttctcccaacatgggcgaccagagtgcaggggctgaggcagccattcttggaaggcttctttggcttcctggccatgctcctaaagtcaaggctaatcccactgggacagcttgtccctggctggactctagcccttaaaatgattcatccagggaatcagatacaatgacaaaagtatgacagggtacaatgacaaaggtagcaatcagaaagaaccttgggatttgggggtccagagagatcttctgatagaccaactggcttgatttcactcatgaacaaaaccccaaaaccctggtaagtgcttgtcccaaggccatggggctagttaaggtagtaggcagcagtctgcttctagaactcagctctctatggacgctctcccagcagtgggccagccaataagagggtctaagtctaccctaggacagtgatttcttagcccaccctcttctactcttcaataacaactgttttaggctggacgcagtggctctgagagcccatggctcacacctgtaatcccagcactttgggaggccgaggtgagaggatccctagagcccaggagtttgaaaccagcctgggtaacaaagcaagacctctgtcttgcttactacttgctttgtcttactactggcccatctttccaaaaaattttaaaattagcttggcatggtagcgtgcgcctgtggtcccagctactggggaggctgtggttgacggacctcttgagcctaggagtttgaagttgcaataagctttgataacaccactatactccagcctaggcaacagagggagaccctgtctcaaaaaaaaaaaggattaagacttcagcacaattgtttttaacccatagagtcctgagaattgacagaataacttcactcctcaccccacctccaattcctgggaattcttggtttgggaggtagaaagaaattaccagaaatcccacaaccatcatatatatacatgcttgtcactgatgcctggaggagtcatcagtataaatgactattcacttttattttattttatttttattttatgtatttatttattttttgagacagcatctctgtcactcaggctggagtacagtggtacaatctcagctcactgcaacctctgcctcctagattcaagcgattctcctgcctcagcctcctgagtagccgggaccacaagtgcacgcaaccacactcggctaatttttgtattttttgtagagatggggtttcaccacgtttgccaggctggtctcaaactctggacctcaagtgatccacccgcctcaagttcccaaagtgctgggattataggcatgagccacgatgcccagccactattcactttaaaaagacaaatacctcagaaagagcaaaacattatatcctaacccctcagtatgagtcaatcactagcagggatactctatagagcactcagtttttccagagatcagccgtgcctgcagtgaacagaaatccttgcagaaggccttgggcctgctgcctcccttcagaggggccgagctggggaggaaagggaaaggaaggggaaagggatgcaggctgggttctgagacagaccaaggcaggtggctggcttccccccacatcccagtccgaagaaatccaatctccctgggatctgtggggatgaggtgctggtctaacttttgggccccagacaggaaaagacttactggaagccaagggagcgtggctcccgcaggtctcagtctaacagctatcctgggttaaagtcagagccatctccagcttggcaggtgaaggggtcaaggaatctgggcccaccccatccccaatccagggaagctggagggaatcttcttgagaaacgtgggagcttgggaaatgggtgtgacaccttccctagcctgagccaggcccacggctatgccttttctttcttcctggggctgaggctccagcctcctagatagtggctggtctctctgaatgcacctggaagtcaggaaagctgggttctgccccttactctttttctttttttacagaccctgtcccttagagacagggtcttgctctgtcacctggactggagtgcagcagtgtgacgaaagctcactgcagccttcctacttgtcacacttcagcctccagagtagctgggactacaggcacgcgccaccatgcctggctaattgttttattttttgtaaagacagggtctcactatgttgcccaggctggtctcaaacttctgggctcaagcgatcctccagccttagcgtctcaaagtgctgggattacaggcgtgagccactggcccctcccctgctgtcttaccactggcgcccccaccccccgctgtcttactacccagcgaagtaaccttgggttgctccttactccctctgcacacaactttattcgcccataaaatgtagataacaatacctgctttgccagccccatcagagcgttttaaacatcaggtggtgctcagaagcatttcaataaatgtcagctatgagcatcattctttcctagaagagcaaagacaccaggccaaatcccaaatttgctgagtgggccacagcagagccagcttcggacaggagccgagccagctggcccttcacgctgttcctttagccctccgggtctgggggctcagtcagggggcccggagccatccatccttctgccagggactcctcctccctggctgccagccagaggcagctcaggcgaggagctgcagggtgcctgggggtgagccctgcgctcttggtgaagttctggctggtctgggaacggagcaggctgagctgtcaacactcccaggggccaggagctcgttctgctgatcccaaagttaacccctgcagtccctgactccagcctcagtcagccctgattcaccagcaacatctgaggccacatgtggcctcccctttccccaccacgtcccatcccttctgtccagtcactgaagtgaggtgaccccgcacttcaccccaacgcaaacgcgcactcaggaagtttaaacagacccattctaagggccacgtctttctgagaatgggagggaagccctttccgaaggcagaggaccggtaagggcccttcaaagctctctgaaacagcaacacggtcggagggaggtcattagcagtgctgtgtggcttcctcatcctcatggtaagtgagcactgggagtaagacaatcagcccttcagaaaccactcgggcctggagaacgcagccagggctgagccacagagatggggcaggagcagttctggcctccaatatacagcggcgctttgctcctctcgcacaagtgaaatcacagctgatgtctccatggctttgaagagcctcacacacaggcccgctggaccacgtgggccctgctcctccatcaccagcagctctgtccccattagcagagcaggtgagaggaaatgccacacccagagtgccagacaacagggcgcacagcccccaacctgctcagccggggaggtgtcctcagccatctctcctacaactgccaggaagaccacagaagccggcggttcccaagtctacgcagagttagttaaggaggaaggccaggcctctggcagagctagggcagcaagaatacacaaatgtcctgcccatgtgccccagctcatagacctctctggaaaaacttctgcctagacaccaaaaggccagatttttcaaccttctttcccagagggtgtcaccgaatccatgacagatgggccccaccgccaggtcctggcattcatggccccaggtctcatcttatttatccttatggttatttttgcattcaaggctctagaatcagaaagaaacttagaaagtaactagcccaactctttagcccaactctttcttttcacagaggaggaaaccaatgcccagagaggaaaaaggagcttgccagaagtcgccagtgcactgggacaaagctagaactagagacaaggtctcctgaccccgcagccgtagtcttcccatagggggcccagacaaatacaacttccccttctcccagacgtttctaagctttggatgctcacatcctgccctgtccctgggagctggggcccctggattgctcatctgtccccctattgttcctacaaaggacagccccttggtgagtctcagagggctgtgtcggggcagccacagtagtgtcaggctggcgccctgagcacagctttttttttgagacagtctcgctctatcacccaggctggagtgcagtagcgcgatatcggctcactgcaacgtccacctcccagtttcaagccactgattctcctgcctcagcctgttgagtagctgggactacaggtgcatgccaccatgcctaggtaatattttttatatttttagtagagatggggtttcaccatgttgcccaggctggtctcaaactcctgcactcaagtgatcctcccgccttggcctcccaaagtgctgaggttacaggtgtgagccaccacgcctggcctgtatggagattttaggaaggacccagggtgagggttagctccctgcattcagcattaagtctgtggtattcctggcgtcagcagaggcatgcaggaatggttgtcatcaccaccaagagacaaaggacagttggttccatgagggctgtgtgagatcagctcttagctatctgagttcaaggtggcagaggccaaaagaagatgggaccagaagagcattccagcgtctgggtcattagagaagggaagaccctcccagcccaccttgccgctccgtgaacagtacaaactctggatgcctccagagcaaatctgaccattaccctgaattttcactccagagtacaggtgtccagaacacccagccaccctaaggggaaccatcctagaaatctcacgtctaggccaggtgtggaggctcatgcctataatcccagtactctgggaggccagatcacttgaggccaggagtttgagaccagcctggccaacatagcgaaaatctgtctctactaaaacacacacacacacacacacacacacacacaaataaccgggtgtggtggcacacagctactcaggaggctgaggcacgagaattgcttgaacccgggaggtggaggctgcagtgagccgagatcacgccattgcactccagcctcagtgacaggagacactgtcctagaaaaaaaaaacacacacacatctcatgtcttccctgggagcagccttgctagagcctctgatttacatccccagaccccttaaccccagacacatggggatgcactttcctgggtgagctgcaggctccatcccgcccctcaggccgggcctccaagttgcctggctccctctctggatatcccaccccagggagaaatcatcattcaacccaacagcagctttctctggtgaactttgtgtcactgagagcctgggctctctgcatctgtctcatctagtcaaacactgaaataactctgggtggctgaggcagggggatcgcttgagcccaggagttcaagaccagcctaggcaacatagtgggaccccgaatatacttaaaaaaaaattagctgggcctcgcggtatgctcctatagtcccagctactcaggagactgaggcaggtggatcgcttgagcccaggagttctaggctgcagtgagctatgattgtgccactgcgctccagcctggcaacagagcgagatcctgtctcaaaaaaaaccccacaaatactgaaaccagatgaggccctcatcgcctgggaccatgggctattccattattttttttttttcgatacggagtctcactttgtcgctcaggctggagtgcagtggcactatctcaggtcactgcaacctctgcctcctgggttcaagtgattctcctgcctcagcctcctgagtagatgggactacaggtgcatgccaccatgtccagctaattttttgtatttttagtagagatgggtttcaccatgttagccaggatggtctcgatctcctgacctcgtgatctgcctgcctcagcctcccaaagtgctaggattacagacgtgagccactgcacctggcctattccgttcttttcttttcccttggcagcctcatggccacacagcaggccaggctgcctactccctagttcccaaaggactcccctgaagagaggaaggctgaagccacagcagggctagagcaagtgtacattccacactcgctgtccccaggctgaccctccccggtcaacactgagagccacatggggccacctccagcccatgtctgaggagcttagtgggccggcctggccaaagggtcccactcagccctggtcaaaaaaggcccagatccctgcactgatgcctgaatgtggttttgtatttgttctatggggctgctgtgacaaagcactataaacttagtggtgtaaaacaatggaaatgtgttcactcacagtcctagaggccagacgtctcaaatcaaggtgccaagagggccacctcctctgaaacccacaggagagactccttcgttgcctctctagcttctggtgtttgccagcaactcttggcttgtggctgcgtcactccagtctctgcctccactgacacaaggccttctctgtgtgtctgtgtcttttctcttcccataaggacaccttcatattggatttatggccagccccactccagcatgacctcatcttaactaactacatctgcaaccaccctacttccaaataaggtcacattctgaggttctggggttaggacttcaacacatccttttgggggatgcaatccaacccataacaggtcccccaatagcccacaccaccacctgcctaacccactgccactcccttcccccagcctggcccctcgctaatcccagctcacatttcagatctcagctttgagtcccatcccttgggagtcgtccccgacccctcctctggtctgtgtccctgcagcacctgtcacctatgtgacatcaccctatgtgacggctttttttaaaaacagggtctcactcttgtaacccaggatagagtgcagtggcacgatctcagctcactgcaacctccacctcctgggttcaagtgattctcctgcctcagcctcctgagtagcttggaatacaggtgtgcaccaccatgctcagctaatatttgtatttttggtagatacggggttttgccatgttgcccaggctggtcttgaactcctgactcaggtgatccacccgcctcggcctcccaaagtgcttagattacaggcatgagccactgcacccggcttttttgtttttttcttttaacctgtgtccctccatagatgagcagctgctagaggctggtgcctgtgacttgtccccactggaggctgcagatatcccctcaccataagtaacctgctggctgcattgagagcacctgacagtaaggagccttgctcctggccagcacttctcaaggtgtggctcgagggctatctgcaaaaggaccacagaggagcttgattaaaagtacaattcctggcgagatgcggtggctcacgcctagaatcccagcactttgggaagctgaggcagatggatcacctgaggtcaggagtttgagaccagcctggccaacatggtgaagccccgtctctactaaaaacacaaaaattaggctgagtgcggtggctcatgcctgtaatcccagcactttgggaggctgaggcgggaagatcacttgaggtcaagagttccagactagcctggccagcatggtaaaaccccatctctactaaaaatacaaaaaaattagccgggcatggtgacgggcgcctgtagtcccagctactcgggaggctgaggcaggagaatggcatgaacctaggaggtggagtttgcagtgagcagagatcatgccactgcactccagcctgggcaaaagagcaaaactctgtctcaaaaaaaaaaaaaaaaaagcaaaaaagcaattcctaacgtttggggctcgatgattgaaaaaaaagaaagaaaaagaaaagtaccattcctaggcctattctcaggcctccagaacaaaggagtgggcaggaggcctcaggaatccaccttttttttattttaagatacagaatcttgctctgtcactccagctggagtgcagtggtgcaatcatggctcactgcagcctcaaactccagggctcaaacgatcctcccacctcagcctcccgagtagtgggactacaggtgcatgccatcatatctggctaggtttttaaattttttttttttttgtagagacagggtcttactctgttatccaggctggtgtcaaactcctgggctcaagtgatcctcccacctgggcctcccatagggctgagattacagaaagatgagccaccacatccggcaaggaatctgccttttaaacaagctcccagaagattctcacacacactaacatccgagaaccaccatccttggaccttgattatgggagccaatctaagcccatcttcccagagacctacgggttgcaaagggtggaggaacctgcttgtgtgaggctgcaccagtcctgcccctgggacccccttcctagctacgatccacttccagggccacaggcggccaacaaaagctgatgtccatcagccctaggcccatcatgggtgggggcatagctggccctgctccctgcccgataatattcctgggaggagaaagaagagagaggagcagctggtggtcgggggccctcacagcaactaccatggatggaactctagtagccagagctgcccagggagcacagtgatggaacagccctgggaccccgggcatctggaggagggagaggagaggaggagggagagagagaggagtagaaagatcagtgttaggagcccaagtgttctcccctaatcagcagtgggacctcaagcaagtatttaaacatttctgggcatgtttcattagtaataaaacagaagagaaaaacaccaaccctgcccacccctcagacttgcagtgccttcaccccactactattgatggagtgcctatatactgtcacacagtgggaggaattctgaaagctggagagtactagaacgtacaagatatttctaattataagataaagtgaggccaggcacggtggttcatgcctgtaatcccagcactttgggaggccgagacgggaggattgcttgagctcagcagttcgagaccaacctgggcaacagggtgaaacctcagctctataaaaatttttaaaaattaaaaaaattagtgtgatggctcacacctgtggtcctacctactcaggaggctgaggcgggaggatggcttgagcccaggagacggagtttgcagtgagcggagattgcgccactgcactcactgcactctcgcctgggcaacagagcaagaccctatctcgagaaaaaaaaaaagaaaaaaaaaggataaagtgtccccagaatgtatatccacacaaaaaactgtacactgatgtttatgagcagtgtgattcacaatagccaaaaggtggaaacagcccgactgtccatcagtagatcaatggataaacagaacatggtctatccacacaatgcaatatttcccagccatggaaaggggtggagcgcttccacctgctacaacacggctgaacctggaagacacggtggtaagtgaaagaagctggacacaagagaccacatcttgtgtgattccatttatacgaaagtccagaataagcaaatccatagacacagaaagcagattagtggttgctgggggagcagggaggaatggatggtggaggagaactggggagtgtgtgctaaagggcccagagcttctttttgaggtgataaaaaatgttctaaaattgactgtgttgatggctgcatatatctgtgaatatactaaaaactactgaattgtatgctttaaatgagaaaattaaatgacatatgaattatatctcaataaacctgttttcaaaaataataaagagccgggtgtggtggctcacccctgtaatcccagcactcggtgaggctgaggtgagaggatctcttgaggccaggagttcaagatcagcctgggaaacatagggagacctcatctctaccaaaaatacaaaaaatgagctgggtgtggtggtgtgcacctatagtgccagctactcaggaggctgaggtgggaggatcgcctgagcccgggagtttgaggcttcagtgagccctgattgtaccagtgcactccagccggggtgacagagtgagaccctgtctctaaagtggctgattcttttctttctccaaaaccttaattaagttgtttacctttaaaatataccctcaatccaaccatttcttaacacccctgcccccaccggctccctggcccagccactgtcatctcccacctggattgttgatgtcaccctttcccgagctgcctgcttctgtcccccatcccctgtgtgtttcccacacagcagcagagcaacaggagacccccactccacacactccctccggtggctcccacctcatgcaaagaagaggccaacatcctacggtgacctggaggcccacaccctctagccctgcttcacctgtaaccccatctctcccatgtgccccctcgtccactgtgtccagccactctggatttgctcttcagggcccctcctgccctctgtgcttgctttgctttttgctgagaatgttcatgcttcccagacaaccgtctgtctgactcactccttcctcttctaagtctgctccaatgtcaccagctccataaggccttccctggccacctactgaattattgaatattgtctcccagtcagtcttccccatcttccatccctggtttttctccatcgcatctaccaccttctaataatctacataacttactcagtttcctgtctgtcagggattgtgtagcccctgcacctagggcagccattggatggatgggtggatgaacgaatggacagctggatggatgaatgaatggaaggatggatggatgaacagacgaatggatggatgggtagatggatgaatggaaggatggatggatgaacagatgaatggatggatgggatggatggatgaatggatggatgggtggatggatgaatggaaggatggaaggaaggatagacggatgaatgggtaggtgggtgggtgagtggaaggatggatggatggataaatggagggacagatggatggacacatagatggaaagatggatggatgggcagatgaatgggtgaatggacagatggatggataaatacatgaatagataaataaatgggtagatggatggaaggaaggaagggtgaatggaaggatgatggatggttgaatgtgtggatgaaggaatggaaggatgaatggaaggaaatatggatgaacagatggatggaaggatggaagaatgggtggatggatgaatgatagatgaatgggtggatggatggctgaatggatggatggatggaagaatggacggatggatggatggatggaggggtagatggatgaatggaaggatggataggaagaagatgaatggaaggatggatgaatggatgaatggatggatggaaggatgaatggatgggtggatggatgagtagatgcatggacgggtggatgaataggtgtgtgggtggatgagtgggtggatggatggatgaatagatggaagaatggactgatggatggatggatgaatggatggatggatggatggatgatggatggatgaacagatggatggatggataaatgggtggattgatgaatggaaggatggatgaaagcaaggatggatggtggatgaatggaagggtggatagatgaatggacagacggacagatagatgggtggatgggtggatgagtggatgggtgggtggatggatggatgaagggatgggtggatggatggatgggtaggtggacagataaatggatggatgacggatggatgggtggatgcatggatagatgggtggatggacagacagatgggtgaatggctgggtggaaggatgggtggatggatagatgaatggagagattgatggatgggtagactgatggatggaaggatggatgtgtgggtgcgtggataagtgaatggatgatgggtggatgaatggatagatgagtggatgggatgaatgggtgggtagatgagtagatggatgatgggtagatgatggatgggtggatggatggattggtggacagatgggtgaatggaaggatggatgaatggatggatcgatggtggtggtggcaaaatggaagaccttccgtcaaccccacttgcgttccaagagacaggagaggacccagattcagaaccagggaagtgcttgcctaagagtaggctgtgtcctcaggccatgtcacctaacctgtccaggcccgcttctcattattaaaaggccccagaggagctgctttccacacctttcatcatgtgacagctacatgaactgaactgctgagttgcagggcctcctcttaaagaccttaagatcttattggagggaaaggcaagcaggcagaaagatggaactaacttcagggcagctcctgagcaggaatgtgaacccaaagggctgagcgaaggagcccatgaggaagtgaagtcatttggggtgggacactgcaggagcccagccaggtgtgtggggacagtggctgtggttaggacagtgggacacagccaaaggagagcctgggatgctggtctaaggagggcagcctgggattcctggaccgggcctccctgaccattggtggccacttctgaaaaggcctgaaggccgggagcagtggctcacgcctgtaatcccagcactttggaagactgaggcaggtggatcacgaggtcaggagttcaagatcagcctggccaagatggtgaaaccccctctctactaaaaatacaaaaattagctggatatggcggcgcatgcctgtaatcccagctactcgggaggctgaggcagagaactgcttgaacccgggaggtggaggttgcagtgagccgagattgcaccactgcactccaacccgggcgacagagcgagactccaccttgaaacaaacaaacaaaaaggctggacgcagtggctcacacctacaatcccagcactttgggaggccgaggcgggcggatcactaggtcaggagatcgagaccatcctggctaacacggtgaaaccccgtctctactaaaaatacaaaaaattagtcaggcgtggtggcgggcacctgtagtcccagctactcgggaggttgaggcaggagaatggagtgaacccaggaggcggagcttgcagtgagccaagatcatgccactgcactccagcctgggtgacagagcaagactccgtctcaaaaaaaaaagaaaaaaagaaagaaaaagtgaaaaagaaaaggcctgaagaccccggggctggggaaaggtggggaccagtctcctcactcttgttcccctccagaactggactgagccacagccacaagcttcaagggctgcccaaacaccccagactctgggtttgggacccctaccacccacagcgagaagacacagccttctagtgggggacccctccttctagagagggagaggtcatgagaaagtgaacttctcagcaacattcaagaaggttccacacacacacttatgtgttcactgcagcgttactcacaacagcaaagacacagaatcaacccagatgcccaccaacggtggcctgaatcaagaagatgtggtacatctacaccatggaataccaaccagccattaaaaaaaatcatggctgggcgcagtggctcgcaactgtaatcccagcactttgggaagccgaggcgggtggatcacaaggacaggagatcgagaccatcctggctaacacagtgaaaccccatctctactgaaaatacaaaaaaattagccaagcgtggtggtggggacctgtagtcccagctacttgggaggctgaggcaggagaatggcgtgaacatgaacccaggaggcggagcttgcagtgagccaagatcacgccactgcactccagcctgggcgacagagcaagacaccgtctcaaaaaaaaacaaaaaacatgttgtttgcagaaacatggatgcagctggaggtcattatcccaagcgaattaaggcagaaacaaaaaaccagagactgcatattctcacttataagtgggagctaagcattggagacacatggacataaagaggggaacaatagacactgtggactactagatgggggagtgagaaagaggacaagtgttgacaaactacctattgggtactatgttcactatctggctgataagatcaacaaaagcccaaacctcagcatcatgcactacatccatgtaaaaaacctgcacacgtcccccctgaatctaaaataaagttcactcagaagttcttcctctgaggagcttctgcagatgaggaggtgcttccacatcctgcaccatctcctgcttggctgctgtgcccaaggccaagactttgaggggactgcgtgctggggcctcgtgcagaagaagagctgggcctcaggtcacagagtaagctggtcctgggcttccagcttcttgctcccttactcttttcatcacacaggcagccaggacccagacctccatccctttcccctctctacctcaccctgcgtcagagacacaccccctaggaactgggcaattctggtcaattctccccacccgggcagccaccctcctacctaccaccactactaggccgggctacctcctgagattctctgcctgagccagtcctccatctgttcattcaacacacttgcccgggtgtgtctgcagagctccagatcagccagggggggcaacccatgagctgtggaacaaagtggaccaaggaaacaggtaccccctccacccagtggaagaccatcccctaggagaaagccccccaaaattagtgtatctctaaaattcatatccacctagaacctcagaatgtgatttttttttttttttttgagacagagtcttgccctgtcgcccaggctggagtatggtggtgcgatctcggctcactgcaacctccacctcccgggttcaagcgattctcctgcctcagccccccaagtagctgggattacaggcgggcaccactatgactggctaatttttttttttttgtatctttagtagagacggggtttcaccatgttggccaggctggtcttgaactcccgacctcgtgatccgcacccccttggcctcccaaagtgctgggattacaggtgtgagccaccacacccaggaagaatgtgaccttctatggaaacagggtctttgcaaatgtaattagttaagatgagatcatactggattaggtgggccctaaacccaacatcttcaatgtccttaggtgatgaggagaggacacagggacacacagacaagggagaaggccacatgatgacagaggcagagagtgcagtgatgaagctaccactcaaagaatgccaggaattgctggcaaccactggatgctggaagaggcaaggaaggatcccccttagacctttcaaagggaatgtggccctgccaacaccttgatttcagacttttgggctccagaattgtcagagaataaatttctgtggttttggccaggcactgtggctcacacctgtaatcccagcactttgggaggccaaggtaggatcacttgagcccagaagctcaagaccagcccaggcaacatggcgagagccctgtctctacaaaaaatacaaaaattagctgagcatggtggtgcatgcctatagtctcagctacttgggaggctgtggtgggaggatcacttgagcccgggaggcagagattgcagtgagcagagattgcaccactgcactccagcctgggcaacagagtgagaccctgtctcaaaaaaaacaattgctgtggctttaagctactgactttgtggcaagttgttaccgtggtcccaggaagatcaaataggaaccaacacctaagcctggcgctgtgagagcttcctgacaccatttaacactgagccaatcgttttcaccatccccatggccgcagaccctgtcgtcaccatcctggggcccacatgctctgaaacccagctcgagccccccttccaggaagcatgccccgacaaccgctccccctttctctgcactctcaggctgcttatttttagctgctgattacgtctaccttatatggttctctattcatgtcatgagcaggggctgtctcccctcctagtctgtaagctctttgaggacagagaatcccaaggatattaacagtcctgagcaggggaggcgtgttgatggattcccctggttggtcaagtttcatgatatttcaggaaactggaggcaaatatcaagttgccgcatactcacaagagtgataacctgtcattcttgtcatagtccttttaagcttagaaagtatctattatcaaaaaatattttaagcatccgatagccattttcttattatagtcacgaaacagccccatgctggaaatagagcaagtatcattatccccattttatgggtgaagaaacaaacgcagagatagtcagggacttggcggctgatttgtgacaaaaccagcatttgctctgcccccgggttccggtgctcccgctgggccccaccccaggccagccgctctgcctctgtgtagacagcgccaagcaaggagggacttggtggagtgctcaccagcttaactaccaattcggaaaggaaacaaaggcaggaaaggaggtgggctggtgtcttgggagcccgaggccaggatggtctccccaggacagggtgagtacttgacacttctccagttcttttccagattcttcccaagtcctagagagcactcccggtctcttgatctccttgggtaagtgcaagaaaaataagtaatcatctactacttgacactaagtaatcaacaaattggctagaggcctctctggtggacacagggacacaggtggtcacatcaggccctaaatgctgtgtaagttggaggcccatcagtggcatggcttccaaaggaatggcttggtcaagcctttacctattgccatctagacgaatttttttttttttcaacagagtcttgctctggcacccagactggagtgcactggcacaattacagttcaccgcagccatgacctcccgggctcaagagatccacctgctccagcctcccaagcagctgggaccacacgcataggccattatgcctggctaattgttgtatttttttgtagagatggggtttctccatgttgcccaaggtactcttgaactcctgcggtcaagggatctacccgcttcaacctcccaaagtgctgggattgcaggcaagagccaccgtgcccagcctaggggaaattctatgggagaaaactgagctggcctaggtcctagccaaatgactacctgaaggaggaccgggggctgcagttttggcagcaatccagtggtggggggaggcgggggctcccaaaccccgggactctcccctgagctcccagcacaagccacttcctacaagcccagaactccaggccagactttgtctgcacctgtttgagctcagagtacagtccctgctctagaagcatccaaaaatatctgagagagcggggaatagggaggggctatctggaagaaaacaggctagagtcttcagagggctgagagaaagagccacttggctcagcattcaaggttcttcccaactggccccaactcatcagggtggcctaatctcccccgaacacgagccccacactctagccagagctagtctcatcctgtccctggcagtgccgtgctctgagcttcctcacctcctggcttttgtcaccatcttcaggtgtctctgcctgcacaaatcatctgtcattcattagaccttgttgactgccttgaatgagccaagcgtcatgctacactgttcgtgatgaaatacgggcaaattaaacaaaggcacagcttccaccctccccaagctgaccgtccagcaattgtcccctccctgcacgttgggctgaaaccctgtccctctgcacagccaaccttcccaaccatcttctgaacttcaaccagagtgagcatagactgctggtgggggggtgttagttacatttttttttcagtgcgtgtcatctccccaaatagaaggtcagctcctgagggcagagacacaactcattcccgcctgcacagtgcagctggccaggacctcacagggctgacaaggggctgagagatgggcctcacagggagggacccacagctgccttacacctctccctgctctcatcaaatgccccactctctctgctccctgcagtctctgaggcatctgagtctgagattgtgccataccctcatgcttctatttgatccttttgtgccttcatccctaacccgagtccatcctgcttttccagcctaaagggggactccctttagggagcatctctcatttcttcaggatttggcacccaatctctcctctcctgccagggctggccatggcctgcattcattctgtgttctctctctcttttttttaaatatggggtctcgctctgttgcccaggctagagtatagtggtacaatcttggctcactgcaacttcgacctcctaggctcaagccatccttccacctcagccccctgagtagctgagaccacagtgtacccactacatccagctatttttaaagtttttttgtagagacaagatctcactgtgttgcccaggctggtctggaactcctgggctcaagcaatcctgccgccttagcctcccaaagtgccgggattacaggtgtgagccactgtgcctagcctattaattaaatttaataaattattgctttaattctgatttaatttggtgctttcattctgattctgccaccttccctgagatggggtggctcagcaattgctgctctgggagtccctctgtgacagacaatgaggaagtcacaggcaacaggcatgtccccaaggtaggggggcagctgggaccttgactccgagtaaaaccaccttcagggctgcagagggatgagggaggctgaaaatagatggaacaggacttctctgatattagagaaggatgacagcacaggctgccgccatcgaggaaatgaatcagtctctagaaactcagttaaatccgtcccatttgctaaactgcacccacccctgtcacgtcctactgaggatacccagctagggatgagcacaggggactgggacctctcgagcactgggcagatcatgcttagcagccgtgctcgccatggctccaattcattcattcattatttcacccattcaggacccagaagagaaacccctgctatgtagctcagtccctctgcgctcagaaccggtgaactatttaccacctccgtgttgagatttaggaactttgggtgagaccttgcctgccaaatgggaaattccatcttagagatatcttccttgagctgaaatcttctgaatcctctgaaacacagacagacttgagcaaagtgcccatctgtgctgcgagtcaccagcctccactgcaatgagctgcagctccccccatgaccagtgtcttggtagcagggacaggggtcggagcaggggcccagcctgagtagggaagggagacccaagagggaatgaaggagccaaatagggcggaggcagactctgaagatcaacttttagctctaagaagacaggtgaggccaggggcgaggtccctgagaagacaggactcccagagcaaactcgggagagaacagaagccagcccaccaccttgagccaaagtgagtcctcatgccaaagtgagtcccaccaatgggacacgagagggcacaggcctcacagccaggaacacatcatgaaggggacctgaggctggactcccatccccagtccacaaagaagaatgaaaaccaaagtcagctgcgtgcagtggctcacacttgtagccccatcactttgggagaccaaggcaggagaatcacttgagcccaggagtttgagaccagcctgagcaacatagtgacatagtgagaccatgtatctacaaaaaataaaattagctgggtgtggtgacacatgcctgtagtcccagctactctgaaggctgaaatgggaagatcacttgaacccaggaagttgaggctgcagtgagctatgattgcaccactgcactccagtctgggagactaagtgagaccttatctcaaaaaaataaataaaaattaaaaaaagagagaggactacagtcatcatctgagtaactcaggccacatatccaccgcgccaatttccacttaaaaaagctagccctgggccgggcacggtggctcacgcctgtaatcccagcacttgggaggccgaggtgagcggatctcgaggtcaggagatcgaaaccagcctgaccaacatggagaaactccgcctctactaaaaatgcaaaattagccgggcatagtgtagtcctggctactcgggaggctgaggtgggaggattgcttgagcccaggaggtggagactgcagtgagccttgatcaaccactgcactccagcctgcgcaacagagtgagtccctgtctaaaaaaataaataaaaagaaaacgtaaagaaaaatattttctctacctcagtaaacccatctgcttttaagttactgttgctggcctttatttatcccaaacttaatttttaaaggtttctatgtctaaagatgttgcctcctcatcctcactaaataccctcaaaccctcctcattggtcagtgacctcctggttgtcagaaggaacagctcctctccctcagcatctctgtgatatttaatcctgctggccactcgcccttcttctagaagacctgggcttgcaggtcactgtctcttcttgggtcccttcctatctttctgaaattcatttatcttcttcctcttcctactcctcaaacttagcgttgatcaaggactggtccttgaatctttgtctctccctggtacagctccatgggtgacctcagagcctccctctcatctttacgtaaatgaatctcactcctaaatgccctgacctgacttccctcctaagctccagtcctgcctaacccctgccacctccttccagatgccccacgagtaaccaatcttcataatgacccaaactgaactttttttttttgagacagagtcttgctctggtgcccagactggagtgcagtggcatgatctcagctcactgcaacctctgcctcccgggtacaagcaattctcctgcctcagcctcccgagtagctgggattacaggcgcatgccactacgcccggctaattttttgtatttttagtagagatggggtttcaccctattagtcaggctggtctcgaactcctgacctcgtgatctgccctcagcctcccaaagtgctggaattacaggtgtaagccactgcacccagccgtgaacttttttttttttttgagacaaggtctcactcagttgccgaggttggggtacaatagtgccatcacagctcactgcagcctcagcctaccaagctcaagcgatcctcctgcctcaacctcccaagtagctgggactacaggtacccgccatcatgcccagttcattttttctattttttgttttattttctatgttgtccaggctggtctcaaactcctaggctcaggccatcctcctgcctctgcctccgcctcccaaagtgctgggattacaggtgtgagccacttcatccaagcccaaactggactcaaaatctgttcctctctcttatgttcccagtctatttttctggcaagatcattctcccagtgacctcaatggaacctgtaagggccccctcccctggcctggctcccaagctgggaaggccagggattctacaccagctgtcagctgggtccaccccttctctccactcccaacccctcgcccaggtccacactccctcacctacctctctggcatggctgactaatcagtctccccctccctactcttcctacaaacaactgccagacggatcttccctgagcccttggtagtgacccgctgcccacagagcaaagccctgcttagcctaacaaggcccttcacacttcagccccacccctgccttccgaacacgtcccgccaccccacttccatctgcccgccttcatgcaagacagaacaatgctccccttccctgggtctcaccagagccccgttgctctggcaccgtgagtttgctcatcttgttccctcaactcagaattcccttcctgccatctttctgttctgaatcctgctttcttcaaggcccagctcaaatattccctcatccgtaaaaccttttctgatccgatccactcagctcaggatggtctcctccctgccttcagccccaccttgcttttcctgtgcctccccagtgacactgatgtgtgtcccatttgactagattcagctacgtgcaagggagaagacgcctcctctcccctactggactataagcactgaggacaaaatgcctgtctcaattcccctagtaccatacttcaaaaacagcagggatgcagcaaacgagggatgggttcacgaatgatggaacacgttgaggtgtttgaatgacagggttgcacatacgagcgatgtttacaggtaaggacttatgctgcgatgaggcctggatttgggtttggagcagggcatgtgcccaggagagagagctaagtaagcccaggcgctccatcccacagccatggccctccctgctccccactcccccagccacctgcctcattccagccaggatgcacagggcctagctctgtccttagcctgcaggccaggtcagagaacggaaacagctgtccccctcctgagtccataggctgactctccccagcccactacacccaagcaggcatcaaacggccagctagatgctaccggcctcatctggacctccctctgggggataagcgggtaaaagcactggccaaggagtggaaaggactgaattccagctctggcctgccatgaactcactgtttgaccttcactgtaatacctggatgtaggaaaaaaccagcagttcctaaacagcagttccacaggccaccatgcccggtgccactttttttttttttttccttgagacaaggtctcgctctgtcacccaggctggagtcagtgatgcaatcacaactcactgcagcctgaccacccaggttcatgtgatcctcccccctcggcctctcaagtagctgggaccacaggcatgcacccctacaccgagctatttttttttttttttagagacagggtctcactatgttgtccagactggtctcaaattcttagcttcaagcgatcctcccaccttgggttcccaaagcgctgggattacaggtgtgagccactgtgtccgaccaccgtgttaccttcttgagggatgtgttcattagcaagacccagtctagtgcattccaggctcactgtgggaccagatgtcccctacaggcttgcccggctgcaccaaatgaggagtcagggaaccagctgtggggaaaaggcttctggggtctgttctctccccaagacccctgagcttgctacattttctcagcagccctgccacagctaggctgccctgatgaggaaactggagtgctggcctctttccagaaataaccagccaggggtgggagagaaaggggcggggaaacagcttcctgaccgtcactgcacccttgtctcacatggcgggcactgagctgtgggcactcacagaggggcagccccagcatgcaccagccccttgccattggggtggccgggtggggccagggcagatgggcaagtctgaagctagggctggaggtggaggaaggatgagatggacaggaatccccagatccccaatctccgtatcaagcaacaagagggacaacaggaagcaaagaggtcccaaattctgcctttagcagtaaacaccaatggcttaaacccgaagaaatgaaatgctttctcagcagacttcgctctccagggaaaccaaaagcatagctcttcgccctgcaaactagggaaactcccccaggacggtcttatccactgcaccctttctcctcctttcacactcaccgtacagggagagaggggcttgggagtgcaggcagggtctgtcacagagagacgggctgaggaaaggagaggaccctggcccgggtgtgcctgtcactgacgcgctgtctgacctcggaaaagttttcctgtttctctgggtttccttcccttccctggatggtggggagaccgatcaaatcattgctaggggcgtttcccactgctttaaggaggaacagccccaagccaggactcccaaagaggagggcccagtgggtggtacaaaggcctgagtgcagcagcaggtcgggaggtggaaaccgggtaaggccccacctggctgctccttccccgtcctggcatgggcacgggcgacgggtggttggtaacagaggggcgcttgtctcctcacagggaggcgagaaggagggctgcagagcccaccaccccagccagagctgcacacgagcaacaaggaggagaagccggaggagaagctctgtggggtccctggcctaggaagcagatgggagtggtgagcgagaatatctgccgccacccagccaaggagcaagcatgatagggagggaagttagcacacagcggagagatgagggaaagaggtcaggagccaagatgtgacctttgggtggggtggtatttaccggggtggcacaattctgaaggggaaatcacccagtaggaaggactgtcatgatgggggcgtgaggaagccaccttgtgggttagaacctgccggtggatgcaggaggaggcctattctggggtatacagtccacagtggggcagagtcctgataaaatccaccacagtggatgaaacccacagcccaagtgctgagcaggagcagggacagagggaagctttacgccggaggttgggccaggggcagacgcacgctgtgggacccaggaaggaaagacagcagagagaagggacctttgcacaagcacctgcctgcgtcctttccccacgacaagagcccccagcgaggcctgcagaacattccagatgaccagttccctcggtgggaggaaagataaaggatgtccctaaaaggccaaaaattcctggggcccagtgtgtagcagcccagcagctggggctggggggcagcacaggagcggccacgaagggagagggtggcagcggcttggggctccggatccaattacgcggctgtttccatacttagccgcctgacagccgcctggaatactcagcactcaagccgctgcagccctgcagagcccaaattaactcaaggacagacaagggcagggcccagcagcacatgcagtggctggagccccccaccttacatcttgagtccccgagaaatagcttttgttcccacccactgcctgctctccctgcagggactgtgcccctgcaaccccctattcaacctcaaagacctgagaggctggactctgggcctctccagtcccaggtacggacctaggctcagagcccagcttgggggaagactgccgagtcatgaaaagactcggtgggcagtccggatcctagggggatccccggagcacctccctaaaagcattccctcggggaacctggcctcaggaaccttaggaacaagagaggtggcaaaacaatctggcatctcctccatagcctatagataacccccatgctgcaacccaagccaccacctctgctacccaaagtgctgagatgtcaaagggaagcctcagcacacagagccaagccccttttctgatggaagcccccaccccgagcagaggctctactccagaacgggccccgttcctcttctgaattgcatccaatgctgtttccagcccaaccgccaactctatttccgatcttatcccaaaccaattccaattctatctcactgctcccaaaacggtccccacctttgcccactgtatccccttctgtccacgcaaacccagttctcttacccgagtggggcctccgccttatatcccaccaggtgggagggtcacctcaacgacctccagctcccagactgtgctattttgtccgtctcagaggctcccccgtctcgactttgagggccctctttcccacatctactggccagactcctctctgaccctggctcacagctcagctctgtttgccgttcccacttcctctggccttcctgagggccccgcaactgtgctgctattctccagcacccagctctttctctgaggccccaggcccggggaaaagagaagggtaagaagacaccagccaagagccagggtttgccatcagccccgaccccctacccaacccatggtagacagaaaaccttggaggaagcgtgggggaccagtctgggctgggtcatgctgggaggggccctacctgcttgtcctgagaacaggagcgaggccaggaggcagccgagcaggaccagcgccctcatggtgactgccaagagagcccagctgctcctcgcctctatttatacggccggccgtggcagcaggcggtggaggggggagaggggtcacacagtcaccagggcaactaggagggtgtgatggggaagaagcccggaccccagaaggctgtgcagaggctcaggctgcgccactgctgtcccagctgccaggccccagaaggcagggccgtggctggattctcttcccccgaacccctgcagccctgggatcacatgacatgggtcacagggcgtgggtgacaggcataaaatggagcatcccttgggctcaggcggtggagctgggaagctgagtcttcccagaacttgcaataacttgacctgaagtctcggcaggttaaggaccttgacacgcctgcactggaaggaggaagttgtaaggccacgcaaaagaaatcctatttaacagccactgatccacatgctagagagtggtcagctacggcaaacccgcaacatgtgacctctgaggtccaaggctgcagccctggaacaaccttcccagcctctggaagagagagagcacagaccagagggagaggggcacactgagacacaagctgaggctacggtgtaaactggaggatggagcaacagatatccatttccaatggcccaggggttccagaacattcagtcacctctgcaaagtgcttttttgtttatttgtttttgatagaggatctcgctctgtcacccaggctggactgcagtggcacaatcatcactcactgcactcgacctcccaggctcaatcaatcctcccaactcagcctcccaagtagctaggacagtagtgccaccatgctgtactaattttttaaaattttttgtagatggcccagagagccagttgtaagaagccaagggaaagcagacacttgcttgtctggtcggggtacagtgtcactgtgtggggaagaggtagaagccagccttggaggaaaggaactaaatcagggccaggcacagtggctcacacctgtaatcccagcactttgggaggccgaggcgggtggatcacctgaggtcaggagattgagaccagcctggccaacatggtgaaaccccatctccactaaaaatacaaaaattactgggtgtggtggcgggtgcctataatcccagctcctcaggaggctgaggcaggagaatcacttgatcccaggaggcgaaggttgccatgagccaagattgcaccactgactctagcctgggcaacagagcgagactctgtctcaaaaaaaaaaaaaaaaaaaaaaagaattaggcatctggtaggcacttgactttttttttttttttaatcttttttaagagacagggtctctgtcaccctggctggagtagtgacacgatcatagctcactgcagccttgaactcctgggctcaagccaccctctcacctcaacctccgaggggctgggaatacaggtgtgcaccacatctggctaatttttttgttttttgcaaacatggtcttcctatgtcactcgggctggtctccaactcctgggctcaagcaatcttcctgtctcgacctcccaaagcactacgattacaggcatgagctactgctttttcaaagacaaggtcttgggacttttcctcttggaagtcccctctctctcactaaggagctgtttttctttctctttcttttgcctgttaaacctctgctcctaaactcctcatgtgtgtctgtgtcctaaattttcttggcgtgagacaatgaaccccaggtatttaccccaaacaatgtagctgcttcatgttggggacctcatccgggatcccaaggtacaacactcatcaaaacgagtcaagaaaacttattgtgaactatttatggcctttaataattgaataaggtatactcctgtgaagaaaatttggagcatgtttgtttctctctgcctggtttctctggaatctggaaactatctcaacatctggtggaggcaaaccagtgttacaacccatcagaatggctgacagtaatcaaactctaaatggtgctgcagacagaaccatgcacggacatgccttttttccgaggacccttagctcgaccccaggaggagcccttagcttctgttccccacacaacaccccttttaagtatgaagtagccagaaagagtcatcatcaaacaaccccgaagagcagttagggttaccactccagagtggggaatgatacaggagttaagaggaaattacttagatagtgaggatacagaagtcctcagtaaggttttccttttactgaaaagcagccccaaatcattttcctttctaacaaagagcagcgtgtaaaatcgagctgcagacatagatgcaggcagttgtgccaatcatgttcaaaatggcggctccatcttcccttctctgccagccacgtgcacagtaaggagcagacaagatggtgctggccaaggggaaagttcatttgcataataagattagagtggggaggtcagccttccccacaccccagcgctatgtaaacatcatacctgactgaaccaatctgtgagccctatgtaaatcagacaccacctcctcaagcctgactataaaatccagtgcatctgctgccggtggcgttttcctttcagaagtaccctctctctcactggagagagctgttttcctctctctctttcttttgcctattaaccctctgctcctaaaaattaaaaaaataataaaaacaaaaaatttcaaaaaataaagatgaggtctcactgtgttgcccaggctcctctgaacttcccaggctcaagtgattctcccaccttggcctcctgagtagccgggactacaggcgtgagccaccatgcccagctctgctcagctcagctcagccttcagacagaagctgccagagccctcagcctaaaagaccccaccccattttcagaaaccatgcatccctaggcacacctgctcctgactgtctcagactgacattcctcagatgactggggaggaagcatgtttgagaacaagacgtggggcagaagaaaaaccatgtagcccggctactcctttccaatggtcccatttctgatgccctggagccagcgtcagccagctgcttctataaggggccaggcggtaaacagtttaggttttgttggccatctgcaactcttccactctgcctgtgtagctagagcagctggcaccacagagatgaatggatgtggatgcatcctgataaaactttattataaaaaaaaggcagcttggttccaagctgtagtttgcaaatctctgcccatactctagggaaatcatttggtgaattactttgtaaagcagaaaatcctttggtaaaggaccacccatatcagcgctttatgaatctgggttttcctacgtctggctgcttcatgtgggggttcagagctagaaaggggaaggcggtgcaatatctcggggccaggggatgacgtgtgtgtaacgaggctgctgtggatttgagcctgggagcacatgctccggggagaaatacgtgaggagtttcatcatctttttttttttttttttttttttgagacagggcctcattctgtctcccaggctagagtgcagtggcacaatcatagctcactgcagcctcgacctcctgggctcaagcaaacctcctacctcagcctccaagcagctgggactactacacctggccattttttctttttctttttgtagcaacatagtctacctacgttgcccaggctggtctcaaacaatcctcctgccttggcctcccaaagtgccaggattataggcgtgagcctgacaagaagagtttcttgggggaaagaagtaggtttaaccctgaaaaactttctccgatcaaatgagaagaggtccccagaagcggcaagtcaacatcacagtcacaaatgtttatttggaggacctgacagccaggtctcaattgctaaagtgttgccacaagaaggaagtattaggcttgtcctgtgtggttcctgagggcaaggccaggtttgatgggcaagggtgacaagaaacccattttagctcaaggtgaaggaggatgttcaggttgaagctgcccaggagaggaacaggattgctgataaagaagtgtcctgtccctgcatgggttccagcagaggccaggtatgcagggacgggcactgctcaagtgctttccctccctgcttgtgcttaaagtctgattctagggaagactctggggctggtgcctcctggaggccctctgcctctgtccctacatcatttcctctggaactccggcctcactggtttctgcgggaggcgcttacgtgcaacaagcctggcccgcatccttgtctcaggaccgtgggctgtctctagggtggtgagggatttatccagcaagcagtgtccttgagatgaggctgcatctgccagcgggcatctgggtgggcagggactcttggaaagccaggggctgtgaaggaaaggagagcttctgcacgccgcatcccagccatttcagcaagggtcttgggggagggtctggatgggcctcctcgcctgcttcctttttttccacttcacttgcagagggctgctcctctcaaagctcaaagtgctcctcttctctgatggagaaaatccctgggacagggctcagagccacacgtcggtgattccggggaagatgcgggcctcagttgtcaaacagggcagccagcctcatagaactgctgtgagggacacgggagatgctggaggacacaggtcatgagtatgagctcactgaattatcacaaagcacgaagagcaggtgatgggggggacagggagtggagatgataagaaaggccacagcccctttaccgttctgggcacgcacttcctgtggctaagcccctctttggcagctgacttgctgtatcgtgccacacctcaaacggttcctcaaagggctaggaaaatcagattgaacatgacaactcaggtctctgaatccattttgtactcaagactgacccagcgttaacatgtaaccctcattgaaagtattgtcccatttatctcagaaatcataggttatctgtcttagagggacccaaattcccacccaagcagaaatcccttaacagccagccatccagcctctgaatactcccagcaacagagagctcactaccagacagctacagctctgctgttctgaagagtgtagggcctagaactagccacggtgctccaggtctcctcccaacttctaagtctcaactttcagccaaaagccaggagcaggccgggcgtggtggctcatgcctgtaatcccaacactttgggcagccgaggcaggtggatcacttgagtgttgcaggccgaaagagtgagggtcgtgatcaactcagtgcaccactggaggctatatgagtaaacagcaaactgttttcatgaaagcagggtgttggcaaactgacaaactgcgtctgccacccagaaggaatgctgagggcagtcacgacccagcacaagtgtttcttgtaatgagataaggtgaacctgtgatcaatcaagcagctgaccaattgttacctcctccaccctgctctttctaccgaatgagtatgaagggcggtagaggttcaaggcggctgcccttgctcactagaagcagggagccctcttcttcttcccctggccccttcctttaaaacagtttcttttgttttaagttttcatttctacgttcgtaccccttcgtttagtcccgtggtaactgtggcaaaccgcggcacttgaggtcaggagtttgagaccagcctggccaacgtggagaaaccccatctctactaaaaataccaggcgtggtggtgcacacctgtaatcccagctactcaggaggctgaggcaggagaaatgcatgaacccaggaggcagagccgagtaagccgagtattgtgcctctgcactccagcctgggtgacagagtgagactccatctcaaaaaaaaaaaaaaagccagggacatgcaccacaaggatcccatggagaatgagcactacctctctcctgatcgcaaccaagccaccccctgctaacccttatacctgacatctccttctcctacaacagaacagcagatacagagactcactctgtcgcctaggctggagtgcaatggcgtgatctcagctcactgcaacctccacctcctggatgcaagcaattctcctgcctcagccttctgagtagctgcgattacaggcgtgcaccactacagtccggctaattgttttgtatttttagatggggtttcatcatgttggtcaggctggagaacagcagtttgtcaattctctttgcaaccagaacgttcagagcactgtctacatctcccatagggcaggagacaataggagagataataaatgtgtatcaacagactaaccgctgatgtgtgtggcacctgcaaccccttcaaccttcacaaatcacctgcctatttattgaggccatccaccaagatagccggcaccctggggaaaacttgacttgggccccctaattcaggcaactttgcagctgtcattcttagctcctaattttttttaatttatttttatttatttatttttttggagacggagtcttgctctgtcactcaagctggagtgcagtggcacgatatcggctcactgcaagctccacctccagggttcaggcaattctcctgcctcagccccctgagtagctgcgactacagattttttgtattttggtagagacgggtttcaccgtgtagcccaggctggtctcgaactcctgagctcaggcaatccgcccgccttggcctcccaaagtactaggattacaggagtgagccaccacgaccagcctttgttgttgttgttttgagatgcagtcttgctctgttgcccaggctggagtgcagtggcacgatctcagctcactgcaacctccacctcccaggttcaagcgatcctcctgcctcagccccactagtagctgggattacaggcaggcaccaccatgcccagctaatttttgtatttttaatagagacggagtttcgccatgttggccacgctggtcttgaactcctgcccttgggtgatgcacctgccttggcctcccaaagtgctgggattacaggcgcgagccaccatgcccggccagctccttgttttctcaatcgggggtgtggtgggagaagctgctttggggaactcattcctttcttcagctgccagatttagagctggtcctgccgcagcccccagtcctatcccctcctctgtcagcacaggttcttgtcaaccaacagaataaacttgcgactcagcagggcaagaggagaaaggagacaaaggcagaggatgatataacgccatccctgcccaggacctgcaggacaagggaggccaagccggccaactcaacagagtgaaaatgacaaatgctacaaggccacacagcatcgaggaaagcacagacagacagctggttcaagaaaggacaggaggatggactaggatgcgggggaacaccgtggagccagaaacacaaaaaaatctgaagctgaggacagcatggccagctggctccaagaggctgtttgaggatttgcatgtgctttacatactggtctggggccagttagtcaactgataagggggccaaggtcacaggaagggacccctcttccactcaatagcccttcaaacatctagcagagctggggcatcgctctgctgcacggccaaagacacccccaaatcatggcaccaaaggcacgtttttattataacccacccagtaccagaaagacatagaaatggcctttctctataaaatatagcaagaaagcacgaactggaagtactagtggaagaaaaacaggaaggcacacagtatggaaccattcgtaagactaacgggaaaaaatgacaccatatatttcagtccctcacatgtgtgtaacttgaccacctgcccaattcagtgtccttaaaataagagcaaaccaaatgcttggaaggagtgaaattatttcaactattgagactcggcaagaatttcttctgagaatcctcgtaaagaggaaacagatacagcacaaggtaatgacacttgagaacattcttagaacagacatacattttccatgaagtttatccctaatagagactcttaaaatagggcaggggaccagccaggcgcggtggcttatgcctataataccagcacttcgggaggccaaggcaggtggatcagttgaggccaggggttggagaccagcctggccaacatggcaaaatcctgtctgtactaacaatacaaaaattagctgagcacggtggtgcatgcctgtaatcccagttactcgggaggctgaggcaggagaatcgcttgaacccaggaggcggaggttgcagtgagccgggatagcaccactgcactccagcctgggtgacaaaagtgaaacttcatctaaaaaaaaaaaaatagggcaggggaggccacagagaaccaagaatgcctggccccgcctcaaagaaatcaccccccaaacagggtccatgacacatgcttaggacacttctcctgaactgtcaccttacatgctgttggtaggagagaaaattggtaccatgcatttgggggatggtagctactaaaatctagttataatagccctaagttggaaacaacataaatgtccaccatggccaggtgcggtggctcatgcctgtaatcccagcactttgggaggccgaggtggatggatcacgaggccaggagttcaagaccagcctgaccaacatggtgaaaccctgtctctactaaaaatacaaaaagtagcagggtgtcgtggtgtgtgcctgtaatcccagctactcgggaggctgagacaggagaatggcttgaacctgggaggcagaggctgcagtgagctgagattgagctattgcactccagcctgggcgacagagcaagactctgtctcaaaaataaataaataaataaataaataaaaataaataaaatgtccaccactaggtgaatggataaacaaactgtggtctattcatacaatgaaatagtacttagcaagaaaaatgaacatttatgtttacataaaaacataaataaatctcagagatattgtgttgagcaaaagaagctagacaaaaagaacttacgtgttgtatgactgatacaagcttctagaacaggcaaaactccagcctggccaacatggtgaaaccctatctccaccaaaaaattgaaaaattaggccaggcgcagtggctcacgcctgcaatcccacaactttgggaggccgaggtgggtggatcacctgaggtcaggagttcgagaccagccaggccaacatggtgaaaccccgtctctactaaacaaaaattacctgggcgtggtggcgggcgcctgtaatcccaacaactcgtgaggctgaagcaggagaatcacttgaacccaggaggcagaggttgcagtgagctgagattgtgccactgcactccaacctgggcaacaacagtgaaactccacctcaagaaaaaaaaaaaaaaaattagccaggcgtgctggcacacacctgtggttcctgttactcgggaggctgagacgggagaatcacttgaatccaagaggtggaggttgcagtgagctgggatcatgcccctgcactccagcctgggcaacagagcgagaccctgtctcaatcaatcaatacacaacagcgaaaactaatatactgtgacaggaattaaaaccaaggccaggtgtggtggctcatgcctgtaatctcagatctttgggaggccgaggtgggaggactgcctgaggacaagagttttcagaccagcttgggcagcatggtgagaccttgttcctattttttaaaaaaagagaagaaattaaaactatggtgagattccaccatacacctaccagaatacctaaataatgataaatctgacaatactaagtgctggtgggaatgcaaggcaactggaactctcataaaaatggtagagaatagagaactacatacacataaaacattaaaaaacgtgtaaatctgagtaagtcccatgtacagtaccaatgtcaattacctggcttctatgctaactgtagctatgcaagatgttaacactgagggatactgggtgatctccctatacatctctttcttttaaaaaaaaaaaaaaaaaaaaagataggccaagagcagtggctgacgtcgtaatcccagcactttgggaggccgagacgggcagatcaccttaagtcagaagtttaagaccagcctggccaacatggtgaaacccgtctctactaaaaatacaaaaaaattagctgggcgtggtggcgcacacctgtaatcccaaataactcgggaggctgagaaagaagaatcacttgaacccgggaggcggaggtccactgcgctccagcatgggtgacagaccgaggctctgtctcaaaaacaaatagagatgaggtcttgctatgttgtccaggctagtctagaaatccagggctaaagccatcttcccccttcagcctctctagtagctgagactacaggttagaaccaccaacccagacttctccctgtacatttcaataattatttcaaaacttaaaaatctgaaagaaagcaaactgcttgatagtggcagaaagcaagcatgaggggattctggggcttgctgggggtgttggctacctgggtgtatgttcagtttgtgaaaattcacggagcgcctaagctatgcaccctcttctgaatgtgttacccagtactccaataaaaggcttttggccctggagaggtggctcacgcctgtaatcccagcactttgggaggccaaggcgggcggagcacctgaggtcgggagttcgagaccagcctgaccaacatggagaaaccccgtctctactataagtacaaaattagccgggcgtggtggcgcatgcctgcaaccccagctactcaggaggctgaggcggaaaatcgcttgaacccgggaggcgggggttgcggtgagcccagatcgcgccactgcactccagcctggtcaacatgagctaaattacgtctcaaaaaaaaaataaataaataaaacagccgagctggaggtgtgtgcctgtaatcccagctactcaggaggctgaggcgggaggctcgcttgagcccggaaggtggaggctgcagtgagccgagatcgcgtcactgcactccagcctgggcgacacagcacgactcttttaaaaacaggttttgttgagtgccgcattgatccggtccctcccacgccccctgtgcttcacaaaaacgtcaggtccgagctccggcgcggcggtctcctcctccgcgggtccgggccggaactcggcagaaggacgagcagctccttggggccggcagtctcccatcgcactgagattgacacggcaatgtttcggatactctgggtaaaaattaaatgtcttacgaaaagtcctgtcacccgtttcttgattactttttacggcggcttccagaacctttcgtcagcgcgagctccatgcccggaggccgccgtcacctgctctccgggaaggccctgggcaggcaggcagcgcgctgaaggagtccgggagcagatcgtgcgagagagcgcgcgggcgccaggcgcgggggcggggccagacgtgcgtgctggcgggagcgcgcgcgccatggcctgaggcgtctgggaacatgcgcggcgaggggacgggcggggcgagtccgggaaggggcggggccgcagccgcgcccctgacttccaccgcctgcgggtgagaccgcctaccatcgcccggcgcgcttgagcatgcaaggggaggtgggattcccctggcccgcccccaagccacgcctctggcctatgagaactgagctgtcccgcagggaccgagagaggagcctccgctttcgcaggggctgggcgttccgggcgcactgcgccctctgttgatcctcttaggagctgcgtggggaccgtcgggcctgccgtttcgcacctggccgaaaggggtcgctgtgccgggccagatcctatgtaaatttagctggataatctcagcaagagaaaattggctgcagtgcaaagaagccaggctcaaaaggcagggttatcccatttctatgacatgtcacaggtaagactatggcaacatagatcagtggctcctaggggctgggttgaccaccaagaggcatggggggcattggaaatgaaggaactaattcatatcttttttattttgctttggttttatttattatttatctatttatttatttttgagacagtttcgctcttgttgcccaggctggagtgcaatggcgcgatctcggcccaccgcaacctccgccgcctgggttcaagcgattctcgtgtcttagcctcccgagtagctgggattacaggcatgcgccaccacgcccggttaattttgtatttttagtagagacaaggtttctccatgttggtcaggctgctgtcgaactcccgacttcaggtgatccgcccaccttggcctcccaaagtgctggaattacaggcgtgagccaccgtacccggcctgttttattttttctttaaatcatatcttgatcatagtggtgggtaggaaactatgcatttgcgtgtaggaaacacgcaaaaccaaaaatcagaaagtgtgacttctactaaatgtaactactttcatttttaaaaattatttatttatttatttattttttaagatggagtgtcgccctgtcacccaggctggagtgcagtggcacaatctcagctcactgcaacctccacctccccggtgcaagtgattctcctgcctcagcctcaccagtagctgggaccacagttactggcattcgccaccatgccaggctaatttttgtatttttagtagagacggggttccaccatgttggccaggctggtctcaaactcctgacctcaagtgatccgcccacctcggcctctcaaactgctgggattacaggcgtgaaccactactgtgcccagcctaatttttgtattttagtagagttggggtttcaccatgttggccaggctggtcttgaactcctgacctcatgtgatccacccgcctcggcctcccaaagtgctgggattacaggtgtgagccaccacgcccagccaactactttaattttttaaaaaagatattaaaaccagaaagcaggtggttgctggagactgggaggagggggaaggagtgactgcttcatggagtcattttggagtgacggacatgttttggaaccaggtaggctgtgtaacactgtgaatgtatgaagtgccattgaattgttcactgtaaaattccaagaaaacctgcagactcctgcctttctgtgaagagttcgtgtccactgtcatcgtggggtgagctgtgattctgccttctgctctggcctcagtccccaagcacccagcactgtgagcatgaggcataggaggggaccacggtgtaaatcgatctctggtcacggaagagtgaaggatttaaaggaccatggcctagcctgggcaacatggcaaaaccctgcctctacaataaaatataaaaaagtcagccgggcccaggccaggcacggtggctcacacctgtaatcccaggactttgggaggccaaggtgggtggatcacctgaggtcaggagttcaagaccagcctggccaacatggtgaaaccccatctctactaacaatacaaaaattagctgggcatgatggtgggtgcctgtagtcccagctactcaggaggttgaggcaggagaatcgcttgaacctgtgaggcagaggttccagtgagccaagatcgtgccattgcattccagcctgggtgacacagcaagactccatctcaaaaaaaaaaaaaaaaaaaaaaattagccaggctttgtggtacaggcctgtagtcctagctactagggaggctgaggtgggaggatcacttgagaccaggaggtcaaggatgcagtgaactgtgatcaaaacactgcactgcagcctgggcgacagagcaggaccccatctcacaccaaaaaataataataaaaatttaaaaatagccaggcatggtggctcatccctttaatcccagaactttgggaggccgaggtaggcggatcacttgaggtcaggagttcaagaccagcctggtcaacatggtgaaaccctgtctctactaaaaatacaaaaattagctgggcatggtggtgcactcccgtagtcccagctacttgagaggctgaggcaagaagattgcttgaacccaggagatagaggatgcagtgagccgagatcacgccactgcactccagactgggagacagagactctgtctcgaaataaaggaccatgccaatccccaataggatgcaatgtccttgtgccgttattatcgccaatttttagaagaagaaattgaggctcagaggaagcggtttgtcagagggggaactgacctctggcagaccaattccaggatcttagcacttaaacaccacaccacgggggggcaggggggtgctgggggggtgcggttggagggggtggggttcccctcctaggggaggagaggatgaggctcagagaagttacagaagcccaggaagtggcaaaacctagggattaaccaaagcgtagggaccaagcagggcccctgaacacctgtgtcctttcccaggttttcggaatcggtggcttggttgtccttctctccttgccgcccaccaaagagccactccccagcctcaacaccatcttccatctttacagaatacccagggtcatcccagggaaactgaggaccccaatttttcatcgcaacaccacacacaagctgagggagtaactgtgctcacacacacccagtccgctttggggggcccaaggagcccccctactctagatggggtagccctgccctggtcttcaggccagcccacacccaggagactcagaatctaaaaaacaaagtacaaactttattttgtttctttacaaaggcacggtggcctcttggtttttttctccccactttcttaacaaaatataatagcttctccttgaacacgaagacctcaaaattgtaaaaaaaaaaaaaaaagaaagaaaaaaaagaaaaacaaaacaaaaacagaaagcaaaccaaaaagaaataaaaaaccaacaacaaacaaaacaaaaagagagagacagacatttttggggtggaagatgagacctggaggcagaggtgggggctggggggtgggagagtggcgaattctagtgccgagatggggaagggggaggggggcacagcagcagcaaaccccaaccaagaagcaacggagacctccgggcccccagaatgccccagcctagtcttacccccaaccatgtaagtgcttaaaggagaaagaagaaaacccaaaaagaggaaggaaaggggattgaaggctgacaatcccaggctggctctgggcagggaagaaataacctggggttttgtttaattttccctgttcttaaaaaacatatttaaaggaaaaaatgctttttggcagagagaggccaggcatctccgtgtcagcttcctccagcccccggggccgaggccccgccctggggtgccgatgctcccacacgctctgcgacaccccagccccgggacctcgggttgagtggcttcgttcaaaggtcgatttacagtattgaaaaagaggtcataaaagagacccaaatgacatcgtaattttgtaaaaatttctcactcattcgcccatgtctctccctgtggctgccccggctccctccagcccccagaagggagaggagggctgggggggtagtcagggaagctccccgtcccccgacggctcctcccggctctggtccatggcgtcactgtctgaggcctcggagtcggaggcggtgtcagaggtgggggcctccgggcagctgcggacaggcttcacgatgacagctcgccgctgctcctcctccagctcctgcttttcctgggtgccctcgatgtgctggattgcctggacagggacgaaccactgagaaggctcggccggggatacatggccagccaggagacagtgggggctctcagccagccactgtcacccccaaaacacatagcccagaaaaaagcctggcaaagcagcaggggaggcccgctagagtacaggaaaaacaaactccttttactttttttttggagacaagctctcgctatatcacccaggctagagtgcagtggcatgatcatagcttactgcagtcagactcctgggctccagcgatcctcctactgctccctccctagtagctggaaccacaggggtgcgccaccatccccagctaacttctgtatttttggtagagacgagggggttcttgctatgttgcccaagctgatctcgaactcctgacctcaggcaatcttcctgcctcaacctccaaaagtcccgggattacaggcataagccaccacgcctgacccaggaacaaactttcaaaacccctctgttaagttgaaaaatccattctgggaagatgacagtcccagtgctgcttagaaattatattatatgtatcagccaggcgcagtggctcacgcctgtaatcccaacactttgggaggccaagacgggaggatcacctgacgtcaggagttcgagaccagcccctcaacagaggccagaagcctactaaaaatacaaaatttgccaggcgtggtggcacatgcctataatcccagctacttgggaggctgaggcaggagaatcacttgaacctgggaggaggaggttgcgatgagctgagatagcaccattgcactccagcctgggcaataagagcgaaactctatctcaaaaaaaaagaaaaaaaaagaaataatatggacctttcatatgtttttgtttgtttgttttttgagaaagagtctcaccgtgtcacccaggctggagttcagtggtgcaatctcagctcactgcaacttccacctcccatgttcaagcgattctcctgcctcagcctcccgaatagctgggattacaggcgtgcaccaccacgtcaggctaatttttgtatttttaatagagatggggttttcaccatgttggccaggctggtctcgaactcctgacctcaagtgatccacccactttggcctcccaaagtgctgggattgcaggtgtgagccaccacacccggccatatgtttatgtattttaaagcttgcctattaacttattaaaggcgtttgttattaattgtattacacaatttgcaaagtttatgagcaattaaaattcgaggagattgatggattttttttcctgttttggcttttttggttatttatttattatttactgatttctgatcttgggctcctcaaggggccctgttcaagggtgaatgcaactgtaacttcaggcttgacccacaaagcttcctcctctgtaggaggcccaactatcaccagccctgccacctgtatctccatccaggtcctaggagatggagctgagacaatgttccggaccaacccaagagctggatgcaggaactctgtaaccagggggctctgggagcaaaggaccctctccggaaaccccatattgagggaagggacagtcttcctggccaactcctcctactggcgtggtaggccctgccccgatctctggccctcacattctccacttgcagatccagggacggggccccccaaggcttccagccctccaccccttcccacacaagcaccatcttcctccgcttctgcccctcttttccagtctcccctaaagagcctgttcccggagtatgacccccacaagctgcccctttctcaagctcaggtacctgcacgatggtgtccagattttgccgggatgtggaaacagagttgatgaccgaggaggggcccatggtgacgacattgatgtggtgggagggaggaggaggcggtgctggcacgatcaccgtggggtggtgggtgggggccggagggggcagaagctgcaagacagaggccctcagcctttctctcaaggcttctcttggcccatccacctccctttcatgcagagctggccaatgtataactgcctctgcccctttatattaagaagcagagaggacgtggcctagggagaggcttccgccattcaagatcacctgtccccttcccggtccccagagcccactcccgggcgcctcctgctcacctgggtccgcagctgctgctgttcccgctccagcttctcctggtgcagcagcctcacctgttcctgctgctgctgcagctgcacctgctgcgcaatcaccttgagcttttccgggtacatgtgggcctccagcgagcgcacctggaggcaggacaacctgggctcagggccaaggccgggagcacaccctgccctgtcagtctcacagcagctcattcactcctgctgaaaaccctagcacagggcgggcccctctcaacagaggccagaagcctttccagagcccttcagcccccggctcctctcgcctcccacctcggcctccactggaccatgctccctcctgcccgagtctttgcctatgctattccctctgccgggaacacctttctctgtcctttggttaactatgagactcaacttcccacttccatggagatgccgtggggcgtcccttgaaaaacccctcctgatgccacagctccagcctggccttcaatatggttttttgtttttgttttttggtttttttgagccatggtctccttctgtcactcaggctgcagtgtagtggcacaatcatggctcactgcagcctccacctcctgggctcaagcaatcctcccagctcagcctcctgagtaaccgggactacaggcacaccccaccacacctggctaatttttgtatcttttttggtagagacagagtctcactatgcttcccaggctgatctcaaactcctgggctcaagcgatcctcccacctcagccccgcaaagtgctgggattataggtgtgagccaccatacccagcccatcacggttacatttttttttttttgagatggagtctcgctctgtctcccagactggagtgcagtggcacgatctcggctcactgcaagctctgcctcccaggttcacgccattctcctgcctcagcctcccaaacagcggggactacaggcacccaccaccacgcccggctaattttttttttttttgtatttttagtagagacggggtttcaccgtgttagccaggatggtatcgatctgctgacctcaggtgatccacccgcctcggcctcccacagcatggttacatttttgagatcctttggctaatctcccccaccccaacgcagacggtggcccccaagggcagagacgtgtctggcttgctccccactcctaggcctggcaccgcagtaggtgctcctgtaaatagggctccaccgagggccgcagagcaagaggcgcgaccccaggctccacgccctctgcaccgcgcgccgtgcccagcagagggcgctgcctcacctgctcctccagcatcatgcgcaccgagcgctccttgtccagctgctgccgcagctcaatcatctcccgccgcaggtcctccgccttctcgtcctcccagatgtccggggagcctatgccttcgtccttgtcctctgcccgccgtcgcttgggggacgagccgctcagctcctggggaccccaaggagtcggtcagtgtgcctgacacctcggtaccaccacggagattggggttccatcgcagccccccaaagctgcccaacacaggtgaatcttcattagggagccccttctgcaagtccaacaaaccagccaaatgccaggagaatgggctgctttacataacagtcacctggctccttccagagcccactccaccgcacttgaccgatggggaaactgaggccggggcaggaaaaaaagtgcctggaagtacttgtcagtgggcaagaaggggcctgcagccacacctgagtcccaggcccatggctgggtccaaggcatgcccatgccagggagagggagccatgaaggacagggcgcacctggatgaagcgcttgagctgtgtgttctgctgcaagagcctggtcttctcctgctccagggagaagatgtactcggctgtctgctggagaatggctgcctgagggcgtggaaaagccgagagtcaggctggcagtgtttaccagagctcactttcctctcccagcgggaacctgccggctcctccaggaagccctccctgctctcacccaccttgctgagcttctctccgtctgtgtgggggatgagggtcttgagggactggaatcccgcgttgatgctctgcatgcgtctccgctcgttgctgttggcgatctcccgccgaatccgccgctcctggtcccgctgagtctcgggggttagtggaatgttggcaaggctgccagagaggacagggacaggctcggccaaggcgccctcttcatcattcatctccagagggccccagtggaaactgcatccctcccctgctgcaaaagatgccaggccacccccagagagtgatggaggggtgctctctgggacaccggggcggactgaatcagctggctgcgggtaagatagtccgctcagaacccaccccgggccaggcacagtaatcccagttctttgggaggtcaaggccaaggatcattgagcctaagagtttgagatcagcctaggcaacgtagtgagaccctgtctctacaaaaaaataaaattagccaggtgtggtggtgcatgcctgtagtcccagctactcaggaggctgaagtgggaggatcgcttgagcccaggagttggaggctgcagtgagctatgatcacgccactgcacttcagtctgggcaacagagcaagaccttgtctcaacaacaacaacaaaaacccatcccctccctggctttcctcacagggagcagtctctcctccggaacagaattcccagtgtgtctgagcatcaaaacatccaagagcttagaaactatgcagacgacgggtgctggccccagcgtctgactagcaggcccggtggggcccagaaacgtgcgtggtgtgattctgatgcacgcgggatgcagacgacattcagggacgctgtccccgctcctggaacacttctgagtgatttgctaggcacctggagcgcctcttcagcgtctcaggctttgccaccccaggactgaggaagacgtccccactcccttcctaccctcacggccacgcctcccaccacaagccccagccccgctaggctaagacttcacagaagacaagtaccactcactccccaaaaagacaccaagccaacaacccctggggacacggctccccacagcccacccactccaagagatagacccaccctgcgccggagaagcgaggctcccaccatgctgtggggagcgctgctgacccttgcaggagcagtggccagtgcggtgagaaggcagcctgggggaagagggcgtggctgctggctgggggcgtggcttcggacgagggcggggcgtgtgcgccagggggcggggctgcgggccagggtgcagaggcagcggttgtgggcccaaggccacgctcccgagggttgggcttgtgtgtggcctggaggaggcatgtccccctccctggacctcccctgcaactccccccgcccctggcctgatggcttccagatgctgggctctcagcagaggctgccggccccacccgaagccgcagccccggcctcttcctgaggggccctcccggggtgccctgttccaggactgggccaagggggctcatgcccctgaatgtgggagaacaggaaaagggttctgggcagctcctgctccattgatgaaggcagtctggggtcaaggggctgccaagtctaactcccctgctgtgtgccctggccccttcgccagcctgcaggcggaaaggagtttgcacggaccccggaggcagcacatctgcaacagctggaaacagccgtggccttcctggccccacccagcctgcccatctgtccagccttggctccctgtgggaccctggacgcatcgctgccccttccccggcctcggcttcctctcccaatagagaggtgtccaacgccggaagtctggatgcaaatcagcctccttccgtcctcatcaagccaagccccctcctccatcaggacccaaaggcccagggcctgcacccagggtacaagtctcttacagggtcttgaaatgtccgcactgcaaaaggggcccgggccccccactttccatgagactttagggtgcagggcagagaggggatggttttagggtcggtcagctggatgtcagtgctctcacttctcccggttcccctgccctgaagtggaggtgatagggggactggagcaggcctgctgcacggctgtgtgtggcccagccttagggcggagtccaggctcccaggcctggcacaaactcagaccataccatgtctgagaggccagcaggccaaggggaccaggactgctctgcagtgggtggcttaaagctggggctctttggaggtaagaggtgggaagagatgtccataggaagccacaacacaaggtaagtgcaatcttgaggcatcaccatccccctcaggagagatgtggggagagacccctgcccacccagcccctgggtccctcctggcaatgcccaaaagccagagctgactagggggtgaaaagggagcaccaagtccagccttgggccacctgagagctggccctcctggagggtccacaacagagggatacatttttttttttaagtttttggcgagaattttctcactgaattgtcacaatgttcctgagtcaggtggcctgaagactcccatgtaaagaggggggcacagaggtttgggtagggtccagctgcagcaagcgctgggcgtgaaccctgaccccagagcaggtgtcaggccatagggcagaatgagctctgaccggcccacagagccagatgccccaactggcaggtgacagttatccctgtaaaagagaagactaggccgggcacagtggctcacacctataatcctagcactttgggaggccaaagtaggaggatcgcttgagccccagagttcaagaccagcctgggcaacatagtgagaccccatcactagaaaaaattaatcagccaggcatggtggagtgtccctattgttccagcaactgaggaggctaaggtgggaggatgtaataagcccaggaggttgaggctgcagtgagctgtgatcatgtcactgtactccagcctgggcaacagagtgagaccttgtctcaaaaaaaaaaaaaaaaaaaaaaaaaaaggaccaggcattcggaaatcgctgtaatcgtgtaactctttttattattcacagacctcgttgacatttttccctgcctgattctcacaaaacccagtggggtggccgagattacagtgagcaagcaatgcagggtcgtgggaaggaaggtgatgatcccaaggtcaagtagccagacctggcacaacagcaacctgcagatgccaacccactgaagcgcctctactgactgctagttcacacagcccgccacttatcagaagcgggtgtgtgactgcaagctcagccatcacccctgcccctctgaacacaagcccacaagtgaggtgacttgcccaaggtcacacccagcagctgggcagggcagggtgcagccagatgcacccttctgcacctcccggcccaagtcccaccaactcctctgctcttgggagctgaccctcagcctcttccgtcccttccccgcaaggcagcccactaactgggagaccaaaggagaccaccagaccccagtcccgaaaaccccagccggaagttctcacaaggaagaggagctggggctgggatcaggggcctgtgtcgcctcctcctctgcatcagaatctgccggcccagcttctccaatgctccatcctgcctccttcctctccaaagccatcagcccagtctcctggctcagaaaccagctgctggctaacctagtgcttaacttaggttaagcactttcttaaatccaagaaagcaaatttccccccaaaaggtacagttcctcgtgggacctgaatctgccaccaagaccctcaaatataactcacctaaattgccctggaagtacccgccgacagagtcctttaatagaatgcattctaaccaaggcttctgattggtggaataggagctaaccaggggttgtgattggtggagtgccgctaaccaggaattcttattggtggaatgctgaccaaccagggcttctgatggctgaccaaccaggggttcctgttgatgaaggatggttgattgaaatttccaggtgatactgcactgaataaagtggatttttctgcaaatgcctgaaagtttctgatagctctttctggggttttgcatttacggttaaggtctgtaaacgtcctacacacacagtaaaggtccactatcctctctctggccacttcagactcctccaggtgaaaatcaaaggtgacccaagtccaccaacaccgaggttctcttttttcttttgactgagtctcgctctattgcccaggctggagtgcagtggcacaatcttggctcactgcaatctctacctcccgggttcaagcgattttcatgcctcagcctcccaaataactgggattacaggcgtgatccaccaagcctggctaattatggggggcggagggggggttgagatggagtctcgctctgttgcccaggctagagtgcagtagcacaatctcagctcactgcaatttctacctcccgagttcaagcaattctcatgcctcagcctcccgagtagctgggattacagggacccaccaccacgcccggctaatttttgtatttttagtagagatggggtttcaccatgttggtcaggctggtctcgaactgttgacctcaaatgatccatccgcctcggcctcccaaagtgctgggattataggcatgagccaccatgcccagccacaccaaggctctcttgcttcttgcaagccagcctcctgggtccaaacaggggctgccctagatttaggaataaggtcactgagcagccaatggccaaggaacaaaatttgggcaccagccttggatgctaaggcaagagccgccacacctaccaccacagcacccacagaatctgctgagactgacgctggcgtcccaaccagacacttggaggcatggggcatgcccttcaagtctagaaccctgccaggtacctatccctcctgcccaggccaaagtcaagtacccccaatccctctacacctgcctgcccagctccagcctcaaaccggccactgagaactttcatttcacactgccctgaagtcactcacatacctcagggtcacttaacatctacacagtcaacgtgggaaagtccacacgggattctcccaaacccaaaaaagcactaaggcactcatccttctctaacctaatcagcccgaggttctcatccatgctccatccccgctgcttctacactactcacccatactctgtactctgacctggccagtctgctgcccttcccctcggtcccagaacacaccatgcccaggctgttgccatcagaaacatccctgcctccctcccttccccaaagctcctccagcccatcagtgggaaccctgcactgggctcaagtgaaaaagtccagccttgccacttactagctgtgcaacaccaagcctcggtttcctccgtctgtaaaatatggaaacactgcttcacttcacagggtcatggtgaagtttaaaagagatcaagaaaggccaggcacggtggctcatgcctgtaatcccagcactttgggaggctaaggtgggcagatcacctgaggtcagaagtttcagaccagccaggccaagatggtgaaaccccctctctactaaaaatacaaaaattagccgggtgtcgtgggacgtgcctgtaatcccagctactcgggaggtcgaggcccaagagttagtttgcacccaggtgtccaggacaacccatgaaactcttagggggtctacaagaccttttaagaccacaaggctgtgagctgctgaggacaggagtcacatcctgttcatggctgtatcctcagtcccggcagaatgttgttgcttcataaataaatcagggacccaataaacactccaaagccttcaattttcttgaactccttcttatgggagctttttaagttttattatttttttaatttatttttatttatttatttagaggcagggtctcactcccgtcacccaagctggagtgcaatggcatgatctcggcttactgtagcctcaacttcttgggcccaggtcgtcctccttcctcagcctcccaagcaactgggagtataagtgcacaccattcacacccggctagttttttgtatttttagtagaaacagggtttcgtcatgttgctgaggctggtctcgaactcctgggctcaagtgatcctcccgccttggtctcccaaagtgctagggttacaagagtgagccactgcacccagtcttactgttttttttaagagacagggtctctgttacccaggctagagtgcagtgctatgatcatagctcactgcaatctccaattcccaggctcaagccatcctcctgcctcagcctcccaaggagctgagactacaggcacatgccaccatgccgggctaatttttttattttttgtagaggtggggtcttgctatgttgcccaggctggtctcgaactcctgggctcaaatgattttttccccttggccttccaaagcactgggattacaggcttgagccaccgagccaggcctaggagctttatgatacagacagaggccaggcgcggtggctcacgcctgtaatcccaacactttgggaggccgaggtgggcagatcacgaggtcaggagatcgagaccatcctggctaacacagtgaaagcctgtctctaattaaaatacaaaaaattagccgggcgtggtggtgggcgcctgtagtcccagctactcgggaggctgaggcaggagaatggcgtgaacccgggaggccgagcttgcagtgagccgagattgcaccactgcactccagcctgggcgacagagcgagactctgcctcaaaaaaaaaaaaaaaaaaaaaaagatacagatggagagtccgggcacggtggctcacgtctgaaatcacagcactttgggaggacgaggcgggcagatcataagatcaggagatcgagaccatcctggccaaaatggtgaaaccccgtctgtactaaaaatacaaaaattagccggccatggtggagcgggcctgtagtcccagttacttaggaggctgaggcaggaaaattgcttgaaccccggaggcagaagttgcagtgagccgagattgcgccactgcactccagcctgtgcgacagagtgagagtccatctcaaaacaaacaaacaaacaaacaaacaaaacacaagatatggatggagactaccatatacctgcccatatacctgcttttaagactcagtggctgggcgcagttgctcatgcctgtaatcctagtactttgggaggccaaggtgggcagatcacctgaggtcaggggttcgagaccagcctggccaaccactatggtgaaaccccatctctactaaaaataaaaaaattagccaggcatgctgacacatgcctgtaatcccagctacttgggaggctgaggcaggaaagtcggttgaatctaggaggcggaggttgcagtgagccaagattgcactccattctgggtgacagagtgagactccgtctcaaaaaaaaaaagactgagtgtcatttttacagctaccaggcacttgccatacccatagctaattttctcacaggtgctctgtttcccagagactgagaaccattaggcgacaggtccaaaacctgcagcttgtgtgtgcagcaccgtgccctacaatcccctctggcaggcctgggagacagaaagacagggagatccctgctggtcactgagggatggagcaaagcccaccagcctgagatgaccctgagaagcaaatgcatctggccagaaggtcctgcctaatgaacacatttgatcccagactggcttcccacctcaccctgcaacccctactgaaggtaaacaaatccagggacccccaactccatgcctaatgcacagctgacaactgtcttgcaatggacgttgccatgtccaaccctggacgaaggccctacaccttcaagtccttggcctaccaagatccagctaccctgggggactgctggtatgctccaaaggaacgcttggggcagggataaattgaagccagaatctcagggggccctgagaggactcacccaaggcccaggcatggcagccagagggccccccaaccctgcccaggatcaggcccagaatgtcttctccagtaggcacagcggctcaactgcacctccgcgctgcccagcccagccctgcagcagcagcaaccccaggacaagggttcaagttccagttccaccacctgctgtagtggtcccttctccagtctctgtgtccgcctctttaagcggaatcaaaagacacttttgactcatagaaagattatgacaactcagtgagaaaattctagcaaagtgagtccccagaacataaaaagagctcaagaattttttttacttattattactgggccctccaggtgggcctcgtgcaagggccagccctcggggcatccctgccagctgccaaacccatcaactggcccaagtctaggtattgactgggaacttcagagtagccttaaggtggggacccccggggcagagggttgggcaggagtgtctacacgtgtgcagcaaccttccctccaggccggattctgcaggcgctagcgtccaccagcctgtgccacaccggcgggctcctcctccctcaatccccgcccagactgcctcgggcggcagagcacgtggctccagccctggggagccatttcgctcctggagcagcgcggcaggaaaggggccacaggtcccaaacttgcgcacgccgtagaacgcccacctcccccacaccacgcccagggggtcgttcaaaatgcagatgtccgggccccagcgatcagagttccaggcatgtgcattttaagaagtgtgcggggtggtttggctgtgtgtggtccttgagtccatcaccctttgggtttagagcaacctaggaccaaagcttgcaaagtggcttctggggaggcctgcggacctcgggccacccacccggctgggggacccgacgctttcggtttacggcaggggggaggggcgttggatgggaaagtttgcagaggaaacccacgtgcggcgggaagctgccctgcgaggctaggggcggcctcaggtgtcccttccccaaatggcctgcccacctggcctgccttgcccatcgtgcccgcgggggccgagctttgtgcagggaaagcgtggcccaggagcgcctacaaatcccacaatgctgcaccagcaggacacggagaactacagctcccgcgaggccgcgcgcagaggtccgcctactccaagagggctgcagagtcacgtccaggcctcgctagtaaacagcgcccgggcgcgggcgggcgagcgagcggcagccaacgtgccccgggccgcggcgcccctaccggccgcgcgggcccctcggggtccgcccacccccaacacccacacgcgagcacgcccccgaccccgctgcagccccgctctgcaaacacgcacagtgcccggctccccgcccccaccccgcgccgggagccgcggcatggctgcattgtagccgccctagctacacccccacgcgcgccccgggcccccagacccccttggatggggacgacctcagatcccgaggaaggaaggagaggaaggaagccgccgcaggagggggaaagaggaagcgcgggggggaaggccaccagcaccaagcatggccgggactgctgcagaaccacgtgggtctgtttgcaatttacaaacgtcgcgactcgcccgcctgcagcggacaaaagtggccggggccgcttggggcccccatgctccaaggaaggagggtcccggggcggcgcggacccggcgtgtggggctgcagccgtcccggcagctaagaaaggctagcggggtcggcggcgcgggccatgcgtgcgcacacgcgcgcccgcccgggcgggctggccgggggctgcagtggtaggaagggggtggggggaggaggagtacacacctacagagccctcctatcacttctttctctgttttcctgaaatgttgcaaagagggcaccttctgagtgggcaccatgaaatactccatagcgatcggcccccctcctctgcacgagccaggtcccgcgatcagccggagaatgcaagatggaaatccgaatcaaagggcagcgccggacggaggtgcagaatcggccggtcccagatgctggcggcggcggcggcggcgaggggagggaggcgggcgggaggggcgggagggaggtctctccggcctgcctccccgggcgtgtgtatgtgtgtgtgtgtgtgtgtgtgtgtgtgtgtgtgtgtgtgtgtgtgtgtttgcagctgatcagatgtctgtttcaaggcgggaaacagctggtgaaaactcagcactcccccggcctccttccgcggagtaaggaattgcatgtaaacaaaggactatttgcagcgccccccgggcggcgcgaggccggggcgagaggggcgcgggcccccggggaccggctgcaaccggggtctgcaggcctctcgcggggcgcagggggccgggggccgcgggcgggcttgcggggcgcggcgtgaatggagcgagctgcggccgagctacatgcgccactatgggtgatgaggtccatcagctgacaggttggcaagcgttgcaaaaaaaaaaaaaaaaaggccagccaccgcgcagggagcccagcccgtgcagcccggagtccagcagcgactggcccagagcagggtccgcgcgctcggccggcccgcagggaggagggggcgcggctgggtcgggcgtgcagcggcagcaaggaaggcggcctggggttcgcgcttggggcttctgctttttcaccattgcagctgcacggagcggagcctctccggtgtgctcccttcgagccgagcccagggccccctggaaacttgcgtcacagccaccgcttcccacatgtaactcggggctgacttcggaggccggccagcttcctccctcccgccttgcttagctggccgcacggccgggactccggatcctgggaatcttggacccggcgacgggacggcaaagggcgcctcggatgctggggccgccctaggaagccgggggccccggcagggaggggagggtggaggcgggcctgaacggcagcggcccccgggcgcaggctgccagcgctgcggggaggtctgctggttgctgccgggtcccctgctattcccccagacccgcactgttccctccgcgggctgaaggctgcagcttcccattcataacaaagcccgtgtgggacttgcccctccgccaggatgcgctccccaagagggggtgacgacttggggcagggacggggaccctggcggcgagcttccgtcctccgctcgcacgccgcaccttccggccccaggccctcccctggctcctggagggttggctcctggctcaggaagcccacgcctgccttggaatgtcctggatcctgcccaccgccttccaggttccgcctaaatcgcgcctcctaatttgacttattcctactagtaacaatagttactgttattattgggaaatattgttattagatgttgccagcacccggtggatgccgagcagttttgcttacacgctctccaatccttgaagcaacctgttaggcagtttctctaaggagagatcccagaccacttgaccaaaaaaaagtctctggaaggcttactatgtttctacttaaaaaaaaaaaaaaaaaaaaaaaactttcggctgggcgcgttggctcacgcctgtaatctcagcactttgggaggctgaggcgggtggatcacctgaggtcgggagttcgagaccagcctgaccaacatggagaaaccccgtctctactaaaaatgcaaaattagccgggggcctggtggcacatgcctgtaatctcagctactcgggaggctgaagcaggagaatcgcttgaacccgggaggtggaggttgcagtgagccaagatcatgtcattgcactccagcctgggcaacaagagtgaaactccgtctcaaaaaaaaaaaaaaaaaaaaacctttttactgtttttcaacaaatagagataggagtctcactgtgttgcccagcctggtcttgaactcctgggactcaaggaatcctacctctacctcccaaattgctgggattacaagcatgagccatggatggccctggtgggaagcctatttttaactgcccttagtgagcaagctattcttttttttgttttgttttgttttgttttttaagacggagtcttgctttgtcacccaggctagagtgcagtggcacgatctcggctcactgcaacctccgcctcctgggttcaagtgattcttctgcctcagcctcccaagtagctgtggttacaggcacacaccaccaagcccggctaatttttgtatttttagtacagatgggattttgccctgttggccaggctggtctcaaactcctgacctcaggcgatctgcccaccccggtcccccaaagtgccaggattacaggcatcagccacctcacccagcagtgagcaagctattctggtgcattactgtctccttatcctctcattttgcacatgggaagacagaagctcacagctgcagacaagaatgcactcaggagtgctggctgcaaaaagccctggttctttatatcacactcatcctcccacctgccacacctcacctctgatcagggccttattttgtacttgcttttgttattttccagagcaaagcattctgtcatacttagttatatgtggccttcagagtgttctctggctgtctccctggttcaatttttttttttttttttgagacggagtctcacactgtcgcccaggctggagtgcagtggcgcgatctcggctcactggaacctctacctcccaggtttaagcgattctcctgttctcctgcctcagcctcccaagtagctgagattacaggcgcctgccaccaggcctggctaatttttgtgtatttttagtagagacgaggtttcactatgttggccaggctggtctcgaactcctgacctcgtaatccacctgcctccgcctcccaaagtgctgggattacaggcatgagctactgcacctggcctccttggtccaattttgtctcccagagacgagggactgtgcttttactcttttctctcttcacgggggatggtacagggctgggcacatgtgtgaactgcagagagtgatctgcaaagctgatatccctggagacagccttggcagaaaggatgagagggagaccctaggcacaagtgggtggcccaggcagacccgggagctggctgcccacactgaactgggtagtaggcactcatcccctctcctaataaatcaaggaagcccccgcaaagcagcggcatttggagtccggccaggggatggcagagacctgctttttcatttgtcttggaagtcatttctaggcccacacagaatctggttcctggggcaagagttgacatcgcaaaatgtaagagagtgacaaaaatttcaacacccaagataaattatgttgggttttctttgttgttattgttgtttttttttgagacagagtctcgctctgtcacccacgctggagtccaatggcgcaatctcggctcacggcaacctccgcctcccgggttcaagtgattctcgtccctcagcctcctgagttgctgggactacaggagtgcgccaccatgcccaggtattttttgcaatttttgtagagataggatctcaccatgttgcccaggctggtcttgaactcctgacctcaagtgatccaccagccttggtctcccaaagtgctgggattacaggcatgagccaccgcgcccagcctcaaattacgtcttaatttaacattttaaaacatcaaaattggctgggcacagtggctcatgcctgtaatcccagcacttcgggaggcccaagtgagtggattgctttagctcaggagttcaagaccagcctgggcaacgtggtgagacaccatctctataaaaaatataaaagaattaacttgtcgtggtgatgtagtcccagctgttcgggagggtgaggtgggaggattgcttgagcccagggaggttgaggctgcagtgagctgtgatcgtgccgctgcactccagcctgggtgacacagcaagaccctgtctcaataaaataatacataaataaaataataaaataaaataaaataaattactgccaaaaatccatactaaacacactctccacattttaatgactatctcagtattactgatttttccctttccctcaggcttcagtatagctctccaagacactgttgctgatccttagctttaaattcaaataatggccaggcacagtgtctcacacttgtaatctcagcactttggaagaccgaggcaggaggatcccttgaggccaggagttggagaccagcctggacaacataaccagatgctgtctttacaaaaaaataaaaaaaaattagactggcacggtggtgcatgcctaaagtcccagctacttgggaggctgaggcaggagggttgattgagcccaggagttcaagactacagtgagctatgatcacgccatggcccttcagactgggcaacagtgtaagaccctgtcttaataatacattttaactgggagtccaaagtaggtagatcacaaggtcaggagattgagaccaccctggctaacatgatgaaaccccatctctactaaaaatacaaaaaaaattagccaggcatggtggtgggcacctgtagtcacagctacttgggaggctaaggcaggggaatcgcttgaacccgggaggtggaggttgcagtgagccgagatcgcaccactgcactccagccttggtgacagagcgagactccatccataaaataataataataataataataataataaaattttaaaaattcaaagactgggccaggcgtggtggttcatgcctgtaatcccagcactttgggaggcagaggcagacagatcacttgagatcagaagttcgagaccagcctggccaacatggtgaaactgtctctactgaaaacacaaaaattagccgggcatggtggcaagtgcctgtagtcccagctactcaggaggctgaggcaggagactcacttgaacccgggaggcagaggttgcagtagtggagatcgcaccactgtgctccagcctgggcgacaaattgagactgtctcaaaaattaaaaaaataaacattcaaaagctggttcaacattgatttctaatactgatttattataaatcaataaatgtgtttttaatttgtaattcagatattttggtcattgtaaatttttggcattaatttcaattttttcttgagacagggtctcactctgttgcccaggcaggaggagtacagtggtgatacaatagctctttgcaggccttgaactcctaggcccatgtgatcctcccaactcagcctctcaagtacctgggactacaggcatgccaccaccatgcctggcaatttttaaaattttttgtagagacagggtctcactatgttgtccaggctggtcttaaactcttggactcaagccatcctcctgcttcggcctcccaaagtgccgggattataggtgtgagccactgttcctggccagttttgatttctctaaagtattgcattaaagttttgtgaaacttgattactgaggggtttggtgctcccattaacttttgttccccaagcaagggcctcccttgtattaccctagccccaccctgctgcttgtgattcccgcagctactgaggtctcactctagcccaggcagaaggcagcagaatcagggctgcccgtcagccttccgggacccactctgtgtccccaaggaacatgggcatcatttgcacagccctggagagggactgtccaatcagtcctggctacttctttctgtgttcacatatcctacttggccacacggaaatcaaaccagaaatgctgccctcgagaagctgccgaccacactgcagtgacaggagctgtgctcaggaaatgatgacatttggagacaatcaatatatgccatagggccacaaaaccaaatgcactgaatgacctctccggtgcctgaaaaaatgagtgaatgaatgaatggcaactggagcaagcgtgtctacctcctgctcctcccttacagaattgccttgactaggccgggcgtggtggctcacgcctgtgatcccagcactttggaaggctgaggtgagtggatcacctgaggtcaggagttcaagaccaccatggccaacatgacgaaaccctatctctactaaaataaaaaaatagccgggcgtggtggcgggtgcctataatcccagctacgcaggaggctgaggcaggagaatctcttgaacccaggaggcggaggttgcagtaagccaagatcgcgccactgccctccagcctgggcgacagagtaagactctgtctcaaaaaataaataaatacaataaaaaataaaaataatcaatcaggccaggtgccgtggctcatgcctgtaatcccagcactttggaaggccgaggtgggcggatcatttgaggtcagcagttcaagaccagcctgaccaacatagtgaaacccaatctctactaaaaggacaaaaaaaaaaaaatctaggcatggtggcacatgcctgtagtcccagctacttaggaggctgaggcaggagaatcgcttgaacccgggaggtggagattgtagtgagccgagattgtgccactgcactccagcctgggagagccagactccgcctcaaaaaaaaaaaaaaaaaaatcaggccggtagcagtggcgcatgcctgtaatctcagcactttgggaggccaaggcagatggatcacttgaagtcaggagtttgagaccagcctggccaacatggggaaaccctacctctactagaaatacaaaaattagccaggcatgatggcaggcacctgtaatcccagctactcgggagagtgaggtatgagaatcccttgaacctgggaggcagaggctgctgtgagccgagattgcgccactgcactccagcctgggtgacgaagcatctcaaaaacaaacaaacaggccgggtgccgtggctcatgcctgtaatcccagcactttgggaggctgaggcaggtggatcatgagttcaggagattgaaaccatcctggccaacatggtgaaaccccatctctactaaaatacaaaaaattagctgggcatggtgctgtgtgcctgtagtcccagctacccaggaagccgaggcaggagaatcgcttgaacctgggaagcagaggttgcagtgagccgagatcatgccactgcactccagcctagcgacagagcaagactccgtctcaaaaaacaaacaacaacaacaaaatgaataaatatattaggagtcagcaaggttttttccctaaagtaccagatagtaaatattttaggctttgcagaccacacggcctcctgcaagcactctattgtccctccggctggaaagcagtcctagatggtatatgaatgaatgggcatctctgggtgccaataacactttgcttatggacacaaatggaatgtcgtataatttcatgtgccacaaaatatcatttgatcgctttccaaccatttgaaaatgtaaaagttctatggcctccgtaacaagttactacaagcttagtggcataaaacaacataaatttgaccaggaatcatggctcatgcctgtaatctcagcactttgggaggctgatgcaggaggatcacttgaggccagcagttggagaccagcctgggcaacaacatagggaaattccatctccacaaatatatgtctgtgtgtgtgtgtgtgtgtgtgtgtgtgtgtgtgtgtgtgtgtgtataattttaaaaaacaacacaaatttattctctgaaggtcagaagtccagatgggttatgtttggctaaattcagggtgtaagcagggttgtatttctcctaaagttctagggaagaatccgtttccttcccttttccaacttgtagatgccactcacattccttggcttgtggccccttcctccatcttcaaagtgcacttctcagtctctgcttctgccatcccatctctctcaccctttcatctccctctcttgatgaccttgggcccacccagataatgcagaataatctccccatctcaaaatccttaacgtaatcacaactgcagagtcccttttgccacataaggtaactattgataggttctggggatggggcatgatcttcattgggggggccattattctgtctaccacaccattcttggtttgtgagccatgcaacaggcagtagttatcataggccccagcaattccactcctaggtaaacatccaagagaatgaaaacagggactcaaacagatcatggtacacccatgtccacagcagcattattcatacgagccaaaacatggaagcaacctagtatctatcaactgatgaatggataaactaaatgtggtctgtccatacagtggaatattattcagccataagacagaatgaagcactgacacctactacagcattacatttattgcataccttatttctattattacactataatatataataaaataactatgcaactcaccataatgtagactcaatgggagccctgagtttgttttcctgcaactagacagtcccatctgggggtgatgggagatagtgacagatcatcaggcattagattctcataagaagcactcaatctagatcccgcacacccacagttcattcacaataaggttgcactcctatgagaatctaatgccaccgctgatctggcaggaggcggaactcaggcagtaccgctagccatgtggagtggctgtagatacagatgaagcttggctggctggctcacttgttcacccaccaagagttcaacaccagctgggagaggtggctcatgcctgtaatcccagcactttgggaggccaaggcaggcagatcacctgaggttaggagttcaagatcagcctggccaatatggtgaaaccctatctctacaaaactacaaaaattagccaggtgtggtggcctgtgcctgtaatcccagctattcaggaggctgaggagggagaatcatttgaacctgggaggcagaggttgcagtgagcagagatcacaccattgcactccagcctgggcaagagagcgagactacttaaaaaaaaaaaaaaaaagagttcaagactgtcccgggcaacatggtgagaccccgtctctacaaaaacaaataaacaaacaaataaataactggttaaacagtaagtctttgttatgtatattttaccacaatagaaaaaggtttgttataaaagcagtgggctgggccaggctcagtggctcatgcctgtaatcccagcactttgggaggcttgaggaggtcagatcacctgaggtcagaagttcgagaccagcctggccaaatggtgaaaccctgtctgtattcaaaatacaaaaactagctggttgtggtggtgggcgcctgtaatcccaactactgagggggctgaggcaggagaatggcttcaacctgggaggcagaagttgtggtgagctgagatcacaccattgcactccagcctgggtgacaagagcaaaactccctctcaaaacaaacaaacaaaaaatgcagtgggccatagtcggctgaccccattgatcctgctaactcctgcagctgtgacccagttcatctcacactgcctgctcttcccctctccctacctgaaagaaacagccaaatatggctagaaagaggaaatcccacaaccttgctgattggtttgtttttattttttccctccagtcagcaacagttgtattagggatgttgtcaaagtcaaagtcacccgctaggtgacgggtttttggatttttgttttttttttttttgagacagggtctcactctcactcaggctggaatgcagtggtgcacggcttattgtagcctcctgggctcaagcaatcctcacgcctcagcctcccaaagcactgggattacaggcgtgagccactgcaccagaccctcttttttttttttttttttttttttgagacggagtctctctctttcgcccaggccagacggcagtggcgctctctctgctcactgcaagctccgcctcccgggttcacgccattctcctgcctcagcctccagagtagctggggactacaggtgccagccaccgtgcccggctaattttttgtatttttagtatagacagggtttcaccatgttagccaggatggtctcaatctcctgaccttgtgatccacccatctcagcctcccaaagtgctgggattacaggcatgagccaccgtgcccggcctccaccaggtcctttttttgagacagagctctgctcttattgcccaggctggagtgcaacggcacaatctcagctcaccgcaacctctgcctcctgggttcaagtgattctcctacctcagcctcccaagtagctgggattacaggtgcccaccaccatgcccagctaattttgtatttttagtagagatggggtatcttcatgttggtcagcctggcctcgaactccagacctcaggtgatccgcccgccttggcctcccaaagtgctgggattacacgcatgagccatcgcgcccagcctgccactgctcttatttttaagtgcctgatccataccctcaagtgggtctgggggttgctgtgactgcatcctgttgccctggccccttcttcctacccttccttctcctctcccctcaagccctctagcacctcctccttgcttgtagctcacttcccgttcctctgagggaaatggaagcaattagaagagaccttccacaggctgccatgcccgccactgcctccctctctgtgcctgggaactgccatcggccagtgtctctggatgagcatccatgctgttcatgcacagaagacccttctacttgcacaactcagagccgtcactccagaaactgtcctctctcctttgtcttcagtgcacaccgtcttttggatcatacccattactaacaagctgttactattctcctttcaaaccaacggactgaccctagatccccttagctctgctctcttttcttggttttgagacagtctcactctgtcacccaagctggagtgcagtggcatgatctccactcacttcaacctccacctcccaggttcaagccattctcttgcctcagcctcctttgtagctgggactacaggtatgtgccaccacgcccagcccagctctggaatctaacagcaaaactccttgaaatggatgttcacactcactctctccccttccctcctgctcactccatcacacccccatgactgcatgggggcagtgactcacttctgtaatcctagcactttgggaggtcaaagcaggaggcaggaggatggcttgagcccaggagttccagaccagccgggcaacatagcaagacttcatctttataaataattaaaatattagccaggtgtggtgatgcacatctttggtcccagctactactctggaggctgaggagggaggatcacttgattctaagaggttgaggctgctttgagccaagagtgcaccactgcactccagcctagaccgcagagtgagaccctgtctccaaaataaaacacatatggctgggcgcggtggctcatgcctgtagtcccagcactttgggaggccaaggcaggtggatcacgaggtcaggagttcaaaaccagcctggccaagatggtgaaacccccatctctgctaaaactacaaaaattagccaggcgcaagggcaggcacctgtaatcccagctactcaggaggctgaggcaggagaatcgcttgaacctgggcaacagatcgcacctgagccgagatcgcaccactgcactccagcctgggcaactgtgagactgtctcaaaaataaataaataaataataaaacacacacacacacacacacacacacacacacacacacacacacaaacccttctcttttcaaagtcacgaggacctccaggatgctacatctgggtctctgttttctgccttcactgcatctgaccttcttgaaattctttttttgctttgcgtctaggacatgcccacggcacagccctcagacctgtctctgtctacacacactccctgctcttcagacaacagacttccagaaaccactagcagccacgaagtgtggtacagaatccaggtcctgcctgaaccccaaccctactaacctgactctgctctctcatctgcaaaatgaaagccacacagcatctccctggcagggctgttgtgaaaagctggtgacagcctggcatgtcacggcatcaatgagtgttggttgctgtcatccctggcaccaagttgccatgggcggcagtggccagaggcgtctgagctgaccttggagaacgacaagatttcctgatatgtagggaaggtcggaggtggggctcagcctttccccttcccagctctacgtggcagcaggtgggaggcagcaggcatgcgctgggctttgctgttcacacagggtgcacctgcttcccactcgaaacaccctcatgtggtggggcagtgaaaattggcaaacaaaccacttgccctgtaaaaggtgggtctcttggccggtcacagtggcttatgtctgaagtcctggctactcaggaggctgaggcgggaggattgcttgagcctaggagttaaggctgcagtgagtcgtgatcatgccactgcacttcaacctgagcaacagagcaagaccatgtctcaaataaataaataaataaataaatacaaataaaaggtgggtctctgtaaaaaaagaaagtaatcagcagagtgtggtggcacacatctgtaatttcagctactccagaggctgagacagaaaaatcccccaagtccaggattgcaaaggcagcctgggcaacagagtgaaatacttcaaaacaaaataaaataaaataattaaaaaaaaaaaaagggaaggccaggggcagtggctcacgcttgtaatcccagcactgtgggaggctgaggcaggtggatcacctgaggtcaggagttcgagaccggcctggccaactggtgaaacttcatctttactaaaaatacaaaaattagtcgggcatggtggcgcacgcctgtagtcccagctacttgggaggctgaggcaggagaatcgtttgaacccgggaggtggaggttgcagtgagccgagattgtgccactgcattccagcctgagtgacaaagcgagactccatctcaaaaaaaaaaaaaagcaactttattgactgaccctaaagatggccacaagtccaggaagccccagaaagcaagcatgggggattccttagagcagaggattcaggactccttcccttggctctttcctcactggctcggaggtgtcagctgctctgaccatgccatcagcacagcagttttcaggacaaaggctacccccaaccccttcccaggctggttgggagctgctggttggagatgggaaatcataagaactgcagccaggaggaagagctgtcggcaaaggtggctgctgcagaggtgaggataggttgttctcatttttacacttaggtttttgggtcttttttttcggggggtggggtttgatcgcagtggtgcaatcatggctcactgcagtgtcaacttcctgggctcaggccgggcacagtggttcacacctgtaatctcaacactttggtaggtaggggcgggcggatcacttgaggtcaagagttcgagatcagcctgggcaacatgatgaaaccccatctctactaaaaaattacaaaaattcgccaggggaggtagcacacggctgtagtctcagctactcaggaggctgaggtagaagaatcacttgaatccaggaggcggaggttgcagtgagccgagatcctgccactacattccagaacgagactccttctaaaaacaaaacaaaacaaacaaaacttcctgggctcaagcgatcctcccgcctcagcctctgccaccacacctggcttttttgtatttttagtagacacggtgtttctagaattttcttttcttttttttttttgagacagagtctcgctctgtcgcccaggctggagtgcagtggtgtgatctcagctcactgcaagctctgcctcccgggctcacgccattctcctgcctcagcctcgcgagtatctgggactacaggcgcctgcccccatgcccgactaattttttgtattttttagtagagatggggtttcaccatgttagccagaatggtctcaatctcctgacctcttgatctccccgcctcggcctcccaaagtgctgggattacaggtgtgagccaccgcgcctggctagagacagcgtttcactgtgttagccaggaatggtctcaatctcctgacctcgtgatccacctgcctcagcctcccaaagtgatgggattacagtcgtgagctactgcgcccggcctaatattattcagcatttttttttttttttgagacagaactttgctcttgtcgcccagtctggaatgcaatggtgcaatctcggctcactgcaatctccacctccctggttcaagtgattctcctgcctcagcctcctgaaaagctgggattacacgcatgcaccaccacggccggctagttttttgtacattttagtagacacgggtttcaccatgttggccaggctggtcttgaactcctgacctcaggtgatccgcgcacctcagcctcccaaagtgctgagatgacaggcatgagccacagagcccagcctacacccggctaattttgtatttttagtagagacagggtttctccatattagtcaggctggtcttgaactcccaacctcaggtgatccacctgcctcggcctcccaaagtgctaggattacaggcgtgagccaccgcacccggcctatatgtgttaattttcttaatttttttgtagagatagggtcttcctatgttgcccaggcttgtctcaaactcatggactcaagcgatcttccagcctcagcttcccaaggtgctgggattacaggtgtgagccactgcgcctggccaactctgctttttaagagtgcatgtgattaggtcagaatcattgataatctctctgcctcaaggtcaaccatagcatgtcatgcatcctaaccacagaagtgatatatttgtaggttttgcccacactcatcaaaagggggttacaccagggtaaagggcattgggggtcacaggaaaattctcctgccccagatggggggtttgaaggtaggatagagtaagggaggagaatttcctgagaacatacagagaattggagatggaacccaggcaggaatctatgtcctcagtcttaacgaggcttgttccgctatagaaatttgctgggagcagggggatgcagcacctgacctttccggccctgctatactcccgtgcatatggggaaccatagcctctttggggtggtggcgggggcagggacaccagtcgttggagccaggttgagaagcaaaaagtccctgcctgggaaaggatcctggatgctcccaggaaggcggaacgggggtcagatgctcctactggggttcggagcaaagccacttccggtcctctggccctcctctccccaagtcagggggacatctctgggctcacagggctggggctcccccgaccagtagggggcgtccggcacacgcgctgctttgtggatgccgagcaggaacacggtgggggagccccaggcaggtaggtgttggggtgaaggggctgaccgcagccccccacaatcccgaggccctgcagatccctacagtgcctggcttgtctagggagacctgtgatgcgcgcctcctcctcctcagttggatctgattcactttggccatgagtaagcactgaaaatgcagctggttcccgatggctcacacctgggatcccagccctctgggaggccagatgagaggatcatttgagctcaggagttccaaaccagcctgggcaacatagcaagatttcatctttaaaaaaaattagcagtgcgcggtggctcatgcctgtaatcccagcactttgggacgccgaggcagaaggatcatttgaggtcagaaattcgaggccagccgggacaacatggtgaaaccccacttctactaaaaatacaaaaatttgccgggcgtggtggtgggcagctgtaatcccagctactcaggaggctgaggcaggagaatcacttgaacccgggaggtggaggttgcagtgagccgagatcgtgccactgtactccagcctgggcaacagaatgagactcagtctcaaaacaaaaaaaaaaaaaaaaaaaaaaaaaaaaaaaaaaaaattagctaggcgtgatggtgtgcacttgtagtcccagctactcatgaggctgaggcaggaggatcacttgagcctacgagttcaagaccagcctgggcaacatagcaagcccccatctctacaaaaaatgttttaaggccaggtgtggtggctcatgcctgtaatcgcagcactttgggaggccaaggtgggcggatcacctgaggtcgggagtttgacaccagcctgaccaacatggtgaaaccccatctctactaaaaacacaaaattagccaggcatggtggcgcatgcctgtaatcccagctatttgggagactgaggcagaagaatgacttgaacccacgaggcggaggttgcggtgagtccagatcatgccattgcactccagcctgggcaacaagagcgaaatttcgtctcaaaaaaaattttttttttttaattggctgggcacagtggctcactcctgcaatcccagcactttgggaggccgaggtaggcggatcacctgaggtcaggagtttgagaccagcctggccaacatggcgaaaccccatctttactaaaaatacaaaaattagttgggcatggtggtgggcacctgtatttccagctcctcaggaggctgaggcatgagaattgcttgcgcccgggagacagagcctgcagtgagctgagatcatgccactgcactccagcatgggggacagagagaaactccatcttaaaaaaaaaaaaaaaaaaaaaaaaaagggccagcatggtggctcacgcctctaatcctaacattttgggagggcaaggcaggtggatcacctgaggtcaggagttcgagaccagcctggcaaacatggtaaaatcccgtttctactacaaaaaatttaccaggcacggtggcgcgcgcctgtaatctcagctactcgagaggctgaggcaggagaattgcttgaacctaggaggtggaggttgcagtgagctgagatcgcgccattgcactccagcttgggcaacaagagcgaaactccatctcaaaaaaaaaaaaaaaaatcagctgggcctggtggcacatgctgtggtcccagctacttagggagctgaggtgagaggatcacttgatcccaggatgttgaggttggagtgagtcatgattgcaccactgcattccagccttggtgacccagggagaccttgtctcaaaaacaaacaaacagacacacaaacaaacacacaaaaatggggctggctgcaaccctatttgaggtggctggagtcccctgcaccctctctctctggccccagctatgggcgcctgccagccctctccctctccttctccctctgcctctccgtctcccctccatcagctcacccgccctgtccttttcagcactcaatttctcttcctcctcccacactcgaagaggatttcagctccctttagggacttttcccctagggaagtgcctctctgcttctcagtgtccacaaggaggaaccaggtgcccaggccttcaaccgagtgcactccctctagaaacactcaattcacagccatgctggctggactgtttctgctttacacagaaatggccatcaaactgctttatcaattgattatgaggccatggggcagttacaataatttcatcaagcagagcagagcctgttgacatggaggatggacatttctgaagaccctcaaagaattagctgtaaccatgagaccagatctaagacccctgacacccagcctggggccttctcaccaggaggcctctggttaatagaaaatgagagtaaatcaggccaggcgttgtggctgacacctgtaatcccagcatttgggaggccgaggcaggtggatcaactgaggtcaggagttcgagatcagcctggccaacatagtgaaaccctgtctttgctaaaaatacaaacattagctgggcttggtggcgtacccctgtaatcctagctactcagaaggctgaggcaggagagtcgcttgaacccaggaggcagagattgcagtgagtcgagatcgtgccactgcactgcagcctgggcgacagagtgagactacgtcaaaaattaaaaaaaagaaagaaagatgaaagaaagaaagaaagaggccagacacggtggctcacgcctgtaatcccagcactttgggaggctgaggcaggcagatcatgaggtcaggagatcgacaccatcctggctacatggtgaaaccccatctctactaaaaatacaaaaaattagccgggcgtggtggcgggcacctgtagtcccagctactcagaaggttgaggcaggagaatggcgtgaacccaggaggtggagcttgcagtgagccgaaattgcgccactgcactccagcctgggcaacagggcgagactccatctcaaaaaaagaaaaaagaaaggagagagagagagagaaagagaaaagagccagccaaggaaccaaggcagtgtggccagagagagtggagggtcaaaggaggcccacaagaaatcaaggggagctaggggccgtggctcacacttgtaaccccagcacttcgggagactgaggtaggaggatcacttgagcccaggagtttgagaccagcctggacaacatagcaagactccttctctacaaaaatttaaaaattaactgggtgtgttggtggtgcacctggcccagatacttgggaggctgaggaggtaggatcacttgaggccaaaaggttgaggctgcagtgagccatgatcatgtcactgcactccagccagggcaagcaagtgagactcttgaaaaaaacaaagagccgggtatggtggctcacgcctgtaatctcagcactttgggaggctgaggtgggcagatcacttgagtgcaggagtttgagaccagcctgaccaacatggtgaaaccccatctctactaaaaatacaaaaattagccaggcgaggtggcacactcctgtagtcccaattactcaggaggctgaggcaggagtgtcccttgaacccagggggtggaggttgcagtgagccaggactgcgccactgcactccagcctctgacagagcgagactcaatctcaaaaaaaaaaaaaaaagaatgaaagaaaccagaaagttgcatttggggatcagaagaaaggcaggaagcagaggcatgtgggatgaggacacctgggaggtgccatctccagtgtccctctgggtgactggatctcttcacatggagtagacagaggttgggaacggaaggtggaatgtcatgttccacttgagactggaaaagggaaggctggggctgaccaggccagaggagggctggaggcctgcgctcatgaaaaccaaagctgggtgagtttccagctgggagaggcagccaggaaacagggccagctctccctggggaggggcaggctccaagccccagtgtgggtccgggggcgggagccatagatcatcaccagcgcaggccagtgctgctgtgggggctttcttcgcactcctagtttctttttttttttttttttttttttttgagacggagtctcgctctgtcggctcactgcaagctctgcctcctgggttcacgacattctcctgcctcagcctcccgagtagctgggactacaggcacctgccaccacgcccggctaattttttttttgtatttttagtagagacggggcttcaccgtgttggccaggatggtctcgatctcctgacctcgtgatccacctgcctcggcctcccaaagtgctgggattacaggcgtgagccaccgcgcccagcctcctagttattttctttccttccttccttcttttcttttttgagagggagtctcactctgtcacccaggctagagtgtaatggtgcgatcttggctcactgcaaccgcagccttccaggctcaagcaattctcccacctcagcttcccgagtagctgggattataggcaccagccatcatgccctgctaatttttgtatttttgtagagacagagtttaactatgttggccaggctggtcttgaagtcctgacctcaggtgatctgcccgcctcggcctccctaagtgctgggattacaggcgtgagccgccgcgccccacctgcactcctagtttcatcctcaccatggtgccctgagtcctatgatcacgcccaaggggcttggccaagcccatcacagccagccactaccagggcctgcacttctttcaggctcctccagatccccccgtggctgccctggagaatggcttcctgttggcctcaaaactcaagagcttacctggtcctggtggctcaaccgtggccaggtaaatccgggtacaagaggagggtcccgctgggcatgacaaggcatacggagggagaaaacatggccatgcatgaaacgacaaggtcagctaccaggtgaaatgtagccccttcctgtgggctgatggtcagagccagactgtcagaggaaggagcaactcgtaggggtcagaaagggttttggcttcaagtctgtgcagacaaggaagaagcaagcgcagtaagcactgtggagtggggaccgggggcagcaaagggaccggctctgggattgctctctcctccctcaagcccgccagagcttgagcccctggtgcccctttcctgctgtgcagctgcggccgccagcgcatcaggggttaatgtctggctggtgccggcttcagcagcagcagcagcaacagcagcaacagacagtggtgccagtaactcagaggctgaaatgtgagaagcaagacgagaggggcagggctgggaaaggctgagcagcagcgagcagagagggtttccctggcaggagccacaggaggctgcctggtcctcccttccatggccctgccgtacagctggccctccagcctcgggctggggtatggcaccctctcagggtggtgggggtgtccatggtcatggccagcgtccaagcccttaggccaccgggaagcagttccctactgcagatctagggaaggggcacaggcgcccaggcaaccagcagagaaggcacccggctctgcccggctctgcaggaagctctaggtggggagatggggcagtggcagagtggggcctggagaaccgaggaggaggacagggagatccctcggggtgtcccaaccgcagaggcctggcctcgacttcacccttccccaccttgggaaagctgaggcacaggaagcttccctgataaatggataaatgagcctcctgctgcttgggggcagggaatgtcgcagggctgctgccccctccacgggcctgggtgtccgcctgcctttgcacaggcacctcagggatgcataagcaccaaccagagaggtgagaggtaccaggcacagcgcgagtgccttatccatactctttttttttttttaataaaaaaaataggccgggcgcagtggctcacacctgtaatcccagcactttgggaggccaaggcaagcggatcacctgaggtcaggagtcggacaccagcccggccaatacggtgaaaccctgtctctactaaaaatacaaaaattagctgggcgtggtgatgcacgcctgtagtcccagctacgcgggaggctgaggcagaagaatcgtttgaacctgggaggtggaggttgcagtgagctgagatcatgccactgcactccaaaatgggtgacagagcaggactctgtctcaaaaaaaaaaaaaaaaaaaaaagctgggcacggtggctcatgcctgtaatcacagcactttgggaggccaaggcaggcgggttgcttgaggccaggagttggagagcagcctgggcaatatggtgaaaccccatctctactcaaaatacaaaaatcagctgggggtggtggtgggcgcccgtaatcctagctagttgggagactgaggcaggagaatcacttgaacccaggaggcagaggttgcagtgagatgagattgtgccattgcacttcagcctgggggacagagggagactctgtctcaaaaatagatagattagatagatagatagacagacagacagacagacagataaaggccgggtgtggtggctcatgccgccctgtaatcccagcattttgggaggctgaggcgggccgatcacttgaagtcaggagtttaagaccagcctggccaacatgacgaaactccatctctactaaaaacgagcaaaaatagccgggcgtggtggtccacgcctgtaatcccagctactccagaggctgaggcacaagtatcgcttgaacttgggaggcagagcttgcaatgagcagagatttcaccattgcactccagcctgagcgacagagcgagactgtgtctcaaaaataaaaaggaacaaggtgctgatctatgctacaatatagacgaaccttgaaacattaagtgaaaagccaatcacaagagaccaccactttatttgaaatgcccagaatagggaaatccatagaggcagaaaacaggctggtgcgttgccagggcctgggaggaaagaggaatggggagtggctgcttcttgagtatagggtttctttttgggatggtgaaaatgttctgaaattagatgttgatgatggttgcacgactctgaatacactaaaaaccactgattgtacacttcaaagaggtgaattttacggtatgtgaattatatcttatttttattttttaatctttttttgagatggagtctcactctgtcacccaggctggagtacagtggtgcgatctcagctcactgcaacctccacctccctggttcaagcgattctcctggctcagcctcccgagtagctgaaactacaggcacccaccaccacacccggctaatttttttagtagagatggggtctggggtttcaccgtgttagccaggatggtctcgatctcctcaactcatgatccgcccgccttggcctcccaaagtgctaggattacaggcgtgagccactgtgcccggccaaatttttgtatttttagtagagacggggttcaccatgttggccaggttggtctcgaactcctgacctcaggtgatctgccggtctcagcctcccaaagtgccgggattacaagcatgagccactgctcccagcttgattttattttttatttttattattattaactaatttatttattttagacagagtctctctctgtcacccaggctggagtgcagtggcgcgaacttggctcactgcaagctctgcctcctgggttcacgccattctcctgcctcagcctctggagtagctgggactacaggcgcccgccaccacacctggctaattttttgtatttttagtagagatggggtttcactgtgttagccaggatgctctcgatctcctaaccttgtgatttgcctgcctcggcctcccaaagtgctgggattacaggcgtgagcgactgcgcccggcctatttttattttttgagacagagtctcactcttgtcacccaggctggagtgcaatggcgcaatttcggctcactgcaacctctgcctcccaggtttaagcagttctcctgtctcagcctcccgagtggttgggattacaggcacgcaccaccatgccaagctaatttttatatttttagtagagatggggtttcgtcatgttggccaggctggtctcaaactcctgacctcaggtaatccacccaccttggcctcccaaagtgctgggattacaggtgtgagtcacccttctgacccactcccaggttccaggaacaagaatacaggtcctctaatggacaaagctcattcagggaccctccaatgtgaatcgaccagacacagtcctcatgtgtcatgggagggggacaggcagcagctcctggagcggaaggacgcctggcccctcctccggccccagatgcagctgcaggtacagggagggcctcccagggcaggccagagcctgcaggcccccagctgcagccccagctgggaccaggcttctaacctcacccctttcttgctcctcccgcctccaccatctctcctgtggagcccccaagactctggaggagaaatcaaatacaaaactcctaggagaacagaaagggggctgctgctgctgcgtgcagacacactcatgcacacccacgcacacacatgcaaacacacacatgcacaccatccttcgagcccacaggcagatcacagagaacctagatgtcaggatgagaaaggaactagacgtgagctatcatctgcctccttggggcaaggcctgtgccaagggatttgccaggattgtctcatccaatcctgaaaagaagcttggagatttcagagatgaagaaaatgagcatctgagagcttaagggagagactcaaccaaagggacacctggggacgctaaagcccatgaagctgagcacagggcctggcagccagcatggtggaggcagcttagcagagctggggggtcgctcttgtatttatgtttttttgttttgtttttgagatagggccttgctctgttgaccaggctggaatgcagtggtgcgatcaaggctcaccgcagccttaacctcctgggctcaagccatcttcccgtctcagtttcccaagtagctgggaccacaggtacacaccactatgctcatctaatttaaaaaaaaatttttgaaaatacaaaaaaattagccgggcgtgtggcaggcacctgtagtcccagctacttgggaggctgaggcaggagaatggcatgaacctgggaggcagagcttgcagtgagccgagatcacgccactgtgctccagcctgggcgacacagcaagactcccatctcaaaaaaaatttttttttgtagagacagggtcttgctatgttgcccacgctggtctccaactcccaggatcaatcgatccttccacctcagcctcccaaagtgctgggattccaggcgtgagccaccacgcctggccggtgtggttcttttaagggacagcccccctcatttccatttgctccatggggctacaggggtattgccctgtgctgggcaggctcctgacccaggcctgtcccatcaggagtacggtgatcgctacagggctgggttgggacccagctccagccaaagagaggcaaacctaggattctgctggaacccgtggtagacacaagctggaggttcacaggtctgtgacatcagggcctcctctcaggaagcgctggcccaagagcaaagcgaaaacggaggaaacctggctgggagatgcaagccagtgttcctgtgagcactggacccagctagaccctcggcctctgcagttacacgagctgtcaaggaactggtctttatttcatttatttacttatttatttattttttaatttgtttttgagatgggggggtcttgctctgtcacccaggctggagtgcagtggtgcaatcttggctcactatagcctccacctcctgggctcaagcaatcctgcctcaggagtagctgggactacaggcccgcaccaccacacctggctaatttttctatttttttgtagagatggggtctcactatgttgcccaggctggtctcaaacttctaggttcaagtgatcctcccacctcagcttccaaaagtgctgggattacaggcatgagccgttgtgcctggcccagaaactggtctttgaatccaggtctgaacgctgaagctcatgctctcttccttgcgccccagctgtccgcatagaggctctgatagatcaggggctcaggcaagtctggggagggggcctcacctccctcccagcccctggagggagtgttggaccctctcacccccctcaaagcagttccattgctccctttgaccttcaaagttggcatctgcttgcaggaatctgtctctctcctcctggaattcagcctccagatgtcagatccgaggcggtggcggcagcatatggctcccctcagagtgaatcagccacattccaaaggtgcacacacagacgccacaccctcagcagcctggctgcagacttcctcccagccccagcacccggcacccgccccagcccccacctcttcccagccagacccgacttcgggcttcctttccagagactttctcctggaactggaacagagagaaagccactagggctggagacaccctgagcagccctgctctgctcactcgctcccaaccgctcacagctgttatcaatatatctatggtgcatccactcaacaggtgtgcactgagcacctatgatgtggcagacaagatacagacaagccccgaacctcacggaactcagctgggcaagagcccaacaaaatcaggtccagaggcagaaaagaattccaagtgtgggaagagctataaaaggaagaaacaggcctggcgcggtggctcacgcctgtaatcccagcactttgggaggctaaggctggcagatcatgaggtcaggagatggagaccaccctggccaacatggtgaaaccccgtctctattaaaaatacaaaaattagctgggtgtggtggtatgtgcctgtaatcccagcaactcgggaggctgaggcaggagaatcgcttgaacccaagaggcagagattgcagtgagccgagatcacgccattgcactccagcctggcgacagaacaagacttcatttcaaaaaaaaaaaaggaagaaacaagggctcagacacgtgacaaagtgacagagggagggttatggggtgggggaggcttatcttggggtaacttgtaagctgaggtctgaaggatgaatagaaacgtcctctatcggctggtcatgggattgcacacctgtaacccgggagctccgggaggcccaggcaggaggactgcttgagtccaggagttcaagaccagcctgggcaatatagcaagatcccatctctactaaattaaaaaaaaaattttttttaaagaaacctcttctatcccgtcacttctgtaatcacttcacgagaattacagaaatataacccaaaaatattttccccagtcactcaggaagttattgggtcctcttctcctgcccctcttttttttttttttttttatcactgaagcagggaatctggctaatttttttaataagacctttggtgaggccgggtgcagtggctcacacctgtaatcccagcactttgggaggccgaggtgggcgcatcacgaggtcaggagatcgagaccatcctggctaacacggtgaaaccccgtctctactaaaaatacaaaaaattagccagacattgtggcaggcacctgtagtcccagcgactcgggaggctgaggctgaggcaggagaatgtccaccaacctgggaggtggagcttgtagtgagccgagattgtgccactgcactccagcctgggcgacagagcaagataccgtctcaaaaaaaaaaaaaaaaaaagaaaaaaaaagacctttattgagatataatccatataattcaccactttacaattacaccacagtagatgattcagttgtttttaaatatccacagatctgtgcatctataactgcaattttggaatattttctttttctttttttttcaagacggagtctcactctgtcacccaggctggagtgcagtggcatgatctcggctcactgcaacctctgtctcccgggttcaagcgattctcccgcctcagcctcccaagtagctgggactataggtgagcaccaccgggcccagctagatttttttgtatttttagtagagacggagtttcatcacgttggccaggctggtctcgaacccctaacctcaagtgatccacgtgccttggcctcctaaaagtgcttggattacaggcatgagccactgcaactgaccaattttggaatattttcattaacccaaaaagaaactccacttagcagtcactccccgatgctcaccaccaccccaggccccaggcaacccctaagctaccctatctttttatttatttatttttagagacagagtctcactgtgttgcccaggctggagttcagtggtttgatcatagctcactgtagcctctacctctcagggtcaagcagtcctctcctctcagtctcccgtggagctgggactacaggtgggcgccaccacactcagctaactttatttttttttagagataggggtctcactctgttgcccaggctggtcttgaactgctggtcttgaactcctggtctcaagtgatcctcctgccccagctttccaaactgctcatgcctgtagacgtaagccactgcccctggcccttaatctacttccagtctctatggatttgcctattctggaaatttcatatgaacagaaacacacaacatgcgtcctgtgtgtctggcttgtcactgggcataatgctttcaagggtcatccatgttgtagtatgtattggtgcttcgtttttttgttttgttttgttttgttttgagacggagtctcactctatctcccaggctggagtgcagtggaacgatctcggctcattgcaacctccgcatcccaggttcaagcaattctcctgccttagcctcccaagtagctgggtctgcaggcatgtgccaacatgcctggctaatttttttagagacagggtttcaccgtgttagccaggatggtctcgatcttctgacctcgtgatccactggcctcggcctcccaaagtgctgggactacaggcgtgagccactgcgcccagctgcttcgttcctttttatggctgaatcatattccactgtttggagagaccacagttgatttatccattcatcaggtgagggacacatggttgctttcactttttggctcttatgaataacactgctctgaacattcccatgcaaatttttgtgcagatatgttcccattcctcttagatatacacgatatatacctaggaggggcactgctgcgtcatatggtcactccatgtttaacattttttttttttttttgagatggagtctcactctgtcaccctggctggagtgcagtggcctgatttcagctcactgcaacctccacctcccagattcaaaggattctcctgccttagtctcctgagtagctgggactacaggtgcctgctaccacacccagctaattttttttttttttttttttacatcaagacagggtttcgccatgttgtccaggctggtctccaactcctgacctcaagtgatctgcctgcctcagcttcctaaagtgctgggattacaggcctgagccactgtacccggcctccatgtttaacctttcaaggaaccagactgtttgaaaggggctgcagactcccagcagcaccacactctgcccagattcactgagaccccttcgcatgacccccagttcacactactcagagaagcaccttaaaattagctggcctaaaggccaggcgtgatggctcatgcctgtaatcccagcagtttgggaggccgaggcaggtggatcatgaggtcaggagagtgagaccatcctggctaacacggtgaaaccctgtctctactaaaaaaatacaaaaaaattagccgggcgtggtggcaggcacctgtagtccagctactccggaggctgaggcaggagaatcgcttgaacgtgggaggtggaggttgcagtgaaccgagatcacaccattgcactccagcctgggcgacagagtgagactccatctcaaaaaaaaaaaaaaaagaagtatcagaaccaagagaggatggcagcaggggatggcaaggcgctcagtggtgaaagcgtcaggacttgaaccccaccgccactactttgcagctttgcatttttgcatgaaccacgcggcttctccaagcctccctctcttcatccacaaaacaggcctgattgtgacaatctactcaatagggtgattttgaagattaaacatagtaatacaaaacaagttattctgtttgccaaagacattacagatgaggtcatgtagccaataccatgccaggaaaccaaaactcacctcaagaaatctgttgggtgggacgggcatggtggcttattcctgtaatcccatcactttgggaggccgaggcaggtggatcacgaggtcaggagtttgagaccagcctggccaacatggcgaaacccccgtctctactaaaaatacaaaaaaattagccagccgggcgtggtggcatgcgcctgtaatcccacctactcgggaggttgaggcagaagaactgctttaacccaggaggcaggggttgccatgacccaagattgcgctaatgtactccagcctggatgacagagtgagactccgtcttgggggggaaaaaagaaaagaaatctgttgggtagccagggcatggtggctcatgcctgtaatcccagcactttgggaggccaaggcgggaggatcacttggggccaggagtttgagaccagcctgggaaacacagtgagaccctgtctttactaaatataaatgtaaaaaaaaatagctgagcatggtggtgtgcacctataatcctagctacttgggaagctgaggtgggaggcttgctataaccccaaaggctgaggctgcaatgagctgagatcacaccactgcactccagcctgggcgacagagtgagaccctatctcaggagaaacaaagaaaaagaaatctgtcttgtcctaaggctgacaggggcaaaaccaggatctgaatcacgtgattcccgacagggctttggccagcgctgtgtgaatactcacacagatgggggatgctgggcagcttcagctcagaaggaacactgagtgagggacagatggactggtccggcaggggacccgcccattcagcagatgtccctgggcacagctcacatgtcagttctctgcaaagcggacaggcggctgagaagtgtcagagcctgctaatgagggctgggcaagagagaagcagaagcgaacttgcctgggtcgggggaaggggatggtgcaaagcaaccctgaggccgaaagcctgtgtagctagaaccaacgggggtgggggcgggcgctcagggctcagggctcaggaaaatgaggtggctctcctagttttaccagggaaaggaaaacaaggcaggaatttccggcagggaaacctggctactcggtgggactcttaaagatgacactttttcctctatcctcgagtgcagcctcaagacgggccctgctggtccatcctggggcgacaggtgtagccagattcccctccaatcaaggagtccaactggaaagctccagtgggttacccaagggcagataccaagcaagtccctaaaaatggaggccagtgtgccctggagggcaagtataaatatggggaactctgagccgggcgcaggagctcacacctgtaatcccagcactttgggaggcagagggccgatcatctgaggagttcgagaccagcctgggcaacgtggtgaaatcgtctcaactaaaaatacaaaattagtttggtgtggtggtgggcgcttgtgatcccagcttctcgggaggctagggtggaagaatcacttgaacccgggaggcagaggttgcagtgagctgagattgtgccattgcattccagactgggcaaacaaagagtgaaattccgtcacgaaaaaaataataataaaaaatatgtggggaactcttaagtagagatgggggttcccctcacttttgcctcttccacggagttaaagtgtcaaggaaaggggttcccaggataaaactttcaggagtattcggttttaggggctacaggcagaggcgcaggaccctagagggattttttttttagctggagtctcactctgtcgccaaggctggagtgcagtggtgcgatctcagctcactgcaagttctgcctcccgggttcatgccattctcctgcctcagcctcccgagtagctggggctacaggcgcccgccaccacgttcagctaatttttttgtatttttagtagagacagggtttcaccgtggtctcgatctcctgacctcgtgatccacccgcctcggcctcccaaagtgctgggattacaggcgcgagccaccgcacccggctgctaaagggatttaggaggtgggtggaaccacaaaggaaaagctagctgctggtggggtctcagcttggaagacgtcagggtgtgaactgtcacttaaggaacagtttaggatagagcaagggatgaggaagcccacctggagttcggcaggagtgggtgacctcaggtagccccctcttttgagaaacctggccgggaaggttggagacatggctgtggcttgaggctagtgtttttttctttttggggacggagtttcactcttgttgcccaggctggagtgcaatagcacggtctcggctcactgcaacttctacctaccaggttcaagggattctcctgcctcagcctcccaagtagctggaattacaggcgcctgccatcatgcccagcaaatttttgtatttttagtagagaaggggtttcaccatgttggccaggctggtcattacaggcctgagccacctcgccgggcaagactagtgtttgattgttcgttttgagatggaatcttgctctgtcagctcactgcaacatctgccttccaagttcaagcgattctcttgcttcagcctccagagtagctgggactacagccatgtgccatcacgccccgctaatagagatagggtcttaccatgttgcccatgctggtcttgaactcctgggcttaggagatcctcccacctcggcctcccaaagtgctgaaattacaagtgtgagccactgtgcccgtcctggagtcaaaggctttggacttgaatgccatctctgctactttagagctgtgtgtgcatgtacttttaacttctctctgtctccctctcaaaatgggcccgatagtaggttccattttggtctggtcccaccaggacctctgactcgctggcgacctcaggtaggggctcatgtaatagcccagctcctcaaacacggaggatgggtcccactcctgacccagcctcattttacagcagagcgtgaaggccgagactagaggctgcaccaggctggggaaggggcaaattctagattactcaccaggcccgtacccatgagagccctcaggcctgcagcaccgtggatccagaggcagagacagagctttgtagaagggtgaaaacacttcctccccgcttccggctgcagaaaagccactttctcgcggcagagcccagactggcaacccccaggccttctgcacctcacctgggcagcaggcacgctgactgtgtgtgtttcaatctctccaggctcagagggatggcgggggatgctgcctgcgcggttgctagtggcggacacagctgcctggctgacactgcctttgtcatgctccagagcactcagccagcccggggcccctcacccactccctctctcctcctgccaccagaagcagcctcttcccggctcccaccctttctccccgaagccacttgtacctgctccagagcctggagaggtgacaagtgcttcccagacaacaaaagcatctcccaggagaacagatgttacgcacactcagctacacccttgctctgtgccctgattttaagctgtgtttgggcagctctttgggatgaaactgaggcaaggggtaaagggcctgtcttggtcaaggtcatcccaccttgggactcctgggtgtgtttcagacatccgtccccttgggttccaatgctggtctggccacttacaagctgtgtgaccttgggcaagttatttgacctcccagagcctaatttccccccagataacgacagataggtagtgaacccacctcttgctaaaaaatgtgagccattattgtcattactccatccttttaattcctctttctctccactccagccacatccgcctcaatgcctgctgcccctggaccttaggcttgggatgtgaaatctttctggaatgttccttcgttagttcctcgcatggcttgttccctcgcttccctcttttgagtcttgactcaagtcacctccccagggaggccctgtcctgccctgtcctccctgggcgcttatgtgacatccgaggcggtttcccaattcgactacctgtggctcttgcgcctggaacgtaagccccacgaggacaggactgtttcacttctgactcccgtgtccgcagcgatggaaagaatgactgtgggcgcctacccccggaggatgctgtcggcgcccagtctggcggctcccggcgcgcgcccgcgaggtcacgtccggggcgcgccggccggaaggaggccccgcgtgggggtaggggcggggcgtccgagccaggccacgccccccggactcgcgcccccctctcagcggcagagccagccagcctggggccgcctcgcacttccgctcaccagccggcttgttcatattcatgaggcgggcgagaggcggggcccgggtcaccggcggcgccccgcccctggcttggaatcccgccccggcggaggcttgggccccagtggggcgcccccagcttccgcctcggggagggagtttccacttggtcacgactcaaaaatgtgtcgctcgcgcttctccgccccctcgttcctgccctgggggggtctcctccctcggaaggcaggaggggaggggccaagggagggacggctcctcctccccggggcaggtccttagggatcccgggcggactcctctccctccaagttagcgccttcaacaatctttcccctaccccgtcagacagtcttctgtcgcccagagctggagtgcaatggcgcgatctcggctcactgcaagctccgcctctcaggttcaagcgattctcctccttcagcctcccgagtagctgggattgcaggtgcgcgccaacacgcctggctaatttttgtatttttagtagagatgtggtttcaccatggtggccaggctggttttgaactcctgacttcgtgatctgcccgcctcggcctcccaaagtgctgggattacaggcgtcagacggcgcacccagccctgcaataatcttaaatttttttttttttttgagttggaatctcgctctgttgcccaggctggagtgcaatggcgtgatctgggctcatcgcaacctctgcctcccgggttcaagcgattcgcccacctcagcctcccaaagtgctgggattacaggcctgagccactgtgaccggcctttttttttttttttttttttttgagactgggtctcactccgtcccccaggctggagttcagtggcacaatcggctcactgcagcctccacctcctgggttcaagcaatcttcccgcctcagctgtccaagtagctgtgactacagtcatgcaccaccacaactagctaattttttaattttttgtagagatggggcagggtcttagtatgttgcccaggctgttctcgaactcctgggctcaagcaatcctcctgcctcggcctcccaaagtgctggaactacaggcgtgagctactgtgcccaaccaaaactaccttttttactttttatttatttattttgcgatggcgtctcgctctgtcacccaggctggagtgcagtggtgcaatctcagctcactgcaacctctgcctcctggtttcaagcgattctcgtgcctcagcctcctgagtagctgggattacaggcgtgtgccaccatgtccagctaatttttgtattttcagtagacaccgtgtctcactatgttgaccaggctggtcttgaactcctgaccccaagagatccacctgccttggcctcccaaagtgctgtgattacagggatgagccaccaggcccagcccaaaactacctcttttaaacttcccaaggatctgtgcaatattatgataccgagaagttcagagcagttgagtgactcacccacgtcacacagccggcctcaggttttccagaaaggttggtcctgctgggttggggtggcaggtgcatgtctcccacggcctttcaggaaatgaggcttacctaaggcactcctgtcttgctggatgtggctgaaggttgggtctgtgcgccacactgatgggagggagaagctacatgctaggagaaacgaaaccatgaaggcaggacaggctgcgtaatgtaaaatgaaaattcgcgggccatgttctaaaatgattaagaatttcaagacggtgacagcagaacattcagccacactcaggcccttctaagggccagccctgtgcaactgcatagctcacatggcttccatgaagcaagcctctgatgaaggagcccaagggtgacagcgctgccaccagggacatccccacctctgatagaactctcccccctagcccaggcgccccatcccgtccccgccctggaatgcaggacccagtctctagacttccaaaagctgagcattttaggctttgcaggacaggttcttggggagtcaggtgggtcaccctgggagtgtctcacatctgcaagtcccagccaggcccctggggctgcacctcctgggcattttcagctctgggccctgcgggcaggtggcgctgtgttgtacatgccaggcccagcatggcttcggttctgacttgaagccctcctttctccctggggcagggaatgagaagcagccagggccgcttcctagaataaacaccccacccgcagacagccccagctctgtaggctcagccagccagcgccaatggagagagaggctcgccaggccaccggctcagggttgataagtcatcctgatctcactccctccatcactcctgccttgtgactgggctctgcccgctgtgggctgcttcattcataatagctaccatttgcgggctctttctcccagccacgtgctgctggaagccctttctgtgcacttcccactgagcctcacagaggccagtggtaataggtaccctgaggactgcgatttcatagatggggaaaccgaggctcagagaggttagagggcttggccaaggtcaagggccagaggtctggatctgccaccattcatccattctgattcctgtcatctctcctacatctacaatgtaggtctcaagggttacttcttttgtttttttgttttttttggttttttagagatagggtctaagggccaggcgcggtgcctcatgcctgtaatcccagcactttgggaggctgaggtgggtggatcacctgaggtcgggagttagagaccagcatggccaacatggcaaaaccccatccgtattaaaaatacaaaaattaggcggatgtggtggcacacgcctgtaatcccagctactcaggaggctgagggaggagaatagcttcaacctgggagacagaggttgtaccactgcactccagcctgggtgacaagcaagactccgtctcagaaaaaaaaaagagacagggtctcagctgcatatggtggctcacgcctgttatgaggctaagacaggaggattgcttgatcccagaagttcgaaactagcttgggtaacatagtgagacccctgtctctacagaaaatatgaaaattagctgagtgtggtggcacatgcctgtagtcccagctccttgggaggctgaggtaggaggatcacctgagtctgggatgtcaaggcagcagtgagccgtgatcgcaccactgcactccagctcgggcaatagagtgagaccctatctcaaaaaaaagagagcttaataatctgttggagctgggcgcggtggctcacgcctgtaatcccagcactttgggaggccaaggtgggtgggtcatgaggtcaggagttcgagaccagcctggccaacatggtgaaaccccatttctactaaaaatacaaaaatttgctcggtgtggtggcgtaggactgtaatcccagctactcaggaggctgaggcaggagaacctgggaggtggagattgcagtgagccgagatcatgccactgcactccagcctagtcgacagagcaagactctgtctcgaaaaaaaaaaaaaatgaatgtgaacctaggtgatgttcaataaatgtttactggtaaaggattaggggaccaagttcagcccccaaagtgtatctatcagcgatactcaggaagcactgacaacatgccaggccctgggcaggaccttgcagggggagggacaaagcagacaatgtccctctccttggggatcttaccgtctaataggagagaccatcctccctccaagaggggcctactctgagaggaggacgcccagcacaatggcagggaggggggacatgcctccatgcctgttgttcacctagaaggagaaatggggcctggctctcctgcaatggcagctgctgcctcctggaaaagcagaacctagagaaaacagctcagagcctggccttgttggctgtctccactgcctgtcccccacctcgacagctacctgatgctccagggaagtagtgggttagagagcacaagctttggattcagactgcagacacatggagactgcaatctggactatgcctcctactagcttatacaaccctggacaagttagtgaacttctttgtgctgttgtcatccatataatgaaaatgtccagtagagagaaagagctggggatggctcacacctggaatcccagcactttgggaggctgaggcaggaggatcacttgagaccaggagttcatgaccagcctgggcaagatggcaagacctatctctaaatattattattattttgagacatattctcactctgtcacccaggctggagcggcacagtctcagctcactgcagcttccacttctcgggttcaagtgatccttctgcctcaacctcccaagtaactgggactacaggccaacacacccagcttattattattattatttgagacagagtcttgctctgttgctcaggctggagtagagtggcgctatcttggctcactgcaacctccacctcctgggtccaagcgattctcctgtctcagcctctccagtagctgggattacaggcgcacacaaccacgcccagctactttttgtatttttagtagagacggggggcttcaccatgttagccaggctgatctcaaaccctgacctcaggtgatctgcccgcctcagcctcccaaagtgctgggattacaggtgtgagccaccgcgcccagctattattattttttttagatagggtcttgctctgtcacctgggctggagtgcggtggcatgatcatatagctcactgcagccttgatctccagggctccggtgatccttccaccacagcctcccaagtagctgggattacagatgtgtgccaccaggcccagctaactttttattttttgtaaagagatgtggtctcttgggaggccggagcgggtggatcacctgaggtcaagagttcaagaccagcctgagcaacatggtgaaatctcatctctagcaaaaatacaaaaaattagccggcatggtggcgagcgcctgtaatcccagctacttgggaggctgaggcaggagaatcacttgaacccaggaggcagaggttgtagtgagccgagatctcgcaccattggactccagcctgggagacaagagcaaaactctgtctcaaaaaaaaaaaaaaaaaaaaaggtctggggtgtcattatattgcccaggctggtctcaaactcttgggctcaagtgatcctcccaccttggcctcataagagtgttgggattacaggcgtgagccactgtgcccgccctgtctctatttatacaaataaaaataaaagtaaaaaaataaaatgtctggtagagaaaaagaactggtctggaagtggctcacacctgtaatcccagcacgttgggaggctgaggtgggaggcttgcttgaaccctgcagttggagggaggctacagtgaggtaggatagagccattgcagtccaacctggacaagagaaggagaccctgtctctaaaaaaattcaaagaaaaataaaaaaagaaagactggtcttgccaagaactggaagtttcttttttttttttttgagatggagtcctgctttgtcacccaggctggagtgcaatggcatgatctcagctcactgcaacctatgccttccaggctcaagcgattctcctgcctaagcctcctgagtagttgggattacaagcacgcaccaccatgcccggctaatttttgtatttttagcagggatggggtttcaccatgttggccaggctggtttcaaactcctgacctcaagtgatctgcctgcctcagtctcccaaaacgttgggattacgggcgtgagccaccacgcccagccaatttttaaaaaatataatagagactaggtgggaggtgggggtcttgctatgttgcccaggctggtctccaactcctggcctccagggatcctcccacttcggcctcccaaagtgctgggcttacaggtatgagccaccgcgcccgaccgataaacatttttgctaacagatttaaactagcgtctcctgtaccttttttctacacacctcgaccccagggctgcagttctgcctgcctgaggtcggatgcggtcggctgcagggcagggctccgggctgaagcgcagcgattcccgccgccgtgagggggcgctctgcgggcctcggcctcggcccttccggacgcccgcacaggtcgccggacccagagagtcggcccttaatagccccctcctggaagcgctaggtcccgaaactggccttcccccggggcccatctcccggctaatgtttaacccggccacactccacattatccacactcaggagaccggggtgaggtgagggtggaggctgggggaggtcacctccaaatcgccaacttccgagcctttgctccaggcaaacggccttcctacatcccttccaggtatcaacctacagctcctgcgcacctactatgtgcccatttccacaacaggtcatgagcacctaatatgtgttcattagaccaaaacatgagcatccattacgagtccacacctactatgtgtgcattcacccacaacgtcctgagcacctactatgtgtgcattctcttaaaatgcaatgagcatcgattgtgtgtccacataacccatgagcacctgctatgtgtccatctgggcaccagcccatgagcacctactatgtgtgcattctcttaaaatgcaatgagcatcgattgtgtgtccacataacccatgagcacctgctatgtgtccatctgggcaccagcccaggagcacctactatgtgccaagccttgtgcctgccatggatgccttgtgatcaagagccacgtgcttcgggctctggcggggaccgcagcatcaaatgcacgaatgaagacggacttaaaaccagcgtcagatgcctcacctctaggggatgctgattctgggatgcctttttcgtctcctaggctcctcaaggccaactgcgctgggaagagggggtgtccaacagcaggagggctgtttttttgaactacaatttgccagcatacagcagagcagcaagaagataacagggcggggggcacgggattagcccaaacaaaacacactcaagaacgcgagtctgtggttcaacacgaggcagaaaacagctgggccgggtgcggggcttctccctcgcgtgtatccgctcactgcactcgctgccctggccgcgggcgccgcgcagggtgctgatgtccaggagggatctagacctcccgcggcgctcgggctagtggacgcaggtggtcccaaatgctgggaccaagctaggaaccaagcggaagctcggattgctcggcatcgggcctcgtcgttattctaccgtgagggaaactgagaccgagggcacggcagggagtcgcccgccgtctcaccagcgtgaggggttgcgccgggccccgaaaactggtttgcgccgcccggcatcgggatccgggacctctgcccgccgggcgctgcctgcgcgttcctggaactgggctgggcggagaaatcagggcccgcagagaggcattcctgccgccttccccgccgcccggggccgcaggggggcctggccaaggtgaccccgcgggaggaggcgaggggtccccgcccgctccgccgccgcgacctcctccatcttcccggtctgcggggcttttcctctgggcccgcgcgcccggccccctcctcgggcttccccgagggcgggacgtctcgggctcccccgcccccccaggccacctcccggccgtgtcctagcgctgccctcgggccgggggcggggccgcggggggggggtggcgtgaggatggggccgaggaggacgcgcgcggctcggcgccccacttccctccctcacccctccctcccggtgcccgctccccgcggccgcgccgccctcccttccccctccctcggcccagcgccggctcccgccgccccctcccccgacgcgcacgccccgcctggcagctggcgccccgggcctggggccgcagcggtgagaggggttttgctgggagggagggagcgagcgagcgaggggaggggtggaggccgccccccgcgcccctcctcctcgccctcctccgcggccggcgggccctcctcccgccgcctccctcctccctcctcccgcccgcccgccctccctctaagacatccccgcacggcccggccgccgcggccaccttccctgcccgagctgcagatgtggcggagcggccgggcgccgggcggccgtgccaggggagcccgcgccccgtgaggcctcgcgccccggcccccgcccgtcccggcccctcccccgctcggctccccgcgccccccgaccgccggagcccgcagcccggatcccgaccgcccccgccgctgaggtaggaagccccccgggcgtcgcgccgtggggaccgggccggggcgggggggggggggcccgcctgtcgcgccggggctgcggggcccgagggtctcctcccccgctcgcgtccgcgccccgggccattgtgagccctcgccgaggcccccgcgttcgctcgctcgctggctcgcgcgctccctccctcgccggctccccggccgggtccctcgagctctcggtctttcttctccctccttccttccctccgtctggaggccgggccgagcagcgcccgggcccggggcgggcgcaaacttcagctgggaagttgggcggccgcggtggggggcgtgcggcgaggtgagaggggggtacccggagcctgggcatgaagttgtccggggcagccgcccctcctctcggccgcgccggggctgctgctaggaagggctttggaaggtgcctcctcccttggccgggagagtctccctcctgctgcccctcgcaagcccgggtccttccttggacctcgggaaggggcgtccctggggggtcaggactgggagtttgggacaagtcaggcacttgttactcccctgcggtccgggtggacgcaggcgaccggcctggcagggaggagatggcaaggggtccatactcgccggagggcgggtctggagcgggtggaggagggggcgaggcaggtgcatcccgagggaggagaagcacgcacagcttccccgctggccccctgggatggggctggaatccaggctggcacctggaggccttggcatgctgccctgcccagcagggtactcgggccacagcagggcagcgtgcagcctgtctgcctgtccaggagggcccgcccagcctggccagagggtggccgggaagcaatggtttcaaggagttgcccagccctgccctggggcctgggaagctggaagggatgctgggaggggccctgggcccccagccatcacagcccaggatcttggctctggagggaacgcttgacactgagggggcagccaggccggctggggacctggccaaggcctgggcttggtctgggccatggaaagggcctgggccatggttcttggaggctggcaccctgggtagtaggccgccatcctgcgtgtcctggcatcctggagggaaggtggggccagcctgcggctggggaggaagcccagagacactgcgcttcggagggccttccagcccccgggctcaggggaggggaaactggccccttgggtcacccctccccaagccccattctggtgccacagtgccacagctgtccaggcccagcccacacacccatcccgggtgacctcggacctccccctctgcttctccttctccccagagcccaggctgggcctcctagctggcctggcctgcacagggggaggggctgcacctgggaggcccctcccaggacaccctttgccaagctccagcctggcccatttcactgcccacctccagctcaacttggccctgtctgcagccagccaagcaggagacagtgccagggacttgggatggtgttttggggggtgtgcggaccccttggaagcaaccctgtttttcttagcctttcctcctccccctcctttccggagctgccattagcgctgaccccctgtgcctgcccgcccttccctgtctgtgacctttgacctttggtgttaaatccctccagctggggctcttcggcccctgagtgaccctggcccaggccccctggggagttctctccttgctcctggctctctacacagggacacctgccagtccctccctcaccaatggggagggggtgccctgggaagccagacagtgagtcaccccacttccaggcaccgctgcttttggggtcagtggcttctggggattggctggagcccagtcacagcttggagggtgaccggggaaagcccctggcctgggagtctcctgccctgggttcaagtcttggctccaccaccaacttccagtggtccttgggtcagactcctcccctctcccggccttgtctatgaaaccaaggggtcagaccaggtgagctcccagagtccatgagaagcctgggtggaggggggtcagggggaggaaagagggtgtaaatccagcaaaagccaactctcaattatccgagggtggagcccggatgaataactggatgccacagacatcccaaaacctcattgcaaacaatcgtgtgaaccgcgtccccccaaagcttttgtttctgagaaacccagctgcaactgggtagccacagcgatttcttcccccgcctgaactccccttgcagggaggacaagtagagggctgagagtgaacaggccggagggaaaacaaaggtctcccagggccccttcttggggcctggagggaggcctggaccccatttccaaggcccccactctcccctccaccctccttcccggcctggccttggccccgggcggtgggagtgtcctctcaccacctaatcctctcagggtctgggcagccatataggaggaagaatgtgttttcccggcaacaatttcccatgtgtatttctagccacccgctccactcgcctggaatctgaattccccacttggaccagggggtgagggccagtgccggccagggtttggggcaatctctggatgagggagggtggcgacagctgtgactgggggaccagatgtggagctcttgtggggcatcttgggggggctcctggggaggcacttttgtgggtcgcctggcctgacccccagccccagaggctgcctccgaaggttcctgcctctaaggggaggcccaggggtctctggcacctaaggaggaaattgattccatgggagaggccctgtgctgggtggaattggggcgggggtggctgcagagaaaagtgtcccctgaatcccttcctctcctcatggctataattgttactttatttcacagcaggtgactgagaccacaggggaaccccggaaggtcctgggtggtcttcccctcacccagataaatgcccttctcaggggtagggggcatccccagcttggcggggctgtgtattgagcagtaagagaccctctccctgctggctaggggatctgtgggaccagctgaaagatgctctccaccctctgcctaagttgcctcccttcccaggggctatgaaagggtccacagagatgggttgaggccctgatgtgtatctgggggttcacgtctctgggaacttgcgccctgccccagcctgctgccagccctgggtgtggggaccacagccctagcgagtctcccgggccacatctgcctctcagtggtttctgaggtggccgcctccgccccaccctggtgaattctaagtcaggcgtggctgggggcggggactccgcgcttccaacaagcacctctagtactctgctggggggccagcgtgggggcactgctttgatcccagggactggagagggatcatggtgatgatggtggcagggtctgcagggcacagcctggaggagacccaggtttctctcctggctccggcttagcccctgggtgaggctgggcaggcacggaggccgggtactcgccttccactcccccactcccccagatgggctggaggattctggttagctggtggccaggctaagtgggcctggggggcatggagatgggaagtgattccagctgaggggtgggggcttcccatctgccccagcagcccctgctgggggatgggtgggggctgagactcttccagttcgatggctggggggcgggtgacttgggctcctcgtgccctttgtcttcggtgcttgagaggccaggtagtgcccaccgcagggaggggccggcctgtgagtgtcacatgtgcgtgcacacggactccagccttggcagatggctgccggggaagggacggagacccagccctggccccttcctccagtcatggccaagggcgggtgggaagccagcagaggccccaggagaccgctgagtggactgagtcagcccccggccgggagcctccggaaaacagtcctgcccgtcacatggagggtccccaccgctggcacagcacgctcccagggcagcctcgcttggaccctggtagtcaagaggtcgtcggaggccggtggggggaaactgaggctctgagacatttgagggtttggcccgaggtcactcccaatcggggaagaacagaggggaactggagtctggggctgtctggccctgacccctgaaatgtcggtttagcctgggaatccccccagctccactcctgccccccacgtccactgcaagggcatgacgggggccaacgtgtctggaagaagcctctccccttccctgcatcgtctgcctggggctgtctagcaagtcccggcctgcctgggccagttctcccctgggccactcccaccttcatccagagcccccattccccaccccaacttccaggcagaccgactctgagctgggatgtcccctccccgcaaggctgtaggggcctccattgtcctccctattctgaagtccccccaaccctgtgctggtgctcgtctccctgccagccccggcctcccccagcaccccccggagcacctagtggtcaccctgcttggttctagggccactgggccccgagggcctggagccaccaggcctggcagatcctgccagtgggtgttcccctttggaaggaaaaggacctcgatggctttggaggctgtccccggcttctggacttgctttcttccagagtaggcgagcagagaggggcgggtggctgaggaggagggcatgggctggagtcctgtgtgtgcggtgccctgctgggcctgctcttgcccagctatctggggctgggggccagggctgggagggcgtggcaggagatggagctgggggggatctgggcccttcccaccatcccagctggccagggtggttcctaggggccaccacacccttgtccagctctgttcctgggtcccttgcctgggacagggagaaagaggcatctatgtcaggagaccagcccctgcttctagccttgaccttgggcaagtcacattcctctttgggcacgaacccctccatacctacccctcccctcctcacttgggggtaaaggcgggaatgtctgtcgagtgaatgaatacatgaatgagacggactcattcgcggagtgccaggtgttgggatatgtgaagggcaggtaccactgtgccacctaagatgagtggttggggttgttggagcttcggctgtcctctcagcaggccccctcctgtggatggggaaacccaggcctagttttctcattctgggttccctgcctcactgcccagttcactctggtggatggggtgggctccgtgccaggggccgtgggaactggggcaggggtctgctggtgaggccttctcttcagtagccacagcgggtttggagctgcccggcgtcccagacatgtcccggcccactcccaggctcccttcttggaaggaggctctggataccagggccagtgggaggcctggggctgaaggtcggcgctgtgtacaccacgctgtgcacaggtgacactggcttcagtgatgcattggcaaggacttggacccgggacagcctgcctccagcgggggtggacagaggcaagtctttgcccagcaggccctcaggtacctggacccacagcctgtgtgcagctccagaaaccgaggctggggagggtgaaccagggagcacttggtggaggagggggcagaaggggatggtggctggaggaaagagaacaggggggcatggatggtggtgagggaggagctggcacctgggagcatcaggttcccagggggcaggggatcctgaggaaggggggtgccaaaggagagggcctggggcaggaggctctgggctgagagagcaggtggcactcttctgtgtagagccctctgtggctccccagtgccctctaggttctgtcccagcctctctgaggggcctctttctctcctgcctcctcgtctactccatgactggtagggtcactgcagatcagccgggccatagcctctggtcctctgtggcactgggctttggggtctgctggcgaacccagctgtgccccttgctggctgtgacagtggcaggtttccccacatggaaaatggggaaaatggcatccattcgcggggtcatcagggtgatggactgtgtgcagcaggcatgctgaccgggcgccgacccgcagggctcccacctccccaaggctcttcaccccatatccatgaggctgacccggatctgtgcccaaccccctgcaggagcagccccccccctacactgtttctcccaccccaccttggtcggggcaccctcaaggtccggttcgatctagcagggcctggcgttggaatgcatgaatgcgtggttggagaaccgaggcaggagggcaggccaaggtccaccgcccgccttacccactcctgctctcggagttggcgggtgccgttcccagtggacctggtacctggccccaggcaggggaggcgtgggccacgggcctgccccgaccccccaggacttaggagctccttgtgggatctgcctgcagccaggcgtggcttgggaggcgcggtgtttccttcgctctggggacccggcctcatccctgctctcccccagaagccaaggctcctgagtcctggccccgacactggggcaaggggttactgtgatgtcctgtgtgtgccacatttgtgcacaggtgtctgtacatccgggggtgctgtgggtgcctgctcatgtcctgtgctacactggcccatccctttgctggcctcagatagctctggctgggtctgctgagaatggcagtgccgcctggcagggcctgggctgtctgtgccccagccttgctgggcgtgcatccctgtctcgctccctggtgccagcccctcccagggatttgggtggcagggcccagtgctctggtcccctcccctcccagcccgggtgggtgggcaggtgtgggggctgcggggcgggctttcctctggctggggcccaggtgcaggcggtgatcatagctccaagcacccccccaaagctgggcagacaggaaaataccagacatagttgtgcaaaggtgcagcagcgggcaggcagcgggggggtggaggccactgcagcaggggcccggagccaccaggatggggaggcctctgtgccaggccggccctgcagctggactgccatggccatctgtgtgagtgtgcgtgtgtgtgccggggctcccggagcccggtgtcaccctccctgctggcgttggagaaggaagtgcctctggtggggcatctcctaggaagcccgggctggtgcaggccagggaagccctccggcccgtcttccagcttcagctctgcctgaattatctgggtgaccttggcaggcccaagttgctgtgcagggaacccccagcctggggccggaaacaagaatcctttaggttaccagtagctggcagcttctttatggcaggcatgaggacaaggccctcccttgcaagatgccctgagtcccagggaccattgccgtggtgtctgttacctacaaggaaaccaaggctcagagacagcagggcctttctgagttcccacagccaggggtggcacagggggctgtaaccaggcagcctggccctggggcacactctgtgaacacgcagaaaaaagatccctggcacatcccatcttcaggtgctttcccgaggaccccacggcagagggcagaggtcagccctggctgggtcacctcggaccccttgtgttcccaccccgggagggggtctgccctcccaaaaggtccgggggtgctggctgagtgccccgtcttgggagggggaggggctgcctactgagccaaaggttcccagggacggtgaatcccccactcttccaggaagtgccgcctgccctggcccctctcctgggatctgctgggccaggcctcaggataagctcctccccctccagtcctgggaggaggcctgtctgcggccagctccttccagggttgatcaggccttcccggggccttgtagtgctctttctttgatgcagttgggctctggaaggtggttagggccagctgtggtcactccccaggattgaagaggcctgaggttctttgaggggcataggcttgtttagggtgcacgctggctggcaggtggcagagcccaggttctcctggttcagggtgagactgcagtggcatagaggggatggccagtccccactcagctgccctcacagcggtagatgggccaaaggctatggactcatgcacactggcgacgattcattcagcacgttttattaagcacctactatgtgccaggcactgttctccgtgctgaacgttacggacgaaggagaagcactcaatagtgattggatgtgcagcactgcattggtttctccctgaaacccaacatgggggtcctatataatcccatttgggatgagggggatgaggcgcagactgaagagacacgcaaagggagtagcagagccgggtggggccccagatttcgagtccggttctgttgcctggtcaggaaggggggccctgagaggacgagccctcctgcctggggcccccagcaggccctgcccctgcccgccagcccctgctgctgggcggccaaggagggtggagctcttggccagagcagggagccgcagctggttcccaggaatctggggctgtggggccgtttgctttggcagcagatctgccctcggctctccaagcctcctggtgggccccccaccccagccagcccctccagcgcccacccactgcctgctctgctatccctcctagccccacaagtccctgggcggggagggggtaccaagcctgagcccctgacataggaagggccaatagtgaacatggcttctggacttacctggggttgaaacccagctctgccacggacaagctgtgggaccttggatgggtcacttcactcccctgagcctcagtttttgcatctgtaaaatggggatgaaacagcacctgccttcacagtacccgcacctggctatgggtactgtcctcatgctgcttgcccgtggcttctggttgtgggtttgccacctacttgtgcagcctgggctggatgcctcccccttcagccctcagtttccccatctgtaagaccatactgctgaagtgatggttccagtaatagactcagggacacccacagaccagggtttctctgactggttcaggagtgaccagggactcacttcctctttctgttaaattagaagatgacgggctgggcgtggtggctcctgcctgtaatcctagcactttgggaggcagagacaggaggatggcttgagtccaggagatcgagaccagcctggatgacacagggagacccccccatctctgcaaaataaaaaatttaaaaatgagctgggtgtggtggtggtgcacctgtggtcctagctgctctgcaggctgaggcaggaggatctcttgagcctcggcggcagttagccatgaccacgccactgcagtccagcctgggagacagagcaagactctgtgtcttaaaaaaaaaaaaaaaaaaaaaaaaaaaggccagacttggtggctcacgcctgtaatcccagcactttgggaggccgaggtgggcggatcacgaggtcaggatatcgagaccatcctggctaacacggtgaaaccctatctctactaaaaaaatacacacaaaaaaattagccgggtgtggtggtgggcgcctgtagtcccagcaactcaggaggctgaggcaggagaatgctgtgaacctgggaggcggagcttgcagtgagctgagatcgtgccactgcactccagcctgggtgacagagtgagactccatctcaaaaaagaaacaaacaaaaaaaacaaaggtgaccacatagacttctgagagatgcatcttgaggccttgtctccaagttctcagctaaatggccactgctgaccaaaagcgcactcgcaggacactccaaggcaaggggtgttcctcacattgcccttgacaacactgccacgctggtcactcacctgaccccatgctgctgggagcggggcagggatgcagccccatcttacagaggacccgcttccttctgcaaagagaccaagtggttctcagggtgggtgcacacagccccccagtgcaccctgcacctccacaggcttagggcctgccagccaccctcccccaagcaggaaaggaggagctttttttgttgttttttgagacaggccggagtgcagtggtgtgatctcggcttactgcagcctcaaactccccaggctcaggcgatcctcccacctcagcctcccgagtagctgggaccacaggtccctgcttccacgcccagctatttttttttttttttttttttccgagatggagtctcactccgtcgcccaggctggagtgcagtggcgcgatctcagctcactgcaacttctgcctccctggttcaagcgattctcctgcctcagcctcccgggtagctggaattacagacacctgccaccacgcccggctaattttcgtatttttagtagagagagcgtttcgccatgttggccaggctggtctggaactcctgacctcaggtggtccgccctcggcctcccaaagtgctgggattacaggcatgagccaccgtgcccggccaccggctgatttttttacttcaaacgggatttttccatgttgcccaggctggtgtagaactcctgcactcaagggattctcctgcctcggcctcccaatgtgctgggcttacaggcgtcagccaccgcgcctggcctagaaggagctttattcagagcaggactccaaccagctccctattagcctagtgatctcaagcctcagtttccccatctgtgagatcgggaaaatgacagcagctactgccaggcagggttgtagaggggtcattgaatccatggacagatgggcctgacacgtggtcagtacctaatggtcctttaccccctctggtgtatgacccaccccaggccaaggggccctggaagagactgtcttttccgggccttagtttccctgagtgtgctgggtcgccccgtgccttccagtagggagggtggggacagtggccggccccgcctgccagggcgggatccttggctacctggcctggccggggactgcgggcggggggccgggtggctccgccagcgctgcagctgggggccgtctgctcgggctgcggtcgggcacacaatagcagccattgtctcggccagggtggcggggggcccgcccagcccaccctccgggtgacccccgccctgcggtgggtgggaagggcagggcccggtcccccgaagcccccgccgtcccggtggtccccgcggccgcccccgcgcgcttcctccctcgccgcagccgcttcctcccgctcgccccgctctaattagttccttttgcagctggaggagccgcgcagcggccggttccgcggccacccccaccccccaccgacaaccccagccctcgccccaacccctgggcccttgcgtgtgggggcgctgccctgggcgcatcccaggctgagtgctcgagagacgcggccctgggctctgtgcaccctccacgctgcgctgtcccaccggggggaaactgaggaacggaaggctccaccaggaggcgcagaggggcgtggggccggcgggccttgcgctgcgcccggggagcatccacggggtgcccccacctgaccgagagccggctcctgccctcgggaccccgcagtaattagcacccaggcctctggctgagcttgtccagagccaggctgtcggccttacgctggggagagccacggccacccgctcatgggcactcactcagggttccctggttgcaggcccgctgctccccgctctgggcctccgaggctttcaggagagcaggaacctagctctcgcctgcccccttcacccagccgggaacaaaagcacagagcagagcccagaactggctgctgccggtcggggcgggggtggaaggggaggctttaagcctggccaaggtcagaactgaagcagggtcactgaccgtctcccctctggggtggggcctccattggaggaaaaactctgggtggggagggcctggaacagggatgctgggaggtgtagggctgggggcagctccttcctttcccgggggcagggacgcaggccgtgtgccgggctctggcctgcattggaatgaacccctgcctccctggcaggacccagtggcaggaagtgtgtgggggtgcccctggggactggacctgctgatgaagggggtgcattggagtcctccctctggctttgggccgtgtggctggccccacctggggagacaggctcctcctggggaagtgtcccctgcaggccctaagaacaaggtgactcagggcccctggctccccgagtccccatctgtcctgggaaggcagtggggcaggtgccaaaggatgttgcttgggcagcgctgccagtgagtgtccccgtcagctggaattcccagttcccaaaccatcctgcccttgtggtccccttctccggaagggtgggggtgggggtgaggacagaggctgtggggaggcctgtggccccaggccagccaagggaccaggccaccagcccttcctggctcctgaattcttcatcagcataaatatttacttccttcctccccgtccaggcttccagcacagaggagcttcggggaggctggattgcgcctgtgtctaaaaataaacaggtagcaggacgatagacacacagatagacagatggaactggcaggggttcaggcagagggcaactccctgtccagccagagaaacagtggaggggaccctggtccatccatcactgtcacccacccacctgctagcgggggtgtggtccctaccccaccgcatctctgggagcccctggcccatgcatggcctgggaggcaaattcaaacaatctgacagctccaacaggggcgaatcgcagacctaggtcccacggcctagtgcagctgccctggctctgatgatgcagccttgggagaggtgggcagcccccctgtgctgagacccccgtgtcagccatgttggggtggggtctggggatgtgtccctagaagcagaggatctccagtgaaggggggaccattttatgccctacttgcttggagagtcagggcagaaggggaggacgtgggagctgccttcctgtcctgccctgtggacagcatctctccccactcacaggctatgctagcccccagggaaacacacgggggcatatccaaagtatttcaccatgtagtagttatgtccaccatggccgccctttggtattgagtaaagaccccaataccgcgaaagacgggatctcacagcgtgattgtgcggcagttagattttcaagttgtaataatcccaatgaacaaacgcaaggaaatgtcgtgtttaaccgcgtaggaaaagattgctgctctgaatgtgaagtttgggtttagaatgaagtgttgaccttgttcttgggtcggtggatactgttagatcatttgcatgtgaggaaaattacaccaggtggggcgaggtggctcacacctgtaatcacagcactttgggaggccgaggtgggcagatcacctgaggtcaggagtttgagaccagcctggccaacatggtgaaacgctgtcgctactaaaaatagaaaaattagctgggtgtgatggtgtacacctgtaatcccagctacttgggaggctgaggcaggacaatcgcttgaactcgggaggcagaggttgcagtgagcccagatcacaccactgcactccagcctgggtgactgagagactccatttccaaaaagaaaatgaaaattaaaccagtgagaaattctaagaaaaatgatgaaaattacagcatgggaagtgatactaaaagaataccatctccagtaaaaaataatttctacatatttatatattaaccgccagatacagctggtcaactccaccaaccctgccccagctggccaggccaggccacaatccccagctgccccctggtggcgacccagcgccctggggctccctggcttgcgatgcctctcctctaggcctctgcagggagggcggtggggcccctggctgtgcccactttctcggtttgcctggtgcgagttccttggtggtgagcgtggctacctgccggccatttcagaggatgctccttgccccctggcctggttctagatctttggggtcaaacagggcgggagtccggagcatggctcctgctctgtcagaaaaggctgttaggacacggctagccagttcccgggagatctggcttcaggccttgaatcttgttgggaacaggccccccaaaatctggctgtaaactagccccaaaactggccataaataaaatctctgcagcgctgtgacatgttcatgatggccatgacgcccacgctggaaggttgtaggtttaccagaatgagggcaaggaacacctggcccacccagggcggaaaaactgcttaaaagcgtttggctttttgtttgtttgtttgtttttgagacggagtcttgctctgtcgcccaggctggagtgcagtggtgcgatctcggctcactgcaagctctgcgtcccgggttcacaccattctcctgcctcagcctcccgagtagctgggactacaggcgcccgccaccacacctggctaatttttttttttgttatttaatagagttggggtttcagcgtgttagccaggatggtctctatctcctgacctcgtgatctccccgccttggcctcccaaagtgctgggattacaggtgtgagttactgcgcccggccacaggcgttcttgaaccacaaacaatggcatgagtgatctgtgccttaaggacacgctcctgctgcagataactagccagacccatccctttatttcccataaggaatactttcagttagtctataatctatagaaactatgctaatgactggcttgctgtcaataaatacgtgggtaaatctctgttcaaggctctcagctctgaaggctgtgagacccctgatttcccaccccacaccgctatatttctgcgtatgtgtctttaattcctctagcgccgccggattagtctcccgaccgagctggtcttggcaaatctgatagtttttccacttctgagctctgcgatctgaggcgatgcctgtaaaagacgcagtttcgccaagcgtggtggctcaggcatgtagtcccagcgttttgggaggccaaggcaggaggatcgcttgaggccaggagttcgagatcagtttgggcaacatggagagacccgatctctacaaaaaagaaaatttttttttttaattagccaggagcggtgcctgcctgtagtcccagctaccagggaggctgaggtgggaggatcgcttgagcctaggaggtcgaggctgcagtgagctatgattgtgccacttgcactccagcctgagtgacagagcgagactctgtcagcaaataaaattcagtttcatggcaaaatgaagaatgtgagctttgtcttccccaagagactcatgggaagcagatgcggaatctctgaggaggctgttggctctccccccatgatagctgccggccaggtcgctcggagggtctccctacccaggagacaacctcacactgccccctgctcctgctcctgttagactgtcatgagtacagcccgaggagaagcctggggtctcagtgccacagcacagctcctgtccttccccaggttcctgcgtgaagaccagctgggagcccactgcctgctgccacctccaactccggccccctcaccatgcactccctggacgagccgctcgacctgaagctgagtatcaccaagctccgggcggcaagagagaagcgggagaggacgctgggtgtggtccggccccgtgctctgcacagggagctgggcctggtggatgacagccccacacctggctctccaggctccccgccctcaggtactggccctgggcagggcagggggacttagccctgatccagtcatggtgacagggagaatggccaagtgtgtccaccagcatgtagctgcagcccctctcggcttccggttcatgggaagcccgcacgcttgtccttccatccgcccagcatcgtatgtctgcagggaggtgggagctgcagtgcccagctcacgtggctggcacacgatgcaaactgaggcctctaggcagatctggaacagagctggtcgggcaaccaggcattcagaaggagcggcagtagtcccaggacctgcaccctaggctgtggggtggtgccgctggccaacctgggcagtagaggctgggtctgagcccaggaggtgcctctcagggattcccggtgcttgggcccagggtggtgggcaccacttctgccctgcctccaagagcagagtcacccgaaaaccagattcaccgcttgtctgaaggggaaggctatgggagcagcccagcccgaacctgccactttacagaagggaacactgaggcaggaaggggcctgggaaaagctagaaaggttcctacctgcccgtctgacagggacccaggggccctgggttcgagtcctgttctgttattaaccctgcgtgccagaccattcccgtctgcaaagcgggcacttcccccctccccggctcacgggggccaagctctggcggctggtaaagctcagaggtggtgggtggtgtcacacacctgtcagctccacaggctgctcctcacattcgtgtggtctgggggcatggctggtgtctgctcccaaggtcacagtgggggttcggaggcaggagtacctggcccactgggactctacactccagcacaccctgaactgtgcctctccctcaggcttcctgctgaactccaagttccccgagaaggtggagggacgcttttcagcagcccctctcgtggacctcagcctgtcaccaccatctgggctggactcccccaatggcagcagctcgctgtcccccgagcgccagggcaacggggacctgcctccagtgcccagtgcctcggtaaggaggggtgagagttccggagagaggggtggactggtttcctggggttgccatgacaaagtaccccaacactgagtggtttaaaaaacagatgtgttacccctcataattctggaggctggagtctacctggaaggctctaggggagaaccttccctgcctctctcctgccttctggcagcttctggaaatgcctggcactctagcctggtagctgcttcactccaggctctgccctgtcttcacacggtctttgtccctctgtgtccgaatctctctctggtttctcttataaagacaccagtcatggccgggcacggtggctcacacctgtaaccccagcactttaggaggctaaagtgggaagatcgcttgagcccaggagttcaaaactagcctgggcaacatagcaagaccccatctctatttatttttttgagacagagtcttgcttcattgcccaggctggaggccagtggcccggatctcagctcactgcaacctccgcctcccgggttcaagcgattctcctgcctcagcctcccaagctgggactacaggtacacaccatcacacctggctacttttgtatttttagtagagacagggtttctccatgttggtcaggctggtcttgaactcctgacctcaactgatccgcccatctcggcctcccaaagtgctgggattacaggcgtgagccactgtgcccggccttttttttttttttttttaaacagggtctagctctgtcacccaggctggagtgcagtggcatgatctcggctcactgcaacctctgcctcccaggttcaagcaattctcctgcctcagcctcccaaatagctgagattacaggcatgtgccatcacgcctggctaatttttgtatttttagcagacatggggtttcaccatattggccaggctgatcttgaactcctgacgtcaagtgatccgcccacctcagcctcccaaagtgctgagattacaggcgtgagccaccgcacctggctatatattttttttaattaagaaaataaaaatttaaaacacaccagtcactgggtgttgggcccaccctaatctagtgtgacctcatgttaacttgattacatctgcaaagatcctagttccaaataaggccacatgcacaggtaggggctggggagaagaggacctgaatgtctctgtttggggacaccattcagtccactaccgatgggacggggggctctgggccagcaggaccttgactagccctcccctcgcaccccaggacttccagccactgcgctatttggatggtgtccccagctccttccagttcttcctgcccctcggctccgggggggccctgcacctgcctgcctcctccttccttacccctcccaaggacaagtgcctctcgccagacctgcccctgcccaagcagctggtgtgtcgctgggccaaggtgagtgggggccagcaagagtagtgtggagtctggggcaggtcaccccgcatgggctcagaacacttcccatcctccgcagtgtaaccagctctttgagctcctgcaagacctggtggaccatgtcaacgattaccatgtcaagcccgagaaggatgcggggtactgctgccactgggagggctgcgcccgccatggccgaggtttcaacgccaggtgaggtgggggagagaggggtagagggaggactggggtctccagtgagctgagccgtgccccccgccctccctggagcaggtacaagatgctcatccacatccgcacacacaccaacgagaagccacaccgctgtccgacctgcagcaagagcttctcccgcctggagaacctgaagatccacaaccggtcgcacacaggtaagaggccggggccgggcggcttggcccatgaagggggcgctcagctgagaccggctgggcaggtccccagggggaggggactgttaagtaaatcccgggcctcagagataagggttgatgtcatcgcccaggggtcccttttccaatgcagtttgctaggggaagcatcccctgggggtcagacccccacccagcacctgctcttggagcaccaatgccatttcctggttcccgtgggtatcttctgactaatgccacctctgtgatcgcagaggccaggtcggcttcactcctcactacagcccaggcccataccaggacagctctggttgtcagagccacagacataattttacatttcctaatcgctgcataaaacacagcaaaaataaatgggtgaaattaattgtaatatggttcgttgaccccggtacatccaacgtgttatcaattcattattaaagacaaatcagtgagatattgaagttcttcatttcatgacaaagcctcaaggagctgatgtgtatgttttttcctggtgtttatttcaccctggcagcacatctccaggtggagagccatgtatcaggaggtcagtcactacatgtggccccctgctctggccagggcagcagaagatgcctggtgaaccttcagccatttgttgagtgagggcagtagcgcccaggcagcactccctgtggccaggcccacgctgggcgcctcgtgccaggatgtgatctccaaggccatggtgtcttttttttcttgagacagactcactctgtcacccaggctggagtgcagtggcatgatcttggcccactgcaacctctgcctcccaggttcaagtgattctcctgcctcagcctctgaggtagctgggattacaggcacctgccaccacacccagctagttttcgtagttttagtagagacggggtctcaccatgttggccctgctggtctggaactcctggcctcaagtgatctgcctgccttggcctcccaaagtgctgaaattacaggcgtgagccaccgggcccggcctccaaggccatgttctgctgctgaaaggcacatcctctgtagcagagggtgcagggcgaggctaggcagagctggagtcaaccaggctgagttttcagcctctgtgccctgcctgggggcagatctcatgccatgtgctggggatgccccctgcccccagaattggggcatctatgttcccagggagtgcttggcccggggaaatgttgagtgcatggggtgagacccaggaaggggagagacccctcatggcggcactgcactgcaccaccctgcaggtgagaagccctacgtctgcccctacgagggctgcaacaagcgctattccaactccagtgaccgctttaagcacacgcgcacccactatgtggacaagccctactactgcaagatgcccggctgccacaagcgctacacggaccccagctcactgcgcaagcacatcaaggcccatggccactttgtgtcccacgagcagcaagagctcctgcagctgcgcccaccccccaagccgccactgcccgcccccgacggcggcccctatgtcagtggggcccagatcatcatccccaacccagctgccctctttggaggccctggcctgcccggcttacccctacccctggcccccggcccccttgacctcagtgccctggcctgtggcaacggtgggggcagtgggggtggggggggcatgggccctgggctgccaggccccgtcctgcctctcaatctggccaagaacccgctgctgccctcgccctttggggctggcggactgggcttgcctgtggtctccctccttgctggcgcagctggtggcaaggccgagggggagaaggggcgtgggtcggtgcccaccagggccctgggcatggagggccacaagacgccccttgaaaggacggagagcagctgctcccggccaagccccgatggactccccctgctgccaggcaccgtgctggacctgtccacgggcgtcaactcagctgccagcagcccagaggcgttggcccctggctgggtggtcatcccgccgggctcggtgctgctcaaaccggctgtggtgaactgagcccatcctgcggacagttgtggtgcccccccggcagctcccggcactgcccccgacgaacggaaactcttctgtgaaatagcaataatgtcctactgcccgggcagccccagcccagcccgccgggagcaaggatggtgctaggtcattcatggctggcctcccagcccccgggtggggacctggcctgtcatgcagggagagctgtgctcctgggtgctgaagcctcgctcctgtctgtcccccaccacctggccctcagcttctgagaggctttcccctgcccgacctcctcccgtttccctctcccaccctggcacctccctcacctagtgaccacccatggcaagttgccctctcccagcagagggggtgggtggggtggcatctgccctccctgctagcaccaggctcccccttcctgagaggagcccccagggaccagaggcctgcccttccctcctaggcttacccagcccctgccctgggggctccttggacccctttccctctgaccctgcctccagagggaaagcaagacagatgcaggcccctgcaaagccccaggtagaagcatgccccccaggacaaggcgcctcccactagttaggaggaggcccgctctgcagccgccgtcctcaccccaggccaggcctgcagtaccagacgggatagctggccactccacccctgcaccccagggtctcctccctctaccttttggggcaccctgggagcgtgggaagcaggtccgagggcccctgagctggcaaggggaggtgccaggccagctgtggtgccaagatactgagtgacctgggccctggctcagggagcatgtggggccaggcccagcgccccgtcttcctccttctacccccgctgggcctggcctgggcagcgccccctgcagaggcctttgggtccttggtcctgtaacaggaagggggaggctggctggggacgaccgaccacaggctgggacacagctcctggtctgggggctccaagtgacagcatgcaggggagggggctcccagtcagtgctgtgttgggagctttctggaggctgtggactgaaggccttgagggaagcagtggctggaggagggtgctggacccatgacacgttgcttcctctggcttttccctgctgggccgctttctcagaggcacttccccacccctaacacccagtgggcccccccaggttctgtgccactcagagggaccctggcaggggccagaaccacttaagggtggtgctggagggccttgtgccccagtcccatcccaggacgccctgagggatggacgcagccatgcaccccccatctggggcctctccctgctccctctcccacctggcagctgggagttctggcttctaggcctgccctgtcaccaggcctctgagtggccaggcccttccacctccccatctgtaaaacgaggcagctgcccggacagccttggggtccttagtggccctgcaggtcctctggcagctctgctgaccccaccctctcccggactgcccttctgtcccagaggggtcaccctgacccggcccaccttgccactgggctttggactccagccctgacagggcccagccacactggctctgcccctcgaaggggctatgagcaaggtaggagggagctggtctcctttcttcgggccccacccaggccctgagcaccccccacccctgtgagggccccaggccttaagtccctggcggggtcatgggtttgcgacttgagcagagcggaggaacagggcactggaaggccgacgagctcagcatgcgactcggtgacggaccaggctcggcagggccggtgtactttttgtggttgtcattggtgtgttgttgcacattccaggacgtcagtattttaacaggttctaagtgcctttctatcgtagcttatgttttcctcctcttggctccattgctgttagcatagagttttaaaaaaagagataagctaatgactataacaatatattcctccatgggagaggaagtttataaagaaacaataaaagtgagttgcaaagatggcttgtatgtcgtggatgtgccaggaacccggccctgacatgaggccaccactgccctgagcccctgcaggcctgatccgggctttctccccgaccctgcaggtgcccctccctctcaatctgccgcttagagcaggaactggaaggttgggaaggaggtaggtgctgagggcgcacaggtgacaggaactgagacagaagattccaggcggagcatcccaaggtccaagtcctcagcccactactgcccgctgcggctttggagagtggtgggcaaaggcccttctccccccagccacattctggggtactgtgcccagattactgaggtgctaggttcaaacctgccccagggacagggtggctgccgacaagagctctggggccaggagaccgccaccccgtgggaggggcaggggcgctatgggagggagcctcaccctggcacgggtgctgtggaagcaggagcggctgcatcctgtacgtgacaggactcagctggagcccactggctggctgcccgccaaccttacccagcccggcccttctgggctgttaaaggctgctgcctccccatctccagcacccacagccctgcaaccggcaggaggagcaacctgccttctggaatctggacacatgcaaacgagaaatgcagaaaagaaatttattaccaagctataaattagaggcggcggggtgggcggggggagccgagcagtcacgtatggggcatctgccctttttctctgtcctcctgggcctggattttgagttcctcatccaggcgctcctttgcgcggaccacctagtgggtcacggataatcaggccgggaggccaagcctccgccccataccccttgcccacatgggatggcctattcccatcagcccaggtccattttttgaagggcagtgggtggataccaatgcttccttcagtggcaccccagggtcggggtggcctggggagacagagctgggctgcagggcccagcgcatgctgtgacctctgtgagctgagagctgtttctagcaccccacccatgggggctcctgctccttcgaagtcccagctgctgggagggagggctctatctggggtgacacagcctgagtggctggaccccgcaaagctgaagcagtcagaggggtggcagttcagggggcctccctgaggctggggcaccatgggaaagcctggcacagttttctgtgtgccaagcccttagctggccagctcccccaactaggaattgagccccaggtgagaagaaggggtcccatgacttcattcctcccagaatcaaagaccactcacctttgactgcaggtagaaggagccacccacggatttatcattcaccttaaataagtgttcatagttctgcagaggagaggggacgggtgagagggctgcagactgcaggcaagagatgttgggcaggctatgtggggccacgtgagagaggcaacaggactcctctccaccctgtgtgccacacccagctgttgtggccactgagaggcagagatggggacgggtaccctggagggcaactgagctgctactggaaggcactctttgtctctagactgtcctgcctcaggcctaaaacttcacgagcaacagtggctcccgaaagttggagtccgagctgggtgcagctgcagcctccacatcggacctccctggccaggcctcccttcactcttcccaccctggcagcctctccctctcaaactttggggtggcccagtggcctcaccttctggacctcctcagggctcagcttggacacgttgagaatctgctgtgcctcctggaggctgaggccggagaggttggaagcggctgcagaccggtgtccagcgcgtcctcgggcatcagctgcggcccggctggctgtgtggacatgtgggtgatcgctcagtcctcagcagcccacacttcaccctgggccttccgagttggtggctcacccctgccaccagcacaggatgagagacacagggacaggtggctaggagctgcctcttctccaggagtggtttcctttttagggggtagaggctgggaaagtgaggacagacgtgcctcactggagggtaagggcaggatctgaccgctaatcctggctcctggtccccaacctagaccatgagatgaccctgtcccccaacccccatatcccaggggaacagcaaattggggagctttaggctacgatggagactgtatagtggggctgcgggcatgagagggctctgcaggggcccagctgcccacctgtcacctagaccaccaaagccactgccttgggtgacctctcccctttcagtgaccccagaacctagaatcaggagctgctaaacttttcctaaaggctcagagagtagctattttaggctttgcgggctaatgagcctacactggaaccattcaactctgccttgaaagcagcctgtcggccgggcacagtggctcacgcctgtaatcccagcactttgggaggccaaggagggcagatcacgaggtcaagagatcgagaccatcctggccaaaatgatgaaaacctgtaaaatacaaaattactaaaaatacaaaaatcagctgggtgtggtggcacatgcctgtagtcccagctactggagaggctgaggcaggagcattgcttgaacccgggaggcagaggttgcagtgagccaagatcgcaccattgcactccagcctgggcaacacagtgagactccgtctcaaaagaaaacaaaagggctgggtgcggtggctcacgcctgtaatcccagtacttcaggaggccgaggtgggcatatcacgtgaggttgggagttcaagaccagcctgaccaacacggagaaaccccgtctctactaaaaatacaaaattagccgggcatggtggcgcatgcctgtagtcccagctactcaggaggctgaggcagaagaattgcttgaacccgggaggcagaggttgcagtgagccaagatcgcactattgcactccagcctgggcaacaagagcgaaaactccgtctcaaaaaaaaaagatttatttacaaaaccagggccgggcgctgtggctcacacctgtaatcccagcactttgaggcaggcggatcacctgaagtcaggcgttccagaccagcatggccaacatagtgaaaccccgtctctactaaaaatacaaaaattagcctggtatggtgtcgggtgcttgtattcccagctactcaggaggctgagggaggagaatcacttgaaccaggaggcagaggttgcagtgagccaagattgccccactgcattccagcctgggcgacagagtgagactccatctccaaaaaaagaaaaaacaagtttacaaaatcaggtatccagatgggccagtgtgccagctcctgccctggatgctcttgctaaccaggtaccactgaagaatgccccggtctggcatcaccccccaccatgggaagtgcctcaggccacgcacacttcagaaccgccaggcctgaggtgcccatggctacggggaaaatctgacctggagaggaactcccagcccacaggggagacggacccatgcttacctgcaaactcctgccgcaaggcccgtgcaaaggccctgcccaccacctgcacgcccatcacaatgatctgggccaggtacttggcctgtgggcaaagcaggcacccggttagcaggccactccctgtgggcccacagagatgggccctggaaacggctgccgaggggcaaggctcccggagacccgaggtcatgaagcacagagctgcagccccaggccaacccctccaaagcaccctgaatgaaagcttccatggtgggtggcttagttactcactggacaggcaggcaggcgggtgaacttgaccgagctcccagaggcagactggccccacctcatccttcaggaaaggcgtagaggagcaaggcaaagtggctgcaaccaccggcttcaggaagaaacactgtggtctgggagccagaacacagggacagccctggacctggcagtaactcactctcgaccctggggccgaccatcactcttcctgagtttctgagatcatcaggcccaacctttactttaccaacggggaaacagatctgtcctaattctcccaagtccgaagactttaagtccattccattcaataaaacaaacttactatgcaaacctgtttccatcttcaaggagctaaaagcccactaggagggtatttaaacacactatggaccaaatcatgagggagagtcaggctcgttcatttgtgcagccattggttcacccattcattcaaacatctgctgagagtctactctgctcagcacttgagcacaaagctacacagaacctggtccctgccccgagtcagagcacactgctggcctggcagggaaccccactgtcacacaccaggctgaacatgccggaacactgcacgtgtgattccatgccccgcagaggccctggggactcactaagatgtgagcggaagcaacagagtcgagggaaaactcaagactgagatgggattcggtgagaggagggggttctgtgtgagaggagggcgttccgtgagaggagggggttccgtgagaggagggggttccgtgagaggagggggttctgtgagaggagggggttctgtgtgagaggagggggttctgtgagaggagggggttccgtgagaggagggggttctgtgtgagaagagggggttctgtgtgagaggagggggttctgtgtgagaggagggggttctgtgagaggaggggactgtgtgacaggagggggttctctgagaggaggggactgtgtgagaggagggggttctgtgagaggagggggttctgtgagaggagggggttctgtgagagaaggggactgtgtgagaggagggggttccgtgagaggagggggttctgtgagaggagggggttccgtgagaggaggggattgtgtgagggggggttctgtgagaggagggggttccgtgagaggagggggttccgtgagaggagggggttctgtgagaggagggggttccgtgagagaagggggttccgtgagaggagggggttccgtgagaggagggggttctgtgagaggagggggttccgtgagaggagggggttctgtgagaggaggggattgtgtgagaggaggggattgtgtgagaggagggggttctgtgagaggagggggttccgtgagaggagggggttcctcctgggctgggctttgcagggtaggaagaatcatgatggaaatactagggctttctaggcagagggactgggttgagccaaaactggcaggagagaaggcagaagggagttcctgcgagcagccaatagcctaggctggcctgggaaagactgggaatctggcggatgacatggaaagatgcacagatctttgtgaaacaaagcgattatatatagacagcacatacaaaggatcttgtgactgcaaagccgtagacgcaggggggtggcgcgggctggaggcagctcggcataggttgaaagctcatgtggcacagccgagtgactttccctttcttcctagtgcttttctgtagatttgccttcagtcaacaagtatcaactgagtccacacaccaggcacggtgccaaacacgttcaattcattgtgccgtttaattctgacaactcaggggtgggggactgctgactggcccgaggacgtaacagcaggtgcctcggaggcagatcggaaacccaaggctggtgctatctgtcacagcagtcactacgcagggtcccggggtctgaaggtagggcacctgggcaagccgacaagtatcaagaacccaaccccgaggccagaggggcttgctccagattccagtggattcgactccagagctggccttgttcagcctccgaggacctgctctttccttaacaggtgggatgtcattatgggccattaggggaatgaacaaacaagtgggttaagatttcaaaagtaggtggaaacttcataacttctggatttcacagcagaaagagcccagagaagaccctcctgtgatcacagcgaggggcagggctgtggctgtactgcagatgagggagggtcagggatgcacctgatgacacctgcggtctcacctgacttcgcctccttcctaaagcccctcccgagtggaacaggaggctcagggatgggatgctggtgctgtctgaaggacagaggtgaaagtcagagggtcccctcggcttgaaacacggctcaggtctcagactacccctcacaccaacagccttcggtccctctgctgccatcgtacagccttgcaatcacttgtttacttttctgccaaggccaatgactgttgcaaaataatgaacggtaagagctgaggtcataactggggagcttccccgaccatcccctgcacacttcaaaccaaagcggcgtggtggcctgtggcttcagctgcctagagctgcagggcagaggggggctggcctgcaaagtttcagcagactggacggcccattgaggccagcaaggttcctataggaggcatctctgagaagacgcagtgtagtgtaatggttacacctgcaggctttgggatcacctgtgtgcaaaaatcccagctatctgacatagacacgttctcaactcctttgagcaacccagtttgcttacctgtaaaatgtggccaccaataaagctgagataatgcctgtcaaatgcctggcacacagcctaatggtacagcaggtgctcaataaacattggttttcattcattactactgtttcacaaaatctgacaatgaccaggcactatgaagtaacaaagcttctttcaaaatagcagctcatttgatacaggccctttgcttcctcaggggtgaaggctgcaaaacaccatactacattccctcagggagctgggaagcagcaaggaagcagaacgagaaccacgttgacctgggaccagaaccctagctttctttctcaatagctgtgtgaccctggacaaattactcaacctctctgaatctttttttgttttggtttgggtcttttattttttatttatttttttgagactgactctcgctctgtcacccaggctagagtgcagtggttcaatctcggctcattgcaacctccacctcaccagttcaaacgatcctcctgcctcaccctcccaagtaactgggattacaggtgaacacaaccaagcctagctaattttgtatttttaatagagacgaggtttcaccatgttggtcaggctggtctcaaactcctgacctcaggtgatccacccgcctcggcctcccaaagtgctgggattacaggcatgagacaccacacctggccttttttttggaagcagagtctaactctgtcgtccaggctggagtgcagtggtgcaatcatggctcacttgcagcctcagcctcccagcctcaagagattctcctgcttaagcctcccgagtagctggagctacttgtactcagcctccgaggacctgctctttccttaacaggcgggatgtgatatgggccattaggggaatgaacaaacacaagtgggttaggatttcacaagtaggtggaaatttcataacttctggaggctgagcacacgccaccacatttggctaaatgtacttttctggagagatggggtttcgccatgttgcccaggctggtcttgaactcctaggttcgcatgaactgccctcctcggcttcccaaagtgctaggattacaggtgtgagctactgtgcccagcctacctcagttttcttaactgcaagatggagagaataacaccctcctcacaagaggacagtaaggccctcaggaggcaatgcccattaacaccacatggacaaacagcggcaggtccagaactaggcggtgcaggcaagcccctcatccacctatccagtaccccaacatcccctgagcttctgccatgggtcaggctgagttcagagctcattcacagggagcagagctctgccagctgtggctaccatgggtgaccaaaacaaccactgcctgaggcccctcccagaggctccaaacatcccatagtccaccgactgacacttgggcctgagggtcccaggtgagaggacccagctgacttggcatccaacttcaggccacgcggctgtcagagagcagcagtcagaagcacaggatccaatcctggcatgcgtgggggcagcatgtgcacttcgttgttgggcagcaacctggcccaaggcaggaccagatcccagcagctgggaccacagacagtgctgtgggaggcactcagcaatggggcttacactgacttgtgtctttgagattcgcgtgcaatgcgcctttgaggccaagccccaggctctgggtagataagcagacagcctgagactcactctcaaggacactctggtcacccagggcccctgagaatagatacgggcatcacaactagacaggagaaaggtcaggaccacaactgtagcacgtgccacaacatcagggacctggccagtggctggcgcagtaagtgcccctggtgcatctgaatgaatatggctgttgcagctttgcccaatctgctgtctcatgaactccatgtccccaggcagggtttccaagcgcctcctaacccttctgcgggagggttctggccatctcccagtaaacacacaattctccaccgccgcctgcagatttggtccactccccagcttggcattcacagcgcctggtctggcctcaacttctcaacctcacctctctccacgctgcagccacaccctctgctcctagagccgctctcatacttctgtactcctcagggcctttgctgttctgagttcctccaccttgaacatcctcccttctaccctgatcctgtcaaaacccaacatccctcaggacctaatatcattccccatcccccgggtgaaaccctttccaggctctcccatgtataccttccgacagcactttcttttttttttggagatggagtcttgctctgtcgcccaggccggagtgcagtagtgcgatctcggctcactgcagcctctgcctcccgggttcaagaaattcttctgcctcagcctcctgagtagctgggactacaggcacacgctgccatgcccggctaattttttgtatttttagtacagagagggtttcaccgtgttgcccaggctggtctcgaacccctgagctcaggtaatccacccaaagtgctgggattacaggcgtgagccaccgtacccggcctagcactttctttttttttttttttttttgagacggagtcttgctctgtcacccaggccggagtgcagtagcgcgaccttcggctcactgcaagctcggcctcccgggttcaagccattctcctgcctcagcctcctgagtagctgggactacaggtgcctgccaccacacccggctaattttttgtatttttagtagagacggggtttcaccatgttagccaggatggtcttgatctcctgacctcgtgatccacccgcctgagacccccaaagtgctgggattacaggtgtgagccaccgtgcccggccagcactttcttttcctgttaatatactgtcatgctgggtgcggtggctcacgcctataatcccagcactttgggagtccgaggcaggaggactgcttgggcccagaagtttgagaccagcctggcaacatggcgaaactgcatctctacaaaaaatacaaaaaattagctgggcatagtggagcatgcctgttgtcccaactacccgggaggctgaggctactggggaggatgaaatgggaggatcacctaagccccaggaggttgaggctgcagtgagctgtgatcgtaccactgtactccagcctaggagacccatctggggcaacacagcaagaccccacctctacataaaatttaaaaattagccaggtgtgctggcactcacctgtaggcccaactacttgggggtctaaggtaggaggatggcttgagcctaggagttcaaggctgcagtgagctaggatcgctccactgcatcctagccggggcgacagacagacatcctatctcaaaaaacaaaccaaaaaaaccccatgagttttgggacagagctgggctcaaaagaggtctctgacaccatgggatgcatgactatggtggagtcaaaactgtctggggctcaggttccttatctgtaaaataaggacaatgacagcaggacttcataaacactaaatgagagactctacataaagccttagctcaggggctggcacttgtacgccgttagctgttacattatccttattactatgttagttaagaagtggctccccgaaccagctgcaacagagtcacttggggaacttacgtgtgcagaacctccagggatagagctcaagaacctgaactttttttttccccctctttttctttttgagagagttttgccctgtcgcccagactggagtgcagtggcacaatcttggttcactgcagcctctgcctcctgggttcaagcgatactggcgcctcaacttcccaagcagctgggattacaggtgtgtgccaccatgcctggctaacatatgtatatattatgtgtgtgtgtgtgtatatatatatataaaatacatgatatataaaaatatatataacataataatatgtagtatacataaatgtatacggtatatataatacatatatataattttttttttgagacgcagtctcaccctgtcgcccaggctagagtgcactggcggatctcggctcattgcaacctctgtctcgcgggttcaagcgtctgtcctgcctcagcctcccgggtagcttggactacaggcgcgcaccaccccacccggctaattttttaaattttttggtggagaccgggtttcatcatgttggccaggctggtctcgaactcctgacctcgtgatccgccgcctcggcctcccagagtgctgggattacaggcgtgagccaccgcgcccagccaaacctgcacttttaaagctaccctaggtgacctgacagtgtggcgcaggtctgttgactggctctacgtgccaacgatatcacacaaacgctccgtgctcggtgtctcggggcctagttcaagtcccaggtcagccacttccctggaaaggccagctttccactggggataacaacagggcagcaacatcgactctgcagcgctgtaaggttccagggcaggggaggcgctcaccagccagactcatgctccaccgctgcccacggctgctcgctcacacgcgggctaggcacagcgcgaccacgtttgcccggcctcttccaggcagacggttttccctggccctgaggccgccggtgccgccgctgccggcctcgattcccccgggtgcaacgcccccagaccatgcttcccgccgggcacgcagggggcgcacggcgcccgccgcccagcccggagctcgccgcccggcccccggcccccggcccgactcggcttcccctccccggtagcgcccgactcggggctcaccatggcagccgctctgcctccggggctcaaactccgacttcctggccccgcggccggggatcaagcgtggtcggcgggtcagaggtcaaggaaagccgcagagagcgcgtgcgcgatacggcgctgggcatgcgcattgcctcagtctaagggcgggccaccgggagcgtcttagcggctcggggcggggtcggaggcggggtttgactgagcctgcgtcgggctctggataactgggggcgggcttgggagggcaaggggcgttaccgggagtctcaattgcccgcgtgcttaccccagtgcgctggagcagctaagcacatcggtcagacgtggggcgatttctgcccttgattttgccaaaatatttgggaatgcaacattatatgaaatcaatgaacataatatggagtaggatgctaaattctcaaaaatactttagaaaatagaaaacttcaaaataggtttcatccacattcctcctgcctgagaagctcgttcccttcttcaaatctttgctcaaatgtcacctcaatgaggcccacctggaccccttaaaacgccgtgacttgccctccatgaatgaaaaaagtaacagctttattgagatataatccatacactgtagatttcatgattttcaagtgcacagtccaatgccttttattcacagagctgtgccactgtcaccactattagttccagaacgttttcatcacccattagtcactccccagccccctcccccagcccctgtcaaccactcatttttctctctatggattcacaggttccggacatttcatagaaatggaatcatacaagccaggcgtggtggctcatgcctgcaatctcaaaactttgggaggccgaggtggatcgcttgaggtcaggaactcaaggccaggctgggcaacatggtgaaaccccatctctacaaatacaaaaattagccgggtgtggtggcaggtgcctgtaatcccagctacttgggaggctgagtggtggatctcttgagcccgggaggtacaggctgcagtgagctgtgatcactgcactccagcctgggtgacagagtcaggccctgcctcaaaaaaaaaaaaaaaaaaaaaaaaggtaaaaatgaaaaatgaaaaaaaagaagaaattgaatcatacaatgtgcagccttttgtgactggcttatcctcccttcttgtctctatttttcttccaagactctgatcaccctctaccataccacataatttacttatttattttatttatcattttgagacagggtctcaccctgtcgcccaggctggagtccagtggcacaatcctgcctcactgcaacctccacctcccaggttcaggcgatgctcatgctttagcctcctgagtagctgggattacaggcatggaccaccatgccccattaatttttgaatttttagtagagacagggtttcaccatgttggccaggctggtcttgaactactggtctcaaatgatccacccgccacagcctcccaaagtgctgggattataggcatgtgacactgtgcccaaccggttttttatttttaaattatttttccttttttttttttttttgagatgaagtcttgctctgtcacccaggctggagagcagtggcccaatcttggctcactgcgatctccacctcctgggttcaagtgatcctcccacttcagcctccgaaagtgctgggattacaggtgtaagccaccgtgcccagccaaaaaaaaatttttttttttcaagatagggtctcactctgttgcccaggctgcagtacagtagcatgatcatggctcactgcagtcttgaccttccagccttgagtgatactttcacctcagctttctgagtagctgggaccacaggcatgtgccaacacatgtggttaatgtttgttttttgtctttttgagagcgtctccctgttgcccagcctggagtgcagtggcatgacctcggctcactgcaacctctgcttcctgggttcaagagattctcttgcctcagcctcctgagtagctgggactacaggcatgggccaccatgtccggctaattttttgtatttttagtaaagacggggtttcaccgtgttagccaggatggtctcgtgctcctgacctcgtgatccgcctgccttggcctcccgaagtgctcggattacaggcgtgagccaccgcgcccagctaatgtttgtattctttgtagagacaagggttcccctatgttgcccagtctgacctcaaactcctgggttcaagcaatcctcccaccttggcctccctttatttttatgtttattgttgagaatctgtttccttccactagaatgggagttccttttgggcaagcatttcctctctcttctctgctgttagatgtcaagcgcctggaagagcatctggcgcacagcattcggcaaatggtgggatgaaagttgggccacctggaatcctactctacaccgctgcccttcttcctcttcctcctggcctccacattcctctctctgtgcccacattgtacttccttgcctcggaagtggctctctccctggctggctcctcatcagccttcaagtcttggctcttagctgaaagtcaccttctcaggccctgaattccctgcctcgctgcatcccagttgcttcctgtcccacaggtttttttgtttgtttgtttgttttttgagactgagtcttgctctgtcacccaggctggagtgcaatggcaggatcttgactcactgcaacctctgactcctgggttcaagcaattctcctccctcagcttcccaagtagcttggattacaggcgcttaccactacacctggctactttttgtatttttagtagagacagcgttttaccatgtgggccaggctggtcttgaactcctggcctcaaacgatcctcccaccttggcctcccaaagtgctagtattataggcatgagccaccgtgcccagccagtttctcttctttactgctgtcttcacactctatatgctcgtgtgcagtctggttcccctgcataaggaggctgtaagaagctgaaggtccttgcaagaccttatctctcctgtcctttatagcatcccgccatccagagcactgccaggaacctgcatggtgagcgaatgactcccagcagtgcgcaggtgattgggccttgggaccagagtgaggctgagataaaggggagcccagggccagacccctgtcacccacattcctgtccccttccctttccagccagcccagagaccacagcagcacaagaggtggccagcttaaaaaagtttaattgctgaaaacatccaaggcaggtgcgggccagtccctgcggggctcacaccccccttattggaccatcagctctgtgatgcccccttctcctggctacaaacctgggaagtagggcagctggtcccagggccctgagactggtgctgctctagaaggcctggtggggggccagcccccaaggcccttgaccagaactggaacagcaggcaagatggggcagcgtggggtgaccaaagatcctggatgaggccaatccaggctgggaccagcccaggtcagcagtgagaccaggggagacagggtgcccagggcctgcccagggacatgctgctgaccccccgccaccctgcacccctggccacatgctagcgggcagctgatgagcagcagctgaccccagagacagcagaggtgaaaacagtccctgggaactgccagaggcccagaggatgtggaagtgcccacgggaaggcaggagtgcaggggtgacatgtgccggggccagagaggtatcttccagcttgaggatgagccgtgaggtgtgcactaggaagtggcagcacaggtgaggtggaggtgacgggggcgcaggctagtcctggggcgaaacaccaagaggtgggagggagtcaggagggcctgggaagggaggaggcatgcaccgtggcatgtgcgagggaccgcgctgcctgccgggaagtgaggccactcactactcacccactcgtcctcgtccacgccttcaaaggagtcctgggggagtgggtcctcccggttccccagttttgccaccatggcattcagcagctgggagagagggcagaagaagggtaggtaagggaataggactccctgttccctctcccactccaagaacaaccctgacaaggctgtgaaaagaactttttttttttttttagacggagtcttgctctgtcgcccaggctggatggagtgcagtggcgcgatctcggctcactgcaagctctgcctcccgggtttacaccactgtcctgcctcagcctcccaaggagctgggattacaggcgcccaccaccatgcccggctaattttttgtatttttagtagagacgggggtttcaccgtgttagccaggatggtctcgatctcctgacctcgtgatccgcccgcctcggcctcccacggtgctgggattacaggcgtgagccacagcgcccggcctttttgtttgtttgtttgttttagagagagacaaggtcttgctctgtcaccaaggctggagtgcagtggtgcaatcatggctcactgcagccttgactttctgggtgcaagcaattctcctgcctcagcctcccaagtagctgggactacaagtgtgtaacaccacacctggttaatttttattttatttatttatttttttgagacagagttttgttcttgttgcctaggctggagtgcaatggcacaatctcggctcaccacaacctctgcctcctgggttcaagcgattctcctgcctcagcctcccaagtagctgggattacaggtatgcgccaccatgcccggctaattttgtgtttttagtagagacgaggtttcatcatgttggtcaggctggtgtcgaactcccaacctcaggtgatccgccctcctcggcctcccaaagtgctgggattacaggcgtgagccaccatgcctggccacacctggttaatttaaaaaatttttttgtagagatggggtttcactggtctcaggctgggtctcaaactccatcacttatatcctcttgctttggtctcccaaagtgctgggattacaggtgtgaaccaccatgcctggccaaaagagccactatattttatttttatttttatttttatttatttatttatttattgagacggagtctcgctctgtcacccaggctggagtacagtggcacgatttcggctcactgcaatctccacctcctgggttcaagtgattctcctgcctcagtctcccgagtagctgggatcacaggcgcccgccaccatgcccggctaaatttttgtattttagtacagacggggtttcaccgtgttgcccagggtggtctcaaactcctgagctcaagcaatccgcctgccttgggctcccaaagtgttaggattacagacatgaaccaccgtgcccggcctcaaaagagccattttaattacagccctgacaaaatcgatgggtttctattgaaaaagacacaaagaagagacagggggagtaagagactgagaggctgcggcatgtggcaccagatacaagggctactatctctgcacatggcctcaagtgctcaaaatatactccaaggtcccaaaagcacttgggcccagaactgccggcttaggctgggtttggcctggccagggcagggctcccactgccctcccccacttcccgggccccatggtcagtggtagggctctggaaggtctccccaccaggctctggtgtgaaggggacgtgacatgtggctgctgtcccagtctgggttggggatggagaactaaggggccgtggccaggtgcagccaggactctgtcacctccgcacagctgctctctcccatgcctacctcctccttcttttgctggtcagacttttcttccaggtactgcgctgaggatggggcccgacgagcaggggcctctcggggggcttggctcactgggacagagcaaggacacgtgtcagagagtccccttcgttagggctctttggtgccaagccctcggggatttctttctttcttttctttctttctttttttttttttttttttgagatggagttttgctcttgttgcccaggctggagtgcaatgatgtgacctaggctgactgcaacctccgcctcctctgggttcaagcgattctcctgcttcagcctctggagtagttgggattgcaggcgcccaccacgccaggctaattttgtatttttagtagagatggggtttcaccatgttggccaggctggtctcaaacccccgacctcaggtgatccactcgcctcagcctcctaaagtgctgggattacaggcatgagccaccgcgcctggccgacctaggggatttctatggcgcagatctaagaggtggtattaacagtcaatggagcctcactgtataagccctgccctagacaccacagtgtgtgcgtgtgtgtgtgtgttaggggtggggacctgtgatgaaaacacagaccacgagccctgccctccactggctcagagactgattgacacagccactccaccctcccaaaggccagaggattctgcgtgccaacaggaatggaacttcaacctgggccttctgtccctttctccaacccccatcccgcttcctccccacacccagtccctcggtgcacctgggctcatgtcaggaggctgcaggctgagaagccagggctgcccattagcgccttgcagccaggcctcggcactgagcacaggctcccagatcacagccgtgtctgggaacacgtcatcctggaagaactctttctgcagagggagaaacgggctgtcctgagacattgaccaggtgcccagggcacacgggcatctgttggggagggacagggcaagacctgggaccctcccaccagcctggggcttccatgagtttcagcatctcagcagaagggggtaggtgtccccatgaacaatgggtagggaagtttggaagctgggtcagacgggacccaaactcccctctaggcaccgagaaggcggtgggcatgggagtcccaggtccccaccctcacccggactcggggcagccggaaggccacaggctccagggaggactgacgcagccgcaggcaccgcatcagctccacttcccgcacgtcgcactccgtcttaggcaggaggacgaggccctgggggagcaagggagtcggagctgccgctgggacctagagctcatggctgggcacgtagtctccccagggtgccggcacccctcacttaggaccaccatgcctagggcctgtccctggacagtaacgtgttgatcatgttgaacaacctgctctctggagggaaagccctgatttgtggtgttttcctatttccacagtttacaaactcccaccatgggcagcttctacgtgccacctccactccctgaatgtggtgttgggaagagatgtaaatagcacatcatcctgcatttcctccatgcactccaacacagaaacatgtgacctcagcacaaataatagtaaaattggataaattaattagaagtgataaactgagtgtttattactttggtttttaatattatttttaggttcatattgtaggttcatatagtttaaccttatctagtgcaattttttgtttgttttgtagagatggggtcttgctatgttgcccaggctggtcttgaactcctgggctcaagcaattctcctgcctcagccttccgaagtgttgggattccaggccaccgtacccggcctacagtatgatttttaataatggttgagtatgacaatggctctcaaaattcctaaataattccagcagcaactcttcttgccagtcactgggcacagccccaggcccagccccagcccaggactctgacccccgacccacaggctcctgtacttgcccacatggccaccagggggcagggcagccttgtggtcccatcggggacgaggcgccagggtggcctcaccttgtgggggtcaggcgacgtgaagctgttgcactccaggaagaaaggggactcggggagcagctcgtacaggaatacacgggtgtcgccctgcggggaagaaggcaggctgggaaccctccggcaacactggccttccccccaccacctctcacctgccatcccgccctccagcccagcccaccttgccggtcaggagcaccaggccagtgtctgggtcgtagctgggcagcagggttgagggagccacgtccaggcccaacactgccaagggtccgccggccagggcctcagcttcatataggagcagctggcgctcactttggctgcaagggggtttgggggctgaagcaggtgtttcagagctgaaggggcctggggcagggagaaggcgcccacgtagcccctgctctgttctgggttgtaggcgaggcctagtgtggcccggcaccgcagccacatcctaacctgcccctccacctctgggttccccattgactctttctcctccactaatcactcacccatccatctacccctgactgcctcaccgcccctgcttccatctcccccagagccccttgtgcacccctgcatctatctccccccaacccctcacccacccctctatccatctccccactacccccaaaacatccctccatctcccctacccccctcaccctcccctgcatccatctcccccttacccccaactcatccatcgatctctccctaccccctcattcatccatccagccatccgcccatctatccccacattcattcatccacccatccatccattcacccacctatccatccacccatctacccactcatccaatcatctacccacccacccaaccatccagtgaggggcaggaatggtttctgaaagcctgacaaatgtatgtgactgtggagaagggggacacaggtggcttctgaagcctggggatggggatgcctgagtcctcacctgtcaaagccagacaccagcagacagcgaccatcacatacccagacaatgcgagctccgcgtcctcccttgggccctgggccttcctgttgagatacatcgcgtgacacccagccagcacccctgaaccaggtctgaggccactccccagcccctgtgtgctcacctgcaggggctcagggccactccggggcctgtagacccgcacacgcccatccttgcagacagtggccagctgctgcccatcaggactccaggccaggctgaagatctgggggcaggaagggatatgagagacagccttgcttcactgctggccccacctctccccactgctcctgcccctcctcactgctggcgccgcccctcctcactgctgttcccgcctctcctcactgctggtcttgcctctcctcactgctggcccccctctcctcactgctggccccccttctcctcaatgctagcccggcccctcctcaccgctggccctgcccctcctcaccactggcccccctctcctcactgctggccccacccctcctcgctgctggtcctgcctctcctcactgctggccccgccactcctcactgctggccccacctctccacactgctggccccgcctctccacactgctggccccacctctgcagccgtcctacctggtcttggtggccctgcagcttcagccgatcagctccagcctgaaggtcccagatgcgaacagtgaggtcataggaggacgaggccagcacattggctgccagtgggtggaagcgcagggagcagatcttctccgtgtggcctggaggaaggcaggggtgatcaggagcccttgggagacactggccaccccagccccattcctgagcctgcctgacctgtgagcacagtctctggcgtggtgagcacctcttccaggccctctgcgggtacccgccacagtcggatcctggcgtcctcaccagctgcagaggacagacaggggctcatcattgctgagcccaagacctctgggctccccagcccctatccgggacccaggaccctccctcaagcccaggcacccagcctccttacccacagcgaggcgatgggggtcaaaggggtcccaggccagatcagtcacagctgccccattctgcagcgtgggcagtgccgtgtcgggcaggcggccaggcttccgtagctgtgggaggtgcccccaccccgaggcccatcagtaccaggcagaaaagccagtccccaggggctgcgggcaagcagcatgtctgggagcccaccctctgcagcagaggctcccaccgctgggtgacccaagctctctgccctgaccaccttgcgctctgagccccaagtgccaaccacaaggccccagagagtgagggggcagcagcgtgaactggcgggaaaagctccggcttagggctcaggtggccgggcttcggatcccagctccaccacttacacagctgtgtgacccgggcaggtcactaaacctctctgtgcctcttctccctcatctgtaaaatggggataaaagtggcaggccccatggcaggtggctgggaggatcacaggacaggcgggcaggagcctgacacaaggtttgtgctccctgtgttgtgtgggtagctaaggccctccgcgtctttgccacaggcagggaactgaggggcagccctggtggggtggggccctcacctcaagcacagccacctgtcccccgctgctgagcagcggcacggccacacgcagcttgttggcacagaagccgtcactctcaccaggtgtggtgaggttgagccccttgaggttggtgatgtggctgtctcggtgcaggacagtgccctgagcatggcggaacttggaactggggcctggcaggtggcagggacatggaaccacgtgtgaggatgccgtccccgcccgccctgcactctttgagtcccggctgcccactcccctcaccccaggtggatgtacagcatggacctaggcccaggcctttgctaatccagtggatgcaactcgcccaggaataatgtctggaatgatataccctgttccatggtggctcggggaatcttggtggagcccagggctttggctgctcagaagctggtggccccagccgccctcctattttgcaggtgagactcagccaccacaccccagcccccaggacaaatgaccctgccagtgagtctgggtgaggggggtgccctgcatgaggcctgtgctcagcagtagggtacacaggaggatgacggggagtggggcagacagggctcctgcggtaggggtgagctccccgtcctgcctccttacccagcaggctctgcagcgacctcaaactggggctggtcccgatgccactggtgctggagagtgagggccccaggctggagggcgtggagggcgaggtcagcgaactgggaggggaagagaaaccctcctggggaggggcatggggtcagccagcctgctcctaggtgtactggccaaaaggagggggtgccagcggactccagggtcaccactctgggccccctgcggactggaggagcccccactgtgggcatgcgacaggagcggcggggggcacgggcataaacgcagacacacagggaagcagccgagcttcagaccgcggggacagcaagtggcagctgctggctcccagccctgcaggagggtgtgcccagtgggttagatctgccagtattttaagagaagccagaaatctagatctgtatgaaaattcttgctttttaagtgtttgcccaatttagaaagcactgtgcaagttccttctttatgctccacgtgtttctctgtctctgttacacttgacaaagaaggttggggccaggcgtggtggctcaaggctgtaatcccagcagtttgggaggccgaggagggcagatcacgaggtcaggagttcaaggccagcatggccaacatggtgaagcctgactctactaaaaaaaatataaaaattggccaggcgcggtggctcacgcctgtaatcccagcactttgggaggcccaggcgggtggatcatgaggttaggagttcaagaccagcctggccaacatggtgaaaacccgtctctactaaagatactaaagataccaattagccaggcgtggtggtgcgcgcctgtaatcccagcactttgggaggcccaggcaggtggatcatgaggttaggagtttaagaccagcctggccaacatggtgaaaacccatctctactaaagatactaaagatacaaattagccaggcgtggtggcgcacgcctgtaatcccagctactcaggaggctcaggcaggagaattgcttgaaactgggaggcggaggttgcagtgagccgagatcgcaccattgcactccagcctagacgacagggcgagactcatctcaaaaacaaaaacaaaaacaaaaattaggccaggtgcagtggctcatgattgtaatcccagcactttgggaggccgaggcgggtggatcacctgaggtcaggagttcgagaccagcctgaccaacatggtgaaaccccatgtctactaaaaatacaaaaattagccaggcatggtggcgggtgcctgtaatctcacctactcgggaggctgaggcaggagaatcacttgaacccaagaggcggagattgcagtgagccgagatcacaccattgtactctagcctgggcaataagagcgaaactctgtctcaaaaaataaattaaaatatagtcggccatggtggcacatgcctgtaatcccagctactcgggaggctgaggcaggagaatcgcttgaacctaggaagaggaggttgcagtgagccgaggttgcgccactgcactctagcttgggtgacagagtgagacactgtctcaaaaaaaaaaaaaggccgttcagccggtgaacactcagggcagccactgcagtgtcgctgagggaggatgggggcggccctggtacttacgcttgcgtctgcatcacccacgggtgtctccatcaccgcaggctgggctgtgtcagggaggggctccgcagggggcaccagacaggaagtgaagctcgggtggggccggcaggcggggttgaggctgaccttctgcacctgcatggaggccggcagtggggagatgggggcatgggctgcccggtcaggagggcccccatgggagggtcaactgggtagggatggggggcacccagcaggccagactgagttggcacacagccacacggggctaccagggactcggggaggctgggagaggtgagccagccctggtcctacctgctggttgtccccagcccaccagctatgggggtcggtggcaggcacacagccggcagtgtccgggaacaggtcctcgtggaactccacagcctggccgcagacaagcaggcagctagtgaggcccaggccccccgactccccagcccccgcagtccctcgcccaagtccccctcaccttgcggggcacatggtagccgatgggcacgatggctgtgtcgctcagctgtaggacgcggagtacctcgcagctcatgacggccagcgcctgccggggcacaagggcagccccacgcagcacgctctccaggacacactgggtcactgttgaggacaccataggggaacaggcaggatgggcaggggaggggagggtaggggatgggggcgaggaagcaaggcttacctgggctcagcgccggctgctgcgggaccacctcgtaacagtacagctgcctctcgccctgaaatgagtctgaactgagccccgtttgctgactgaacccctggggagggcccaggactggcatcagctcccccacaggtccccaaggacctgagccacagaaccacagtggctggagatggggctccccaacatgctgggcgctgagctgagccctaggctgactacctcacttgctcagcctcgttgcacatggggtgagcaccgggggtgtacgtcagtatttatggagtgctgactgtgtgctgacactgctctattctcggccttgttctcaggaaggccagtgttctaggagagctacagtcaccttggctgcacaggggaagacacagaggccctgttcgagttcctcctctctcttggggaaggccaggggctggactccaggctgtggatgtgggtgggagccccagcttctcactcacctttcctgccaggaccaggagcccagagtcagggtccagcagaggcacgagacacctggggaagagagggcaagatggcgggtcagggcagtgggagggctgccagactcgtaaccccatgtaggagcccaggacaggcaccacagtgactgggagccgcttggccatccagccatgttcagcctggtccccaggaaccccctcctcttcctgagcttcccacatgcccaacacacgcccacaccccagctgctcctccccagggcctccacctgcacacctgcgtcactccaggactggagtgggcacaggggaactcgggcccgatctcagccacagctcttcctccaagaagaccccacatgcattctgtgcccctcccaccttcgacagcctagacatcaggccagcattgccagggaaggtggagaggtgaggccggaggcgaggagcctcccgtccccactcggcactgcctgtggacaggcagcatccgggagcagtgcaggcagccctgccgttccgaatctgcactaaggtttggggccctctactcagttaccccacgtttcctgtgcctcagtgatatcttggaagctcagagacccccccatgctgagttaaagttcctgtgtccaaatctgagccacgtgcccgggagaaggggctcctccggccgctgggcttccctgcacaccccaggcctgctgccccggccgagcctgccagcagcatgctcccaggccttctctggtctcgaggcaggagcagggcggggtggcagctgggaatagagtgggcgggccggaagcccccagagcccctgccactctatgtccagctcagccttggccaactgcctgtcactggccgggctttatgcctccctcccggggcccctcagagacccctgcacagcccctcagccctgtgagagctgccttcccactccagggccttttgaggggaatggggacctggaaggactctgacagatgcccagatgcccagttgccttcctgtgtttcttgctcctgatctttgcttttttttttttttttttttttaagagacacggtctccctctgtcacccaggctggagtgcagtggcacaatcattgctcactgcagcctcaacctcctgggctcaagcaatcttcccactcagcctccagagtagctgggactacaggtgtgcaccaccatggctggctatttttacttctatttttgtagaaacaaggtctcactatgcttccgaggccggtctcaaactcctggcctcaagtgatactcccaccttagcctcccaaagtgctaggattataggcatgagccactgcacttggtcttggtttcttgtttctgggacctgcaggcctggaccctcccaacccagacactgacacccttaaacaggaccccgtccccactgtgttgccagggtcagaggtcacccagctgtggcagctgcctctatccctcactgcggtgacaaagggcccagccgccctccactgtccacccatcccctcctgccagccgaccactaagcagtcctgcccacctcccctccccacacttccaggagccacagagtggctgggaagctgggtggggccctgggtgtctccatgacttcctggagtgccttgggctggtcacctgtgagtaacacaggcccctacttactgagggcccagcagggtgagccgggctcagcaatgccctttgcatcccggcctgaccactgcttgtagaggtggaggcggaggcggagggtaggggaccaaggtggtgcgtgacctggagtgccctccacactgacactggctccactggggctggaagcaagtcccttcagcagctttgacagggctttcactcattcattcgttcacaatcattcactcctttgatgagctggtctgtgcctggtcctcggctcgacctgcatgtaggtatgcccagagatgagtgcaacagaccctgcctctgtcctcaaggtgctcacagcctagcacaagaggcagacagacacaatcccatagacaaacatgtgaagggaaggttcaccgaggacacacagtgacagagcagggggactgggcctcagcagtgggggaaggggtgatccctgcgatcccaaggtcatgcagaaatcaaacacctcacaggaagagagtttcagagagaacacaacctgtgcaaaggtcctgtggcaggtgggttcatggcctgtttgaggaacaagatggacaatgtgcctgacagcctggacagtgtgggtgagggctgaggctcaggatgggcaggtggaggctagacgggaaggggcctggtgcatgtggggagggggagttctgcctccagtggacgagcaatgaaaaggtgacggtgcgtttcaagcaaaagaggctaggccaggcctagtgactcatgtctgtgatcccagccagcactttgggaggctgaggtgggagaatcacttgagcccagtaggtcaacactgtgaccagcctgggcaacatcatgagaccatggctcttcaaaaaattaaaaattaaaaaattagcgaggtatgctggctcacgcctgtaatcccagcactttgggaggccgaggtgggtggatcactggaggtcagcagtttgagaccagccaggccaacatgatgaaaccctgtctctactaaaaatacaaaaattggccaagtgtggtggtgtgcatctgtaatcccagctaattgggaggctgaggcaggagaaccacttgaacccggcaggtggagtttgcagtgagccgagatggcaccaatgcattccagcctgggtgacagagtgagactccatctcaaaaaataaaattaaaaattagcctgctgtggtagtgcacacctgtggtccagctactcggctggctgaggcaggagggtcacttgagcccaggagtttgaggctgcagtgagtcaagatcgcatcgccagctgggcatggtggctcacatctgtaatcccagcactttgggaggccgatcactttgggtcaggagtttgagaccagcctggccaacatggtgaaaactcgtctctactaaaaatgcaaaaatgagctgagcatggtggcgtgcacctggaatcccagctactcaggaggctgaggcaggagaatcacttgaacccgggaggcggaggttgcagtgggccaagattgcaccactgcattccagccttggcaacagagtgagactccatctcaaaaaaaaaaaaaaaaaaaatcacatcagcctgggtaacacagcaagaccctatctcaaaaaaataaaaatagaaagaggataggaccagactggcacagagtagggatcacactggctgctgggggcacaggctgggaggagtggaaacaggtgccaggacagaagctgagggcaagtaggataggcaggtctcctgtggcccctctgctgcccttatgagaggtgggaaacaggcctggggccacctcatggcatcagaggctcacctgtgcgctgagccaactgcctgaggaggcctggtgctcagcctccctcacccccgttccatcgtcccagccagccagccactgactcaggagctgaggccgagtgggcaggaagtcagggagggcagggctggctcctctgacaggtcaggccagtcttccttgcctcaggcagagccatctggacaactctgccaggcaggggcatcctgtctgccgtggcacgggccaagaaatggggtcatggcacccagccccaaaggttggccaagtgttggcatgggcctgaccccaggctgtgtgaagagagccaagctgggtctgggtctggaacatggtacatgagccccagccaggcagagggccagaggtggtaagaggtattgccggcacctctcctgctggaatctgggcctgccactgggaagggctctgaccctgacccaggtccaggggtctgtcccaggcataaagttatagaaggtctaaagcccagatctgcccccgcccctcagccaggtcccaggagctagaagacaacctcagtaccaactgggaggcacgagcagtttcagcctccggataagccccgccagctctcccaggactcctgtgattagcaccgaggggaagcaccaagggtgtgcttgctacaaggagcagctgcaaggctcctcctctgtcctcccctccagcccatccctcccgctcaggccccttcccaccaacccagacattctgccattgcgccagttcaaagcaggctgggtcccttggatctgtccctatcacccaggctggagagttagttaggatcctttgacccccctccacccccacagcccctagctcccccgctgtgtgcagactgctggtaaccaggttctaaaggcgggtggcaccttgaaaccatacaaggcaatgttggataaactgagaggggtctcctaaaagcttcccttgagcctctgggtaagtggggacctgtgtaaggccagggcacaggattggggcagggggtgaacaccaggcagatggggtctctccgtctacaagaacctgccacagaggtgagaagcttcaaggacatcaggaggtcctgttccttgaggaaagccaggctggaggctcttggagccctctttacccctgaccctgggcatctgtggatgcttctgagggcttcagaggacacagggccaagggaagaggcagggaaacagtccgacaagaggctgcacagcactgattggaaactcagatggttctggggccgggcaggaaactcaagtgagtggacagcttggcaggaggcagcagggagtggtggggactggggtgacccatgagcccacattttggcagagggagcaaccgccactcagccccagctgagagttcctgttcaatgcaagctgggaagccccattttaatatgaaaccacctgatttttcaatgttagcagtgccttcaaagttgtaaaaactcccataaagcctgcactaaatgcacccaaaggccagccccaacccaggaacagaggtccgcaagccatgccctaatccatgtagaccgagaaacgtatgggttgtggagccctgccagccctggaaaggggccctgtggggagagggccctgtggacgggaggtccagaaggtgactgtcccagccaggccctgcttagcccttgacggctagacacagaggccatcctgccttctggagataactgagtcctccagagactaggaaaccctccagctggtgtggcccagcctcccagggataagccttcaggccccccaaagactagagctagcccagccaagggccttggctacaggccgggctggagggggtgtgggtgtcccaaggctctccggaagtcaggagctgagctgggcccccaaaggctctgaggcatgactgaccacaaacgcggagggggaggagggcagagtgttttcctggaatcctccaaggcaggggatttttctggactagtccggcccctggcacccgcccctcctgcccaatcaagggccactgtcaactgcagcccaggccccacccaccgacggtgaccacccctatgcctccacagctcaggcttgaagctgccagtaactgtggggccgtgggcagaccaccactgccctccctgacacagccccttcatctcataatatggtggggaagagagtccagggctgctcacaactcttaaggctgtcgtggctaagaggaccctgagctcagatttggcattggagtttatacttaggaggctcttgaaagggctttgtgtgggctgccaggagttttttgaaattgggattagctaccaacaataacacattgagagatttcacctaaaaatctggatttccagtttctcttcaaaaatccaaagctctagctggcccgggctggtcatgaggactcagcccttaccagccccactcccgccatcctgcctctccagggccgcagaggccctggggtggacttctggcatttgtcacctgcctggtgcctcataggcatctgggctgtgacgcttaggattcctaaatagtctctcgctttttacacaaaaagcagaaacctgcccagtgtcatccggcaaacccacgacgggcaaggtctccccgcgcaggtcaggtggccgcagggtgagggccagggcaacccggcccacgagcccctcggtggggaaggggcgtgtctccacgcggctccgccccggccaatggggagaggccccgcccctgccgcggcgggcccgccccccgggactcttaaggcgcgacctgcctccagcgagccgactccggagcccgagcccggggcgggtggacgcggactcgaacgcagttgcttcgggacccaggaccccctcgggcccgacccgccaggaaagactgaggccgcggcctgccccgcccggctccctgcgccgccgccgcctcccggtgagtttctgtggggctggggggctgcgggcggggaagggggcgccacggccaggctgtgcacacgcgcggggaccgccgccgcgcgcacacacgcactctcgggcgggaccgcggccccagccccacacggtcacctgggccgcccggcgggcaggccctgtacgctccctcccccgccgtcctggggcgccgacagccccgcggccggccagggtgcgcgcctgagtgtgcggtgagcccgcgaggctgcaagcagacaaaataaacaccccgtcccatgcttcctcctcccacggctgggcctccggcatgaccagttttatgaatcaaacccctttgagggggatagccaagccacaggcttgggtcacttttccctcctggggtccggcagtaggtgctgctgtgcagaagggctgcccggggtcctctggacccttgtcactcaaagcacagctgggggctacagatatgcagccctagggaggggcggggagtggctggtgggcgtccgatgcccatccctccaggtgggggatggacctgtactggccagggcccttagagcttcgggtatcaggcagggtgccgggtctctgcctctgccagggaaggggctttgcttgggctgcaaacccagtggcctggagccagcctagtcctttgtgtccctgggctggcagtgctggggcctgaggactgctgaggtcccctgtggtcactggcaggccagccgattggtgccaaccattctgcctctcccccattcgttaacgattgccacaccagggtcactgaccgcctcccctgctgtggcccaggggtggagtgtgcagggtggaaggaagaggtcctgggggtctaggtgtccccatgcctgccttttgcaccaaggacaggtgaggctctggagagaggcagcgggacctagagcccccttccccaggctgagagcctccagggctggggattggataaaatctccaaggtcccttcacactagactgtactttgggtgttgagggcatagaggggtggccgggctgggaccttccaagcagggtccattagggccagtccagggggcagcaaagtccaggatgggcccagctattgacaaaaacccaacagagctggggcaggcgggtgggggatggggagcagtcccctgagtttactctcttctcccaggggagttggcctggagcttctgtaaacagagtgtcagaggcaggaagaggctctggtgatgagcagcccagctggatcccctccagaccattatctagcctcccctgggcctggggagggaggatgcgcacacacatgccagcctgggggccgggcactgcctgtccccaccccgcccctgtctcctgcacgttggaacagctgtcctgctacctgtgggtccggagggtcagatggggatggggctgggggctggggtcccagggcatttgtccagatggcacctctctctccatattctgggaatgggagaatgggattcagcataaggagcctctcagacactgcccagacctgtgcttacccgaggaaggcccctctggcacgcagcccaggggccagggagatggcaagggagatgccccgggcaggagatgggtccgcggctcctagctcccattactgtcacccccactgacagccccgggggagctgggacaagtcccaagtacagaaaattaagtccttgcctgggcttataagtgggtcccaacacaacactgggcagcctctgggaacaagaaagcagggccctgctgagcccaggagggagctcccacctcagcaggccagacagccagtcctgccagtgagcagaggtgtgtagaggggaggctgcccacagggatggctatccctgaccactggccagccctgagctcatgggagggcagcaaggccacctaactctgttagtgacctctcctggaccccccatcagctgcccttagagtcccctccctgggctggggagcccaaggctctgtgctgccaagaaaaccagctcccctcactgctgtggaatttgcgtgagttcttggagaagggggagggtgcacgtgtgtgtgtgtgtgtgtgtctgcaggagcactgcccagtgggcgtgtgtctggcgtgggcgtgtctgtgtgcgcgtgactggagcagggctgtgtatttgggggtgggtgggggtgtttgggggagcctgcttgcaccaggaggggcagggcctcagcctccttccttttatcggtttccacattccagagtcagccggatcgctttccctccgcgctgggccgccggcctcccccgcttttcctcattccagcctccctgggtgtgaggaggctggaggaggctccctcaggccacctcggttttgggcagggggtgggggcaggcgaggggccagttattcttcagggttcgggacggcccccaccagactcttcgtggggaatgcaataaggttctgacattcctcaggggctgcctgagagatttaattaaggagggaggagggagccggcctacaccgggaaggggctggggcggccgctggggcccctgctggccctgggccccgagcccggctgggcattgagagcagtgcgggggcagggttgtggttcagtggccaggtcctgttctgcctccctgaatccatcccgcctgcccattgatcagctcacagaccccaggggcgccatttctgccacgggttggccaagaaccctgggtgattgtggggggttcggcatggggagcttgagaagggcaagaccccttccagggccacttccttctcagacccccaggcccaggaagcttagggctggcggccttccttggtgactaaggtgttcttctggcaagttcagggttaattgcaggttagggccttactagatgggtgcttgcccctgggtggggacagggcagtgaggaggccccgtgtgagggcccagccctggtggcatcacacctgccgcgtgccgaaagtggcatctggactggcccatttctagttgggctgcagccactgcacagctcccagggccacaggtgtcctccctgacaggttgcacctcttgtgactacgatggcacgtcccaccgccccaggggctcacttgagctggggcctggccttagtcactggtctccctgccctgggctaacaggtctggcagctgccaagtcacccacggtgctactgaaggcacccacctggggccgggccagcctcctgggtggagggaggagggaagaccctgtgcctgcccctctcccagccctgccagctggtccacacctgctccaggatacagagcctcctccctgcacaggaagacgagctgacatcctgactgtcccctttgcaaccctctgtcctggtgttctgaaccctggctgtgcggaggactcgctcaaggagcttctccaaaatacagctctgcctgggtctcactcctagacattctttttgtttttgagatggagtattgctctgtcacccaggctggagtgcagtggcgcaatattggctcactgcaagctccgcctcccaggttcacaccattctcctgcctcagcctcccaagtagctgggactacaggcgcctgccaccaggcctggctaatttttttgtatttttagtagagacggggtttcaccatgttagccaggatggtctcgatctcctgacctcgtgatcgtcctacctcggcctcccaaagtactgggattacaggcgtgagccaccatgcccggcagaatttcttgtttaattggcctgggggtggggccccagcatggaggttttttttagaaagcttcctggatgattctgatgtgcagcccggcgggcaaagccctggcgtcacaggtgggagacggaagcccagagaggggagcttgcttggatgaggtcacaaagcgtgtgagtgcctgactgagctcctggctgtggcattatctgtggaatgaagagcgccagcttggggtggtggatggagtaagaaagaggctgacacccatggggacccccgctcaatcaccagccaggggtccccgcgcctatagggagggtctacctgccgcagtccctgaggaactcgaggcccagccctctctgccccttctgtgagggcccacgacccctgacctctctgccctgcccttgggactgctgtgtcccaaggaaggggagacggggcggacccagccgggccctgagcctcctcggacacgtcagcgaaactggagccagccgtcctggccgccggcacagtcccgcctgcctggaggggttggcagactcccggggctgggctgctgccaggcctgaccggccacacagagccttggcgggccagcatgaggagcgggggcccggagtctcagggtcagacctgcagcgcctgtcctgcacccacgctgaagcatacggcacaggaggggcgtactggcctcagactgtctatctgtctgtccaagcctgtcccctactcagcaggcacaccgcctgccccagaatcagtgagatgttctcgccaggggctgatgtggtcaccagatgcctgggtcccaccccagccatgctatcccctggcccgtccccgcctgaccctgggcgtgtgtggtgtaccccagaggtgggtgggcgtccccctgggagttgagatgacgagtgccttgtcctccttactcatagggcccctccctgaagtcctgtgctgaaggggccgccaagggacagctcacccaccacgtgcccccttccagaaccagagataccccacccccgctccccagcccccagggtgaagggcagccttggtgtggggatgtctgatctgtgtaaagctggcctgaaaccctctcccttagtagtacccacgcccagggggcaggcagagttctgcgtttatgagtgacgccctccgcagtgaatgtttaccgaccacttggcaagtgctccgagcacagaccaagtcaccccagacacaggcaccacgagcaccacgagcagcgcccactgcacaatgggggctgaggtaggggtcgtggccgggctgtggaccctgtcgccctatgccagttactgtgccagggagggagcaaggccggcagcagcactcagcaaggctgaggaacttgggtggaggacggaggccccagacccttgcgtcatcttcccaccccccgacgtccccgaatcccaggaatcccagggctgcctccggaacacctcctgcaccaggcagaggaaaaggtctcacctccctgcctgactagtgatcaaatatcaaagcccaggtcctgggatcaccgggtgggagggtgggtgggcggcggcaaccaccgtgtgacctgtagacagcccccagccccacgcacacaccaagcacacgcccagaccccaggcgggcgggacagctcccagaacttgttaaaagaacttccccatttgaaaacaaacagaacaacagaaaactacaactccagagggtgagggggcagggctgcttgcaccaactccagaggtgagaaactgaggcccacagttgagaaaggaactctggcctctgtcccctgccaccgtcccctccacagtcagccttccctcgctgggttcctctcggggctggctgatgggttctcagtgccaggagtccctggcggtgccctcagagctgccagcctgtagcttacaaactctggggttttccaaagctccagcgctgcctcctccctcctccctttgatgtgggggtagaattggggctcaggcaaaagagctcaccgcacattttacggggctgggaagcaggctggctgccgcctgctggatggtcagcccaggaccccagcccacagtcctgacctagacccctgtcctgctaacaggaacgcacattccacagctcactacctgtcagccggaaagccaccctgtggccagatggacccacagcatcccctctcccttcacaaccttgctgattaaagacccaacagattacggagcccagagctatggctggtccccctccccagtgcagggtgaagagcaccccccagcacgtgcccctaagagctggcctgcacacctggccttgcagggctgaggactccacatgcatcccccactgcagccctgaagtgtcccagatactcagatgaagaaaccgaggtgtgagagcaaagtcactgtctgcggcctcacagcttggacacctctgagcacagggccgcctgcctggagtgagcgctcttaactgtgaccttaaacgaggcccaaggggagctgcggccacagtggtggccaggctggccaggctggccacgtggaggatcccctcccactctggaacctggctgcatccttcctgaccctggtctggccctgctgggagggctaattcaggcagaggtggcctcaccccccatatggacatggggtgggtgggggtcactcacagcccacatctggaggccaggccgcacccgccgtcctctgagtcagtgagggtggagcgggtcccatgggggaagagaaggctaggggtgtggccccagggccttaggtcatcagacacgagcccccctggggtgggctggccgggccagggacgcgtgcctggggtttggggtgctaacttcttccagtgctcagtgccaggccctcctgggctgttcactcagcagacctgagctaagtgggcctggagacacctatggcaaaggcaggctgggtctcaccttagggaggtgagggggcacacgacagcaagggggacaccgctaggttggggaggcttagcctgctggcctctgaagggtgcttgttgtcgctaactggctaggggctcagggtcggtagctcctaggggagacgactctggcagtgcgatactacacgtgggcagggcctgcgtgggcccaaccccggggacaagggcttcttccttcacctcgagctacccgcagaccccagtggtcacctcaccagtgacttgtctaatctgtcctgggaccacctgctcctcctcacattccaggaacccacgtacctgggggagagggagccctatggacgggtccccccagcctggggcggagtgcaggctgggtcggggtcgtgttccctggactacctgcacagcctgtgtgggggaaggggaagcccggactccagcacaaagggctcttgtgtgagctgcaggcgccactgggcaggatgcttcctggggatgggctggcaccccgtatgaggctcagggacttctaggggtgccaaagtggggagggctcttcctggggacggccccagcggtctccccaggagtctaggtgatgggggccagccacagacctgcctgacttgggcagtgcagctaagatctggagcctggagcggctggtgggagcccccgcccccagggccatctggagggcacgcacccttcacaggtggctgctgcacacctgggctctagctcggacttgctggcaccgcaatggcagcgagtccctgcacctccatgagccctgctttcttctgtctgccctgacgtggctgctggggggctacctgaggtgacggtaaacacttagtgttccttcgtccttcccacttcgctggcacatgggaaggacttgcaccatcactgccaaggggatggctgctgctcatctttcttggtgcccagctcagggcagaccccaagaaacagtagacgaagccgggcacggtggctcatgcctgtaatcccagcacttttggaggctgaggcgggcagatcacctgaggtcaggagttccagaccaacctgaccaacatggtgaaaccctgtctctactaaaaaaaaaaaaaaaaaaaatacaaaaattagccatgcatggtggctggcacctgtagtcccagctacatgggaggctgaggcaggagaattgcttgaacctgggaggcagaggttgcagtgagccgagatctcgccactgcactccagcttgggtgacagagcaagactccgtctcaaaaaaaaaaaaaaaaaagtagatgaatgactctgcagagttttcccaggcctggcactgcccctggggctgccatgtagccagtgtccccacctgagccctgtggccccccagctccagctctgtcaccagcctcagctccccgcctccctccctcacaggggacacctgccaatgcctgtggcctctgcccctcctccaggaaccttcccgccggccacttcctggcggcccgcagcccccagcctaagcaggtctgactgcccaagtggaaaaacatggatcccatagtttccatgtgaagtcttcccgctgcattccctcctccaaggagggcgggacacggagcgtggcagcaggagccggcggccaaggcagccagcttctctgcttacacacccacccagctgcctgcctgccccctcttccagaccctgtagggaggagctgccgctccaagtcccaccattctctccttcctggtccatctctgaggcaggggatgggggaacctacctaggcagaggcaggagggcctggggttcaggaggaagcagtgcatggtcactgcacgttcagtggatgtcatgccccatgatgacctctgtgtgcattgacaaggtcacacagtgagggagtgacggggctgggacagaacctgggtcggggcactggcgacctgactcataaccattgggttctcttgcatttgggggcagaagcagtgaattccctctggctcttcctggcgtgtctgccttctaggcccctgactcacagtcttctgtctctgcctcctctctgctcccagggacagaagatgtgctccagggtccctctgctgctgccgctgctcctgctactggccctggggcctggggtgcagggctgcccatccggctgccagtgcagccagccacagacagtcttctgcactgcccgccaggggaccacggtgccccgagacgtgccacccgacacggtggggctgtacgtctttgagaacggcatcaccatgctcgacgcaggcagctttgccggcctgccgggcctgcagctcctggacctgtcacagaaccagatcgccagcctgcccagcggggtcttccagccactcgccaacctcagcaacctggacctgacagccaacaggctgcatgaaatcaccaatgagaccttccgtggcctgcggcgcctcgagcgcctctacctgggcaagaaccgcatccgccacatccagcctggtgccttcgacacgctcgaccgcctcctggagctcaagctgcaggacaacgagctgcgggcactgcccccgctgcgcctgccccgcctgctgctgctggacctcagccacaacagcctcctggccctggagcccggcatcctggacactgccaacgtggaggcgctgcggctggctggtctggggctgcagcagctggacgaggggctcttcagccgcttgcgcaacctccacgacctggatgtgtccgacaaccagctggagcgagtgccacctgtgatccgaggcctccggggcctgacgcgcctgcggctggccggcaacacccgcattgcccagctgcggcccgaggacctggccggcctggctgccctgcaggagctggatgtgagcaacctaagcctgcaggccctgcctggcgacctctcgggcctcttcccccgcctgcggctgctggcagctgcccgcaaccccttcaactgcgtgtgccccctgagctggtttggcccctgggtgcgcgagagccacgtcacactggccagccctgaggagacgcgctgccacttcccgcccaagaacgctggccggctgctcctggagcttgactacgccgactttggctgcccagccaccaccaccacagccacagtgcccaccacgaggcccgtggtgcgggagcccacagccttgtcttctagcttggctcctacctggcttagccccacagagccggccactgaggcccccagcccgccctccactgccccaccgactgtagggcctgtcccccagccccaggactgcccaccgtccacctgcctcaatgggggcacatgccacctggggacacggcaccacctggcgtgcttgtgccccgaaggcttcacgggcctgtactgtgagagccagatggggcaggggacacggcccagccctacaccagtcacgccgaggccaccacggtccctgaccctgggcatcgagccggtgagccccacctccctgcgcgtggggctgcagcgctacctccaggggagctccgtgcagctcaggagcctccgtctcacctatcgcaacctatcgggccctgataagcggctggtgacgctgcgactgcctgcctcgctcgctgagtacacggtcacccagctgcggcccaacgccacttactccgtctgtgtcatgcctttggggcccgggcgggtgccggagggcgaggaggcctgcggggaggcccatacacccccagccgtccactccaaccacgccccagtcacccaggcccgcgagggcaacctgccgctcctcattgcgcccgccctggccgcggtgctcctggccgcgctggctgcggtgggggcagcctactgtgtgcggcgggggcgggccatggcagcagcggctcaggacaaagggcaggtggggccaggggctgggcccctggaactggagggagtgaaggtccccttggagccaggcccgaaggcaacagagggcggtggagaggccctgcccagcgggtctgagtgtgaggtgccactcatgggcttcccagggcctggcctccagtcacccctccacgcaaagccctacatctaagccagagagagacagggcagctggggccgggctctcagccagtgagatggccagccccctcctgctgccacaccacgtaagttctcagtcccaacctcggggatgtgtgcagacagggctgtgtgaccacagctgggccctgttccctctggacctcggtctcctcatctgtgagatgctgtggcccagctgacgagccctaacgtccccagaaccgagtgcctatgaggacagtgtccgccctgccctccgcaacgtgcagtccctgggcacggcgggccctgccatgtgctggtaacgcatgcctgggccctgctgggctctcccactccaggcggaccctgggggccagtgaaggaagctcccggaaagagcagagggagagcgggtaggcggctgtgtgactctagtcttggccccaggaagcgaaggaacaaaagaaactggaaaggaagatgctttaggaacatgttttgcttttttaaaatatatatatatttataagagatcctttcccatttattctgggaagatgtttttcaaactcagagacaaggactttggtttttgtaagacaaacgatgatatgaaggccttttgtaagaaaaaataaaagatgaagtgtgtttcttgggctcagccccagggtagaagggctgggtggagggagatgaagaaggagtggccctcgctctggggagccagggcccctcagcagcccctgggcttgggcagccctcccaggtgtcctgacctgggtgccatccaccctaggcttgaatgaggtgaggctgggcccaggtgggagcagggctgcctctggcctcggacaagaacgggtcagggagcctcaccttccccaggccctgtcttctgccagcaggggctctggcccatgtgcggctgggagaggcttgtggcacatgtggggccaggtgagtcccttgtgggttggtctgatgggcagttcactgcctgctttcctccagggacagggccctgggctctctcattccaggcctcatggatggtcccgggagcaagtggcctccgggaccttctctacagcgtcccgggagagccaagcggtttgcatggccccagccccatgccactccactgcccaccatgggcgcagcaggaaatcctgctccctgcctcctgcccctggctacagcgagggctctggtgggaggggaagtgtgaatcatcaaaggcagggaccccatgggtggggagaaaggggccgagccccagtgagcaggacaagctgggggacaggaacaaagggcccaggttggcttgcagacggtgccaggattggtggccttgggatgccccctcagcccctgcattagggatgtgcccaggctttctggaaaccctagaagtgggagcattttccaggaaggctgcatgctgaggtgggggcagtgatgctgagtgcagctgtggcctggactgggtgcagggggcttggggacagtgatggacacacagcaccttttcctgttaccctcagtgggatggaggggaggggacccactgggctgccgctgcaggggcacccagaacatgctggagtgagcctcctgcagaccccatgccactgtcccacaggtcatggccccggcccccagcactcaggctcacccctggtgggacagagtcagcccagccagacccagggagcaggccccgtggcgcgggtgttgatgtcagtgccgagtcaggcccagccacgcgaggctctggattcaattagcggctgctgagggctctggcacgaggagggaggaggcgggccgtgggtcatggcgggcagtgggtggtggcagtgggcctgggtggggccccttcttcctgaggcagcggcggcagcccaggtggatttcctgtaggcctgggtcccattaggggagtggctgcggccaggcctgcctcccccggcccgtggctgcatcgtcaaaggggcctttgtgggcctgaggctgctgctgaacacggcggctgctgaagaaatgttttcactgcaaagcaaacctggccgagtgggatggtggcagggggcagtggcgggggggtggcagggcccaaaaaaaggaagccttccctggaacagtgtctggagtgtgccatcagatcagggcttcggggaaggggagaacccagccagggggcgaccaagctgagatgcagcctcgacccgggacaagccccccgactctaggccagggaccaggggcagacgtgggggtgtgcgagcccccatcaccaggtgctgactgcagcaggccctgggccatgtgggtgacacatgctcttgtttcatgcccggcgacctcgtctattgaaaaggagtggccacagggagggaagacaacatgctcacagtaagtggagacaggaccccagcacctgctccccagccacgggtggggctgccggccacgcgggagggcttagggccactgtgagctacagaagcaatacaccctacttctatgggggtagggggtgatacagttcacccagccccctcacaggcattcacacactcatccccgctcaattcacacccagaagcgtggcacccaagacaggtgtatctctgcatctccaagaccaaagcatgagctgttccttcagtgcaggctgccagtccctctcgttatccccccacctccaccctgcgccaagcatggtaccaagcacacaaagtgctgggcagccctccgtggaggctgcctgagcacagacaggaccttggtgttcgaggctggcctggctcccagcccctgctcctctcactgtggctggcttccccttagatactccacaaatgtcaggggaagggcataggtgggaccacagcggaggcccctgggtgaggatgaggaggggacggggtgtgtgcacgaaccctggcctcctctagctctcataagggcacacactgttctgcccaagccaagatggaaaatctgtaaaacagaagaactcgagggtggtggagtggatgcagttgccaacctccccattagccgtgcccacagatgacactccagactttccatgctcagcctagatttgctcagaggccccggcaccccagggagttagtggggggctccagcttccaggacgcctgggggtgcaggggacctgccacctctcagaacagctggggggctggcacacatccttggcatccaccagcttcatgggggctggcagagcaggggccagggctcgggggcagaggggagaggaccctagcctggccacccatctgggagtgatttgagaaattccagtcctcactggtccttcgaggctattcttaactgtggtaattacagggtcagccttggccagtggcaccgtgaggtctgggcatcattaactcctccagaggccacactggggccgggcaggagacgctttcaggggatggggaccctgtcactgggggcagagcctggaaggcaggaagtggtgggtggaagtgactggtgccaggtcccttcacacaaatgcctccactgggggccctgcagggaaggggctgtctgacctagaaaggtctagaagacaagatgccaggcagctccgggcctgggatgggggacatggggccagatcctagacgtggagtctgaaggcccgggagctccgactcctcaaggcggggcgggtcccactgactcctccctgaatctccaatgcccagagcaggcaggaggctgagggcagccctgactctgcctcttaccctccatatggcttcagggaaggtgccgaatcttgctcacctttgcctccctcatctgtaaaatgggccttgccagcttctcagcccctccctgggtgtgacagggtgggaaagggcgtcactgtcaccctgacccctacccctcctctgggcggctctcagcccggggaagcccttggcaggagctctcgctggtactcaggtgggagctcttctggggactccccggaagatcccgcagccttccttacccccagacacatacccttgctgctcccagagcctggacaggtcactgttgcctgtgactcagtttcctcagttatgcaatggaagaatgaataagcttgccaagtaccacccctttcctggctctgacattctcggatccccctgcctgtgaagattccagcaaggcccttataagtcacggttgaagtttcagaaggcggatggagtccctgtctctccaccccggccctgcctggctacgtctctgaacaccccccccagcctcagtctccccagctgtgttgtgggtggtctgaacagatgagtcactcataaatgcttgccctgggcctcctggtgtctggctcctgagccgcagtgggccaaggccatctcggcacacagctgactgtgcctggccaggaccccgccaggcactgccaaaagccctctccacacacttctgggggcagatggaaggatgaggtgcacctggagccccccaggctgcctgggcaccagccccacctggggacatacctcaggatagaacaggacagccatgtggctggtgtggagtaggccgcataaacctcagtgggccgcataagccaaggcccacctccacctccacctccacctccacccccacccccaccctgccaggctgtccaacaatgcccacgtccaccctcctatcatagcctggagcctccctgggcctcagccctgccagaacatccacagaaaaatgaagcgtattcttgcacttctggatcacaccctctccctgaatgccaagcatacctgtgtcaacccccagccatgaaacctctggtgaccaagggcccactctgctaccaggggccagaggggcacctgagcacctgctgctcgtgacatctggaagctccgggggtacagggccaggtgtctgttgcaaggccttgcagcccagatcaggtaccccagaacaccccggagatcagcccgcctcactgacaggccggatcaggtgccctcacctgcggcgccttgggtcatcagccccccagcccacctgcgtgccgcagctcctacccaagcgaggtgtccaaggtgagggaggccagggcgctggagaagaaccgcgtgtcccacagcttcacttcgcgctcacgcatctgcagggagggcgagagaggggctcagaggggcctgtccctcagccccacccggggggctcccagggaaaccagcgcctgagggtgcagcctgacacggggcacctgccccagagcagggcttggagtgggggtgggagtcaccccagggaaagagaatctgggttttcatgttctgcccctttaagaacccttaggtgacaaaggatgaggggcggttccctctgtgttctcgggtccctgtagggccactatggctcctggggtcaggctgagctattacaaatggaatctgccagttttcagcagccgtcagtcccctgaggctctgagacccggcagcacagccaggccgtatatggacaggcctggaactggccctcagtcccccgcctcccattggtttcgtccccgcccaaagggctggacatgtccccacctggccgtgccctgctcctccaggaggaaccccctacctggttgaatccagtagacacaaggtgctcccaggtgcccatccatgccagccggctatccctgctgttctcatgggcctgcgtgctctgcaggaggcaagaggtggacctgagcccccagggccctgctggtgggcggggccccctggaatgggcctgagctggggaacttctgctgcccacctgcctgaaagcctcacagagggtgggaagggctgggtccttctccacgtccccactgggaccaagggtggtctccgaagcaccccggggatcagccccgcctccgccccagttgagggcagctctgcacccagaggccaacctggctgctcctcccgagtgtccctcctaccaaggagagggctgcctcactccccagctccaggccccttccctgctgcgccaggggctaaaggcactggcactttcttgcccctaagagctgtgtgatcctggggatgtcacactctgtcaatgcctcatttctctcgcttgtgtaaggggctcacgatgcggtgccacccgcttcccagggctgtcaccatgtggaagggcagggcttgtggcaaagcaccgtgtaaactgggggatttcgaggatcactgtggctgccccaggcaagaggcagggcctgggacccacctctgggcaacgtccagagagcgccaagtagtgcctctcctggccctcccgaggtgctggagctgccagcaggaaggctcccggcccctgggaggagagggaagctcacatggtgggtggggccctgtcctcctgggccctggcagtggggagctgagggggccagaggaaatgcaaacagctcctcccagtcaccctggcccctggagcctgagacgaaggaccctgttaccaaaaatagctcaccccaaaccatggccagcttcctccgaacttcccacgatctccttgggaatgaatgagggagggaagcagcctgcgaggagctggcctggggccccctccccagcccgtggaggctgactccagcgtgggagaccatcggaaacggctccaggtcccgtccttcgaggggcttttctcactgttcccttcccaccaggctgtggccggcacaggaagttggggctggagcctgagaaccaaggccccactgccctctctccacgtaagaggggatatcgggtcaggacaagggtcgagccattggccagccctgccctcaacacccggagagggtcacagtgtcattcaggctcctgccctctcgttggtgtttgttgtgcaaatatctgcgtgtgtgcagcccaccaggtggctcttagcttgtccaaaagtcactcattcattcaagaaacacacaaggcctcccaggggccagaactgtgctaggagctggcagtggggccggatggttctcagatagagggcaggtgctggggggaagcagtgcccctcactcatctgttctctcgtcatatgggtatttgagccacacactattcgagatgacatggtgaataaaatggggaaagtccctgtgcccgtggaataaacacatcggggaggtagatgtaggccaaagagaaatcagtgtgtcattccctgtgactatgcatgccatgggggagccgcacggtgttaggggaggaagctctggaggtggacccaggagagccccagcctggccacctcccttggtgggtcagtcactagctctgtgcctcagtttccatgtctgtaaaaagcactgtaacagaatttactttttttttttaacctttcctatggtgctgaaggacctacttttgaagacggccacaaggagtaagagggaacacttgtagaaggctcaggattgtgtctgacacgtgtcaagtgtgcatgtctcacagctgatagcagggtaccgccagactgtaagtgagggaagacctagcgtcattcctgctaggctgggagggttgataggcgtgagccaggtatgggaactggcatctgcaaagagttggaaactggaagcagagagacccgctcagccagcaggtggggacgagggaggcggaggctgggccaagcctgcagggtcccccaggggctgccactgagcacttttcacctaggggcacaggctaaggctaggggtgggacgcccttggcctgtagctcccaccttcctaattcacatgtgggaagcctaaaggcacagagagacgaagccatggtgcaaagtggcttggccccagctgtctcctccacctgcacaagatggacgtgaggctcagagtggtgatgaggcttgcacaaagtcgcagctaggaggcagcagggaagggaggaggagccgcccaggaccacagctgccccagaaacgctctgcttccagcaaacatcctgggccagctcttgctccctggagcattcagcccagccttcagaggtccaggtaagagctttgtccgtgcccagccactccccaatgtgggtacacccagctcagtttgcccagagaccacaggaagcccccaggtgagggagggggtcagtggcccaccccttaccctgtaactcctcatcaatggagtgatcaccagtatcaaaaatgagaggtgggctgggcgcaatggtacctgccgtaatcccaacactttgggaggctgtggtgggaggacggcttgagcccaggagttccagagcagcctgggccacaaactgaaaacttctctcttaaaaaaacaaacactaggccggcacagtggctcacacctgtaatcttggcattttgggaggccgaggcgggtggatcacctgaggtcaggagttcaagaccagcctggccaacatggtgaaaccccatctctaccaaaaatacaaaaattagctgggcatggtggcaggcgcctgtaatcccagctactcgggaggctgaggcgggagaatcgcttgaacctgggaggtggagctcgcagtgagccgagactgtgcccctgtgctccagcctgggtgacagagcaagactctatctcaaaaaacaaacaaacaaacaacccaactagcttgacgtggtggtgcgtgcctgtagtcccagctaccagggaggctgacgcaggaggattgcttgagcccaggaggtcaaagctacagtgagccgtgttggcgccactgcactcccgcctgggcgacagagcgagacccgtttgccagcctcagcaagcctcagagaagagccgtctccccagctcctcattctcctgcatagggggcaagaacaggggctgcagctgggacccaggcatcctgctaccctgcagccccaagagggcccccaccacctagctctgagaataggaggggctgtggcagggcaggagcagtgtcagccccgcagggggtgcaggaggggaggcgcgtgcccgccccttcatcaccatggcgacacttcctgtgcagggcaggatggttccaggagcagccctggctccttgctggggtgaggggacctgcttcaatagtaagaccccccacttacccccttccctcctctgaggttcaccaccccccactggcctgtctgatgcactgagattcctagagggctcaatccggggccccctcccgcccagacaagggttctgaggcctcgacactcatttggggctgccactttcccagaacagcctgggctccagggcctcacccagccccagctgggccggttgtaaagggaaggggcggcagtgggggtcctgggggttctgcatccagaggggcgagcctgcctctgtcaccctgaggtgggaccatggagaagccacagaaccatccgactctcggggtctgcacctccgaggaagtggaatatgccaagtgcctggcgcataacaaagggtcatacatgcagtataagaaccaagcatgggtgtgaggaggagcctccccagggtcccctgctcaaagctcacgcctgaggcagggctccaacaagacagtggagggcggactccctggcccactctgggctccgggatagcaccagggctcaggtggggtgggacccacagaggacagaggttggatggagggcaggcggccccgctccctgacccccagccacaccccactaggcaggaaggaggattgccagagaaggagctcccagaaggcctctccctcgagccggcccctcggctcacaccggccctggctgccagcagcggttttcctaatagaagccaggtgtgggccagatgccctgggcggaagtggggggcagggccacacggagagcggcattccaggcctgctgcccccgcaccagggcccgagcacaggccccagccagcagctggaaggggtgggagccacccacgctcttcccaggtctcctcgccccaaagccccgcaggggggctccctccagaaccagatcctctccctctctcttcgaggagctgggagccccttggatagcagccactctatccccacctcggcatcagtcaccgccccagccctgctggaagaggaggggagaggaggaggaaggctggaaagagggggcggaggaggggagaataggaagaatcacgtgggcccagtgagctggctcagagccatgcccggtaggtcgggggcagaagcataggtgccccagcagtgccctgggctctggagaggagagtgcaacctgagaaagtgaagggggccgggggaagcctctgtggcaccttcaagctgagcctgggccccgctttctgggcaaaggcttggaggtcaaagaaagctacctagtgaggataccgtacacacccacactgccttgagatgcagacagccaccatctaccaggcccaggtcccacatgacgaagaggtcagccagcctcaccagcaagtacgaccagggtgtggccaaaaccaccctgcctggctagtttcactgcttaaatgggagtcctctcggtcttcagctggacaaaagtggaactgactgtaccgtttggactaaaaagctgcaatcttccatgtgactgggtttctctcctgagtcttgtgtgtgtagggggctctggggctccgggctaccactagtttggtttgggctggtggtttgcccttgaccccgggtggggaaaacgtcctagaaatggggagggggtatctatgatgggcctaggtctttgctggggagctcctctcctgagctaacagtaggaccctaaacttcaccttcctcagggaataagcctcctcagcttctagaaagttctttttagaaatgtaaatccatggccaggagcggtagctcacgtctgtaatcccagcactttggcaggccgaggagggtggatcacaaggtcaggagttcgagaccagcctgaccaacatggtgaaaccccgtctccactaaaaatacaaaaaaattagccgggcatggtggcgggcacctgtagttccagctacacaggaggctgaggcagtaaaatcacttgagcctaggaggcggagtttccagcgagccgagattgcgccactgccctccagcctgggtgaaagagcaagactccatctccccacccaaaaaaagaaatgtaaatctactcatcgcacttcctgcttaaaactccctaatggtggccggacacggtggctcaggcctgtaatcccagcactttaggaggccaaggcgggaggatcacgaggtcaggagatcgagaccatcctggctaacatggtgaaacccagtctctactaaaaatacaaaaacaaaaatagccgggcgtggtggcggtcgcctgtagtcccagctactcgggaggctgaggtgagagaatggtgtgaacccaggaggcggaacttgcagtgagccgagatcacaacgctacactccagcctgggcgacagagcgagactccgtctcaaaaaaaaaaaaaaaaaaactctctaatggcttcccacagcccaggtaaccatgggcccgtatcccccagcgcccctcgcgcagacccctcagacaagcccgtcctccttcaggccatctatgtctgcccccttggcattactcaggcctctgctcccgggccagttactcagggaagcactaaaccagcccagcaagagaagcccccagcaactacctgcctagcacaggcaatgtttacggagccagacacagggccctgtcccagggttgttgctcctgcctacaaggtctctgtagggcaaatgaacggtgtcccagtggctggatgcctgcagcatgagccaggtcccagcttccccgcttggaactgaaatggccacgcacactccatgcacagacacaaaccagaacacgctcagtccctggaccctgtacgttttgacaggtcccacccagggtcttcctgcagaggacaggggttgtttctttttggctcctctgcagctggtctctgctgaccgtgccagggtgaaggtctcaaaggaaggaagtgggaatcccagatcgctgcctgaagccacacgatggcctccgtggagagcctgggggaagcttagcttctgccacccggtgatcaaagccaggccctcccaggacccacaacacacttcacaggaagagctcccagcagtggtggtccacctcctggggacccctggtgctgcagaacatgtctgccaggaccccaggcctgcccctacctccacctgctagaaccactgggtcctcagcctcagtggaggcttcaacccaccccagcttgcccacacaactcacctgagaggcccgcggctttgttctggggtcaaagatccgcagctgcttgtcctggaaaagcagagaggaggaaacaacttgcgattagggctggagggtccctggaagccagcctgctcccctcacctcccaacccccagctctgagcagcccatccccagcacgcagggctgccatcacacaccagggcatccctcctcagccctgttcctcctcctcagcacagcagcaaccaccacccagtcccccaggtttctgtgaggagtgttcagctgcctgagacctactcagtgaggagtgttcagcttcctgagacctgctccacgtcaggcatcccagacactcgacccctcctactcttccaactaccctatgaagtggtactatcaccatgatccctcacagacagacaaacggaggtccagaaccaaactctaggctgtcagcgccccacacatgctcagccctgtactaggcccagcctggagaggctcatatgacgacctcatttctgcacttacagaatttagcactaaccaggaagacgagcttacacttccgaaccatccattcggcagttattgattcagattatccaaagggaggatggaaacagacaaaaagcagaaaaaaatgtactgaaataaagcactcatgctttgtatagaccttctttctgtggaacaatgtgtgtgtgcatgcacacgttgtgtgtgtgtgtgtacacaaacattcatgcataaagaaccagggcacaatctgtatccactactacaggctgggccataataattttttttttcttttttgagacagagttttgctctgtcacccatgctggagtgcaatggtgcaatcttggctcactgcaacctctgcctccctggttcaagcgattctcctgccttagcctcccgagtagctgggattacaggcgcccaccaccacatctggctaatttttgtatttttggtagagacggggtttcaccatgttggcaggccggtctcaaactcctgacctcaggtgatccgcccgcctcggcctcccaaaatgctgggattacaggcgtaagccaccatgtttggccataataaattaagtgcaaaaaggaagttgtagaataacatggcatagtgtgattctactgtggtaaaaatcaacaaaaatctccatttgtgtgaccacgatcctgtttgtttttattgatacccaactatcatacagcccatacattttacaagtttgctgagcaaggagaaaggtctggactaacacaggcctgtgtgctaatgctaggtatcaagggtggggaagatgggggctggttaacttttcctttttacgtcttagcacaggtctattttgtttcattcagcacagattcctgttttcatattttgaaaaacagtaaacaactggaatttgaaatgaaaaacaccaccagccaggcatggtggctcacgcctgtaatcccagcactttgcgaggctgaggtgggtggatcacctgaggtcaggagtttgagactagtctggtcaacatggtgaaaccccgtttctactgaaaataaaaaaattagccgggcatggtggcaggcacctgtaatcccagctactcagggggcggaggcaggagaatcgtttgaacctgggagacagtggttgcagtgagctgagattgcaccactgcactccagcctgggcaacagagtgagactcaatctcaaaaaaaaaaaaaaagaaagaaagaaagaaaaacaacatcatttgcaccagtacagataaaaaaaacttgaaatactcatgctcctcaacatacaatggagttacatcccaataaacccgtcttaaattgaaaatatagtaagtatggccaggagaggtggttcatgctggtaatcccagcactcagggaggctgaagcggcagatcacttgaggtcaggagttcgagaccagtctggccaataaggtgaaacctcgtctctaccaaaaatacaaaaattaaccgggcatggtggcacgcacctgtaatcccagctactcgggaggctgagtcaggagaatcacttgaacctgggagacggaggttgcaatgagcttgcagtgaaccgagatcgtgccactacactccagcctgggaaacagactgagactccgtctaaaaaaaaaacaaaaaagctgccgtaggccaggcacagtgggtcctgcctgtaatcccaacactttgggaggccaaagtggaagaatcacttgagccccggaatttgagaccagcctgagcaatacggcaaagtccatcaatggacatttctctctttttgtatttgtttttgtttttgagatggagtttcattcttgtcacccaggctggagtgcagtggcgcgatctcggctcactgcaacctctgcctcccgggttcaagcgattctcctgcctcagcctcccgagtagctgggattacaggtgcacgccaccacgccaggctaattttttgtatttttactagagtcggggttttgccatgttggacaggctggtgtcgaattcctgacctcaggtaatctgcctgccttggcctcccaaagtgctgggattacaggtgtgagtcactgtgcctagccttttttgtttgtttgtttttgagacagagtctcgctctgttgcccaggcccaagcgcagcagtgcaatcacagctcactgcaaatcaacctcctggactaaagcaatcctcccacctcagcttcccaagtatgtgggaccacaggcacaagccaccaggccctgctaatgttttaatatttctttcgtagagatgaggtctcactatcttgagcaggctggttttgaactcctggcctcgagtaatccttctgcctcagcctcccaaagtgctgggattacaggtgtgagccaccaggcctggtttgaatatacattttaaaaatatatatatagaaatggccaaaaagcgtatgaaaatatgttcaatatcactaaccattagagaaacacaaatccaaaccacagtaagatatcccctgacacccattaggatgcctattacatttttaaaaatagcaagtatcaggccgggcgcggtggctcacgcctgtaatcccagcactttgcgaagccaaggctggggggaatcacttgcggtaaggagctcgagacgagcctggccaacatggtgaaaccccgtctctactaaaaatacaaaaattagccgggcgtggtggcgtgcacctgtaataccagctactcgggaggctgaggaaggagaattgcttgaactcaggaggtggaggttgcagtgaaccgagatcatgccattgcactccagcctgggcaacagagcaagactccatctgaaaaaaaaaaaaaaaattgcaaggctgggcgtggtggctcacacctgtaatcccagcacttggggaggccaaggcgggcggatcacaaggtcaggagttcaagaccagtgtggccaacatagtgaaactccgtctctactaaaaatacaaaaattagctgggtttggtggtgtgagactgtgttcccagctactggggaggctgaggcaggagaatcgcatgaacccaggaggcgggggttgcagtgagctgagatggcaccattgcactccagcccaggtgacagtgcgagactccgtctcaaaaaaaaaaaaaaaacaaaaccaactgttggtgggtacgtgaagttagaacccttgcacactgttgatgggattgtaaaatggtgcaactgctatggaaaacagtatggcagttcctcaaaaaattaaaaatagacctagcatgtcttccagcaaccccacttctgggtacatatccaaaagaactgaaagcaggccatgaagagatatttgcacacccatgttcatagcagcactactcgcaatagccaagaagtggaaacaacccaagatctactgatggataaatggataaacaaaatgtggtctgcgcatactatgcagtcttcaaaggcaaggaaatcctactgcacgccacgagtaacccttgacgatgcagcatttcattatgctcagagaaataagtcagccccaaaagagcaaatagtatatgattccacttatgtggggcatctaaagtagtcaaattatagacacagaaaattatagacacagaaagtggaatgccaattcctaggggccgggaggtagggcaaaggggaactgctgtttaatgggtatagagtttcagttctgcaagatgagaaaattctcaaatctgtttcacaacagtgtaaatatacttaacactactgaactgtacacttaaaaatggttaagatggtgaattttggcactttgggaggtcaaggcgggaggatcatttgagcccaggagtttgagaccagcctaggcaacacagtgagatccctgtcgctacagaaaatttaaaaagtagctgggcgtggtggcacgtgctagtagtcccagctactcaggagtctgaggtgggaggactgcttgagccttagagtttgaggctgcagcaagctaaaaaaaaaagaagaaggtaaattttatgatatgtgttttcttaccacaatttaaaaaaatagctattagcccacaaaaatacattgctaagttaaagaagccaatctgaaaagctacatactacataccatataattccaactatatgacattctggaaaagtccaacatacagacaatgaaaagatcagtgcttggcagtgatctgggaggagggcggaagggatgaacaggtggaacccaggggatgttaagagcagtgaaactactccgtatagtggttacattatgtcatgcatttatcacaacccatagaacatacaacacagactgacccctcatgtaaactgtgagctttagttaataataatgtatcaggctgggtatggtggctcaggcctataatcccagcacttcgggaggctgaggtgggtggatcacttgaggtcagaagtttgagaccagcctggtcaacaaggtgaaaccccatctctaaaaatacaaaaaaattaggccaggcatggtggctcacacctgtaatcccagcactttgggaggccgaggtgggtggatcacctgatgtcaggagttcgagatcagcctgaccaacatggagaaaccccgtctctactaaaaatacaaaattagctgggtgtggtggcacatgcctgtaatcccagctactcgggacggggaggcaggagaatcacttgaatctgggaggcagaggttgcggtgagctgagatcgtgccattgcgctccagcctgggcaacaagagtgagactctgtctcaaaaacaaaaacaaaaacaaaaacaaaaaaacaaaaagtagccgggtgtggtggcacgtgcctgtagtcctaactacacaggaggctgaggcatgagaatcacttgaacccagaaggcggagattgcagtgagctgagatcgtgccaatgcactccagcagtgcaataataataataataataataataataataataatgtttaccattggttcctcaattgaaacaacgtaccacactcacgcaggatattcatcacagacactgggggaggaggtaaggaatatggaaaatccttatacaacttgctcactttttctgtaaacttaaaactgttctcgaaaatagtccatcaactaaaacaacccaaaaagaaatgcaggggaaaaccaagtgaattcccgctccatgtgcagcccctccctgagagatgagtagcctccctgctactaccaagttccaggctaagtgctggactctggggcctggaggttgtcacgggaaaccgcggggaagaacttagacctggtcatggaaggacaaacagagcttgtgctgggaaggcaaaggcattcgaggaaggtaaaatagcatgagcaaagaggtggagaaaggaacttgctggtgtgtggcgttgggggaggagaggccacgtgaggaggcagatggtgggaaccaagggggccgtgggcacacgcatggctggcagaggcgggggcctgtctggagagggcctcaaaagccaggtctccctggtctgcctcagcagggccctggttttatgccgctcctggcaaagccctgccagctgcagtttaccaagcacctgctgcgtgccaggcgggcaccaggtacagtccagggactggctcttaaaactccactactccacacctcggattcagagggatggcgagggacagagagaggaggatgagagacagaagacagagaccagagagagaacagcgagggacagcaagggatgagagaggacagagtgggacagaaacagagcacaatgacagagcgggccagagagagcaagtagagatcaaggacagatacaggggacagcaggagacaggcaggacacgagcgacagcaagcgacagaggctctcaggagatgaagggcaggacacgacatccagcagtcagggctgctcctgccccacagaggtgcagagaccgacagcccgagtccagatgccaacaccaccactgaccagctatgacgtgggcaagcccccgagccccctatggtttctttttttcctttttttttttttttgaggttttagtttgtttgtttgtttgttttgagacagagtcttgctctgtcgcccaggctggagtgcaatggtgtgatctcggctcaccgcaacctccacctcccaggttcaagttattctcttgccacagcctcccaagtagctgggattacaggtgcatgccaacatgcctggctaatttttgtatttttagtagaggaggggtttcactatgttggccaggctggtcttgagctccttacctcaggtgatccgcctgcttggcctcccaaagtgctgggattacaggcgtgagccactgcacccggccagttttgttgttgttgttgttgttgttgttttttaagagagagggtcttgctccatcgcccaggctggagtgaagtggctcaatccgagctcacttcagcctcgaactcctgggctcaagcaatcttcctgcctcagcctgggaccacaggcgcgtgccaccatgcctgtctaatgtttgcattttttttgtagacatggggtttcaccatgttgcccgggctgatcttgaactcctgggctcaagtgatcctcccacctcgtcctcccaaagtgctgggatgacaggcgtgagccagcgaccggccacccgcccagccctgtgaactgtgaggatgcggacagcgccacccctgggcagggctgggcgctggggctaagggcggaactcacagcacacactccatgagggcagctgggccaccctcatggaggagcttaacgcggggtccaaaccagggttcagagtgggcactgaggctgctctggctcagcggagaggaactgggctgcagaggccgcgtcctccccggctcatcaggctcaaccatgccgggagtcaggagcgcagcaggccggaatgggccatccgtgaggagagcgcgccccctagcggcctcctgccccttctctcccagctcgggaggccccttcacccagtgggagtagctgagagggagcaggagggggctttggtggtcctgggaggcagacctgctcacacagaggcaggacaggagtggaagccaggggcacggaggcttccccgccaggaaggagatggggcgggggtgggggcacactctggtggaaagtcccatgaccccccacccccatccccatcaggcagcccgtggcatgagcagctccagtgcataaacccagagccaggtgcggctgcaaagaggggctcacgctcgctcctggtgtggggtgggcccatccagcagctccagccacagctcaggacaagccctcgctctctgcacactcatgggcatcactggctgccctaccacagtcaggccgccccccactcccggctccatactgccagggtttccagtgtaggatgcccccaccaggaccccgatgtactccctttacagcaaaagaaggtggcagccgacccagggctgaggtacccattggccctagactgtgctgacaggtgcggcttggaggcaatgctgcgtccccgcaggcggaattcctaggtccaggaaccagggaaggagggggagtcgttccactaagcatcactcccacgacccacttaggaaatgtgtgcttctcgtccctgcaactttaagctctgggtttagcgggggaaaacacatccactggggaagcagcaggagctcctccgtctgtgactcctatgactcttcctgcaagacaccagtaagcaaggagaagagtggccaagccggtggcccatggggctgctcactgtccttccctacacaactgtgatagtaaatagggctcggacccccaggaggagggcctggaccaccacacctgtgacagaggggcagagacagtttctcaaagaaagatgtcacggtcccaaggcagccatccctgagtcctgctgagactacccaggccatcccctctgcctgggacgcccgtcccctccttctcagccagggctcatccctcaaggaccggcctcgagctcactctgcctgggaagccgtccccagcagggttaggtcaaagcacgcataccaggtctccccagaaggggctccctgggggccttattggcccccagagcttaggccagtctctcaggactctctgctcaacgcacaccacagaggaaaaactgatcaagactgggagatgcggcttccacaaaagcagagtacagaaaagaaagttagactagggtccctccaagtatgcagagccctggggcggaatgctcaggtctggtaggcctccctgccctgctagctcctgttcggctccattcccaggcctctcagccattcttcatgtgtcttcaggctcggcacacctccagaagggccctgatgggtgccctcattcccagcaaccccgacaggtcttcagagacccttggtggtacccacggccgcctccctggggaagccctttggccctggtttcaggctccagcctggtcctggctttcctcctcccacctcctcccctgcaggctcttctcatcccctcctgggggcagcactatgtggtcagcaaatcaaacaaacgggaccttttcacctgcagccggattctgctcagagcccctctgggcccagactccactgacacctccaggtaccgccggcagctcagcaaggctgcagccaccctggagcggctctgcctagaacattcacaccaggtgctcctctagcgccccctctctgccacagcacatccccgtcccagtgacaggcctctcctactgcctcaggaccgccacgcctcccacccaatccttctccaacacttggcttcctcctcccaaaggtctccgccactcccggcagagaacagctctcacctccccgcaggctgccacgcatccccctgtagacactgcccctcctgccacacactgtccatgtggttccaaatgcgaatccgctcccctcactgcaccacctgccctactctggcctttaacacttcattgccttcccattacccctacggcaacaggcacaacccttactcaccacccagcacccgcctgccccgcacctgcctgtcctggccccgatccctgcctgaggccacgcgtccctggcctgtccaaccagctcaaagcaccatgtccctcttgcagagcccaggtcacgggtcctcttgtctgtactgtcctcgacggaagtcacctccccagcaactggggcctggcccagcacctgcggccgaatgctgcttaacaagagtcttgcagaaaggctggcggttcagacagaccagacaggcggccagaggaggctgcctgagggtggcgacattagggcgcaaaccagggaccagcgtgggctctcatctgacaggggcctaggcaaggtaggggcttccagatgtaggtgagcgggggtgtgaggagcagctagggggcagggcacacagatgaccatcctgacctcagtgctccactgcctcctaaacaacaagcctggaaggcccagcccagggggtcccagcccaggaggcctgcacagagccccacagggcatccccacctgcctgctcaccttgcacgccgtgcccaccagggctccatctcggctccagacggcgctctgcaccaggtccccatgggctgccagctctgcagagaagcagtcacagtcaggtcccgggcagtgagggcaccagggaagtgggtgggggcgggccttgctggggggaactcccagagcaaaggcagcagctacgagggtccttttcagccaagggggcaagggcagcagcttctcccagacaggcttcccctgcaccacaggctgcttccttcaccccacctttgtgcagccgtacatcactcaactaccttccgaggcttcccgctcctggcctggctctctcatccctcccaggctcacttccaacatagctccccaccaacagggtcactcctgccctaagcctctattcctgccatctatactctccctcgctagtgtgaggtcttaaaatacttctctacattctctgcaactcctgttccaggttaaattgtgctcccctaaaaagatggtgaagtcctaacccccactacttttcggaggcttgctctgtcacccaggctggagtgcagtggtgcaatctcagctcactgcaatctccgcctcctgggttccagcaattctcctgcctcggcttcccaggtagctgggattataggcacctgccaccatgcccagctaatttttgtatttttagcagggacggaatttcaccatgttggccaggctggtctcgaactcctaacctcaagtgatccgcccacctcggcctcccaaagtgctgggatcacaggcatgagccaccgtgcccggcctattattattttttgagacagcatctcactctgttgcccaggctggaatgcagtggtgtgatcatagctaactgcagctttcacctcctgggttcaagtaatcctcccacctcagcctcttgagtacctgggacacagacaggcacacgccaccacgcctggctgattttttaattttttgtagagattgtgtctcactatgttgctcagactaattctcaaaatattgggctcaagcgatcctcccattttggcatcccaaagtgctgggattacaggtgtgcgccacgacgcccatccaagaaggtttttttttggtttttttgttttttgttttttgttttgagatggagtcttgctcttgtcccccagggtggagtgcaatggcacgatctctcttcgctctccatagccactgcaacctctgcctcctgggttcaggcaattctcctgcctcagcctcctgagtagctgggattacaggcacccgccaccacacccagctaagtttttgtatttttagtagagacgcggtttcactatgttggccaggctagtctcgaactcctgacctcgtgatccacccgccttggcctcccaaagtgctgggattacaggcgtgagccaccgcgcccggccaaagttattttttatttttatttttttgagacggcatctcactctgtcacccaggctggagcgcagtggtgcaatctcggctcactgcaacctctgcctcctgggttggagcaatactcttgccgcagccttctgagtagctgggattacaggtgtgtgccaccacgcccggctaatttttgtatatttagtagagacggggttttgccatgttggccaggctggtcttgaactcctgacctcaggtgatccacctacctcggcctcccagagtgttgggattacaggcatgagccaccgcgcccggccattatttttttaaatggagaaaaacaacagaaaaaaaaaaaaacaggtaagaggatgaaactgatggctacggagagcaaagagagatggggtgtttattacagcctcatagaatcttaagacttttatactatgtaagtgtaaaactttgatatctgtttttaaatttatgtgactaaacatgccaacaaagaaacggagtgctgtccagagtggggctgccctgggaagggcaggccagggtggcctgtacctgtcaggggctgctgcttggctgcgtcccagaccttcacagtggtgcctgctgcgctcaccagaatgccgtcagaggtggggtggaactgcagtacctccactgggaggtcctcggggcccagcaccaccccgggtgctgagggcagggcctggccaggccctggcagtcgccagagttttacctgcaagaaagaccaagtccgtgagcacagggctgagggcctcactgccttgagtcagctgccgtgaccccagtgaggtcccgtgttggaactaggctgctccaggagaccacacaccttggccttgggaggagcgcccacccgcctcagcttgcttgggccaggggctgcataccccacatccgagaaaggagggagggaatctcagctcctagaccacacggtgtggtcccagagttggggaagtggctctactgtttctggcagcatccccacctgctgtcctcgggctccaggtcaggtcagagccacggctccaagcaagcccttgggagccagtgtgggaccaggaattcagaccagccccgcagccctggggagtggggtggggctggactgggaggcagcagagccctgtggggatggcgctggggctcagaaggccctggactacgggctgggacatagagcagctcttccaactggctccactcaccgtcctgtcagccgagcctgtggccaggaggaagtcatcaaagggcgagaagtccaagtcggtgactaggtctgtgggagaggaatggctgaacccaccggaatgtcctgtttccaacccagtatgaagcaaagcccagggcttccgaggtgacacttttgtgtgcacacagaaacaggctacaagtctacaagggccctctggacaccatgggggcaaatgccacaggcccctcctgcgacatacgtccccgagggccctgctgacccagggtggccaagggctctggcatcaggaggttggcaggaaatgggcaggaagccgcttgagtcaccaggcacctgcaggaacgcagctgcccagcccgacccctcctagggcagcacagcccactgctccttcagtcgtggaaggtccccaggactcaactaagaaattgctttttggttaagcaagccggagttggctttagttctttgcaaccaaagaacctgaatggtggccgggcatggtggctcatgcctgtaataccaatactttgggaagccaaggtgggcagatcacttgggctcaagagttcaagaccagcctgggcaacacggtgaaaccccgtctctacaaaaaatataaaaattagttgggtgtggtggcgggcgcctatagtcccagctactcaggaggctgaggcaggagaattgcttgaactcaggaggcagaagttggagtgagcagagatcacaccactgcattccagcctgggcagcagagccagaccttgtctcaaaaattaaatactaagaacttgaacggctcagctccagaggtggggaggggtaggtggggtgcacagagtgagccagaccccagagggaaatgcggtgggtggttggggaggtagagactaggcatggagggtggcggggtttcggggtgtgaacaggacgagaggtatcaccagagctgggagcacagcgaccacctgctgctgtctgcctcccaacagggctgagcaggactgtcttcctcccggcctcaggagacagggaaaagataggacggacgtgcacaggcacatcttgggatagccctggcctggaatcccagctggcaggaccacaacattcctgggcctaaagccacagaacccctgctgccctcactctggggtgtgcttgctgggccctgcagggcaaagcaggtccctgggcaggtgtagcagctggcacaggcgggctggcatctcaggcgtgaatgagatgtgatgacataagcaatctgagtgctcagcatgtgctggcaccacagatgcccaggggttgacacgcagggacctcactgaatcctcataaggatgcagcaggtggcactgcagcagcatcccctactggaggatgaggacgccaaaacccagagagggtgagtaactgccccaagtcacgcggctaagagacagggccagcttcagaacctgtgctgctcagcatgacatgctgctgccttttcccactggagcgggccccagctgccgccccacagcctggacatcagaaacgcacccagaagttgctcaccctctgctcccctggctgctgggcggaagggcaagagtggccctgagctgagaggctgaaggggcctctgaaggcagggcaacagccagagccccacctggccatttctcccgacaccggcacctctgaggcagaagggcacctggtgcctctagggcaggttccaggggtgctggagctcaccttcccatgagcagtttcccggcagggctgctcatgcaggcaaggctctgaacagttgcagccacagtgaggctatggacttgcctacaggaccctggtccagcttctacttgaagagccctagtagcagagggctcaccaccttgcaagcatcaccaacttgggctagctccctcatagataaaaagcatcaaaaagtcaaacatgaagccaggtacattggctcatgcctataatctcagcactttgggaggccaaggtgggaagatcacttgaggctaggagttcaggaccagcctgggcaacacagcaaaaccccatctccacaaaacataaaaaaatcagctgggcatggtggtgtgtgcctatagtcccagctactagggaggctgaggatagacgatcccttgagcccaggagttcaagactgcagtgaactatgattgcaccaccacactccagcctggatgacagagacagagaccctgtctctaaaaagacaaacccaaacacaggctcctatagacctgggttctgattctggccctgccataacaatgggtaagttcctaaccttgcaggagtctcagttttcatagctataaaatgggttgttttaaaacctacttcaaagagatctgagattagatgagaacagacttgttatacaagctgccacacacatgtatctctaaaacaacatgctacgtgaaagatgccagattccaaagaccgtgtattgtgcgattccatttgcgtgagatgcgcaaaagaggcccctctatagaggagaggccagtaaacgtctcctgcgaagggcaaggcggtaaatattctaggatttcagggctcaacagtctcggtcacaactcaactctgcagttgttgcaagaaagcaaccacagactatacatcaatgaatgggcgtggcagcgttccaataaaactatttacaaaaacaggcagccagctggatctggccgtgacagtagtttgcagacctctgccacagaggcaggaagcagatcagctgttgcctgaggctgtggtattggaggtggaaatggattaactgcaaaggggcatgcgggatcttttggggatgatggaaacgttccaaaactggatggcagtgcacatgactcggtcactttaataagaatcatcaggctctttacttaaaacaggtaatctgacggggccccaaaactttgggaggccaaggcgggaggatagctcgaggccaggagttcaagaccaggctgggcaacataacaagaccccattttacaaaaaatttttaaaaattagctggaggggtggtggcataaacctgtggtcctgacaacttgggaggctgaggtggaagaattgcttgagcccaggaggtcaaggctacagtgagccatgattatgccactgcactccagcctgagtgacagagcaagaccctgtcacaaaaacaaacaaaaaacaggtaacgttggctgggcctggtggatcacacctgtaatgccagtactttgggaggttgacttgggaggattgcttgagcccagaagtttgagaccagcccgggcaatatagcaagacctcgtctctatatactttttaaaaattttttaaaaaagtttagatgagaaaactcagctaacgtacttagtacagagagcaatctccataaatctttactattgttattaaccaccatcattatcatatcagaacccctccacgaccctgcacacccagcctgaggaccaggcatcaactgccttccctcacccgaaggcctccaaacaagcagccagaaatgcaggccagagagactgggcccgcggccgctgcagctggacagtgagaggcgaggccagctgggctgctctgcctccatctgaggcgagcaaactgttccctcgaggcggacagcctgccaggcaggctgctggacgcccccagaagcagctgcggcacacaaaaggtctctttgtgagggcccatctccacccctgcagcccaacacagcgacctccttggagggccccgagcggctgggctggggaggatgcctggtggagaggggactccagcagaagacggagggctcagagccatccaacgtggagtcctcggcagggacagggagccagcatcagcctggagcctggggcggccactgcacaccccgctccatccagctcacaaccggagcacacagcttccctcctcactgcccaggccggaattctacaccaggaggaagccttctgagccccactgtctctcagagagtgcacagacagggcgacaggagggacctggcaagccatgcggcagtgggaccaggtgaggatgaatttctggccctggagagggaggtgcaagtttcaggcttcacccactagtcagacacccactcacctgaatggcagcccaggtgggccacgcgtcgcttgtcctctccttggccttgcagaggcacaatgcccagtacacctgttaaacaaacacggggactctgacttcaggccccacagggccacccacctccttgcccagggatcccagagatgaaatccagcagctcagcctcggaccttcccagagcctctaccaatcacaagatcatatcctctgcacgtagcaatggcctgtgggtaggttctggccccatgcatgagccatccatgcctcagatggatacagaagacattaggcgagaggtcctctctttttaacacgggtcatacgaaaggggcgtggggctttcgtatggggcttgcagctaccgtcagccacttttcgcacttttacttgagaaagaagccaacacccaaggtggcagagctgagagacccagagaggtcagggccgacagtacatgtgagcctttgggcaccgatctgcctgaagcccctgatctcttagttaggctgaaacattatccattttttgcttaagccagcttgagggtctgagttaccactagcaatcaagagagtgccaaccaacacacgggcttttcaagcctttctgttcctactgtccccagccatccagggcccaaagatgaggagcagggagcacagagggacagctggaaatacaagcgtcagtcccctcccagccctcctggccatgctcttgcctgtggtttgtacacacatatgtcctaatcaaaagcaatcagattactgcgcctggaccagtttgtgggggtctaaggtctggcatggggctcacctctgagccccccaaagcagttccgttccaagtctccaaatacaccaagcctgcccctgctccccaccccatctatggtgacgatgaccgaatatgtgagcaaatatccacactcatggccattccctaccaggacggtcggagttgaaggcgatcaagctgcagcttgatttgatgtggttcctgcatgaaggggcggttcctgctcgaatgtcactgatccaggactgaaaatcaagagtaaagaagtatgtggtgagagccagggttccacctccatgcatgcctaaagcaagaggtggggcataatctggggaactctagctcacagctgcaccattcgagatgcattcttttatttactttttttttctttttgagacagggtctcactctgtcacccaggctagagtgcagtggcgcgatcttggatcactgcaatctctgcctcttgggttcaagtgatcctcctgcctcagcctcctgagtagctgggattacaggcgcccaacaccaagcccagctaatttttgtattgttagtagagatggggtttcaccatgttggccaggctggtctcgaactcctggcctcaagtgatctgcctgccttggtctcccaaagtgctgggattacaggcatgagcctccgcccccagccgtgttgtgttacttcaaatcaaactctgtccccactcacgaagtcccttaggaaatgtaaaatgtgggccaggtgcggtggttcatgcctgtaatcccagcactttgggaggctgaggcagacagatcatcctgaggtcagaagttcgaaaccagcctggccaacatggtgaaaccttatctctactaaaaatacaaaaattatccaggcatggtggcgggcacctacatacaattccagctactcaggaggctgagggaggagaatcacttgaacctgggaggcggaagttgcagtgagccgagatcatgccactgcactcctgcctgggcaacagagcgagactccatctcaaaaaaaaaaaaaaaaagaaaatgcaaaatgtggccaggcctcctccaagtacccggagaaaaacacccaagctcagagaggggaaccaccaaggcctggcctcatcaggacacacctttccacaaagtctcataagtcagtaaaagaaacacccccacccaaggggaggcagaggagcacgtttctgaaactaagatctgcaaggtccacacattttctctgttgtcaaagcaccgctcagcactccttcctgccctcgatgacaggacacccatgtttcccactccacccacccatagcaccccggaaaccacctccaccacctgaagtttctatatcagtgttcacctgccatggttacagcatcagtcccaccctattatttctccctcctgattcatgtttactgtataaacacagtgactgcaaatatctctgaaaagaacagatcacctgttctcccgcctccctaacataaactgttttaagctctccctacagtctgtagttccatgcctatctgtttatgttgctggactaaggcccacccaggagcaagaattagggcccctcaagtattctccagacccctccaagcagtacttaactgcactcagagccaccggctgtcttgatgcaaacctaggtacctcctcctaacttttcttgtttgtttttttctttttttgagacagtgtctcactctattgcccaggctggtgtgtagtggcacaatctcggctcactgcaacctccacttcctcggctcaagagatcctccaacctcagcctcccaagtagctgggaccacgggagtgagtcaccacacctggctaatttttttttctttaacttgttgttcagaggggtttcgcaatgttgcccaggctggtctcgaactcctgagctcaaagcagtccacccaaagtactgggattaccgtgagtcatggtatccagcccctccccctaacttttcaatggctctgcactgcaatcagaataaaacccaacttcttccggtggcccttgggttctgcaggaccactctggactcatctgtcaccatactgctccggccatcccctccatccactcatgctcactttccatttctccaccaggctctttctcaattctcacccttctggcctcagctaaaatgccatctactccaggcagcctttcctgaccacgctactgagactggccccctccattctccatcccagtccctcatgtgtgttcttcaatgtcgttatgaaaacctccaatgctcttgtttgtctgcttgctgtctccctcatgaggctacaagtgccacaggggaaggaaaatgccgttgtgttcaccgggatgtctccagcagcttagcacagcataaagtggaagcagaggaaatatagtccacactacaaaaacggaacctctacccagactgccctgacttgctctgggaccctgatggggtcacttgaggtcaactcctaggcccagttatcggaggacactcccaggccttacaaataacacggaaagcggaagagcagagctgacatcgtttccaaggcgcacccctcatcagtcctcctgccgtttcgggggtccgaagggtctcccggcacctggctcagcaattctttggggctccacctgctcaggcttccccaggccccacccagccgtggcagcatcaccgagataaagaaagagcttgcgccagcggcgagaggaggaagcaccggcggaaacccgagggaggggcgcgtgcggccgaggggctccctccccaccactgacacacttgggctcgccggggccagaggagagaggggcgtctccccacagcccagccaggggcaggggcgacccggggcggcagggaggaggagccaggcgccggcagcgccccgagccccggctcccggcgaggccgaccggaagctgggaaggcaggcggcctcgcaggcctgggccccggctaggagggctgcgccgcctcgggggtcccggggcgaggtgggcgaggcgggcagaccgccagggtcaccgagcgccagagcgagtcacgggagtgccggactctgccctccggcggcgacgaaacggcccggacgccggggccctggcctgaaggggggttccccggggatggaggtctcggggttccagacggccctggagggcacccctgtggggtccgggcagggggaggggcagccggacggggcccgaggcgacagcgcccggtcctcgggccggactcacctcgcggcggggcggccgagcctcggtgtgccggaacttggacaccctgaagcggttcatggcgacgggcacggcggcggacgcgtcttcgaggaccccgggcgtcgggtctcaggtgcacgctgagcaaccgcgactcccgctgcctcggccccacccgggacccaatgccgcggtcacgcccccggcgcgccccactgccaatcgcagccgtctccggccccctgggccacgcccccaagcccctctcctttcgcgcgcgcaccaccggtcccgcctcccggccaatccaggtacggccgccccgcgaggccacgccctgataccgaggggacggactggcgcgggtgggaggtcacgtggggcgcagctgtcagcccacgtctcctgcggtgcttgcttgcgtggggtctcggctgcagcattcgcgattttgtgtgcaggatttgctgtggagtctttgcggtgtacctagcacgccttccagcactatctacctcttcctgtagagaggggagaaattagctccatttcagagacaggaaacccccggctaaaggagagtgtaaactgtcggtccccaggtcacaccagtggtaagaggcagagggggaacaggggcccaggtctaaagcaaatccctgtccaccgggcctactcaaaagcctctgcatccggccaggcgctctgcatccggccaggcgcggtggctcaggtctgtaatcccgaactttgggagactgaggcaggagtatcccttgagcccaagaggtcgaggctgcagttatctgtgaccgtgccactgcactccagcctgggagacagaaagagaccctgcctctaaaaataataataataatagcttttaatttttctttagtatttattcatttatttgacacggagtccctgtcacccaggctggagtgcagtggcgcgatctcagctcactgcaccctctgcctcgcgggttcaagcaattctcttgcctcagcctcccgaatagctgggattacaggcgcctgccaccgcgcccaactaattttttatttttagtaagagacggggtttcaccatgatggtcaggctggtctcgaacgagactcaagcagtcctcccaacttggcctgccaaagtgtggggattataggaatgagccaacgcacccagctgattcttgcatttctaaggtttgaaaagcaatgcttacattttatcttagttcgggcagaagtgtatttactgtgaaccaaagtcacttgtggtttattgaaaaggctttttgtttgtttgttttgagacagagtctcactctgttgcccaggctggagtgcagtggtgtcatctcagctcactgcaacctccacctcctgagttcaagcgattctcctgcttcagcctcccaagcagctgggattacaggtgtgcgccactactcctaatttttgtatttttagtagagatgggattttgccatgttggccaggctggtctcaaactcctgacctcaagtgatccacctgcctcagcctcccaaagtgctgggattagaggcataagccactgcgcccagtccaaaaaggtttttagaaaatcatcaggttggccgggcgcggtagctcacgcctgtaatcccagcactttgggaggccaaggtgggtggatcaccaggtcaggagttcaagaccagcctggccaagatggtgaaaccctgtctgtcctaaaaatataaaaattagctgggcgtggtggtgggtgcttgtaatcccagctacttgggaggctgaggcagagaactgcttgaacccgggaggcggaggttgcagtgagtcgagatcgtgccattgaactccagcttgggtgacagggcgagactctgtctcaaaaaaaaaaaaaaaaagaaaaaaaaagaaaatcatcaagtggctgggcatggtggctcacgcctataatcccagcactttgggaggccgaggtgggtggatcacctgaggtcaggagttcaagaccagcctggccaccatggtgaaaccccgtctctactaaaaatacaaggcgtggtggcaggtgcctgtaatcccagctactcgggaggctgtggcaggagaatcacttgaacccgggaggtggaggttgcaatgagccgagatcatgccattgcactccagtatgggagacaaaagcgagattttgtctcaaaaaaaaaaagaaagaaagaaaatcatcaggacagtggtcccactggatcctaggcgaccgaggcacagctcatcatcccctttcatagggaactgcacctgctacagacatcacagaccagaacatctggaccacacattcctcacccacttggaattgtcctatactctgtgtgaagtaaagaaaatgctatacttaagacaaatcatgcccctgaagagctgggctcaggctcttctgccctctgtaaaagatctctgagctcacatgggagagttgcagccattggcagccatgaacttggccagtcccattatacttcaaatgatcagtggtttcagcaagaaatcacagagaccgtcttgtctcccattgccttcagcccagcactgtcggggagcaccattaaaccccttcgcagctctcacagatatccacagctcaggagatggggaaagtgctctgtggaattgctggtctagtgaaatgaaagtgtggagggggaaacgcttacgactttgtgttccctttgcaagtaacatttgtttctccttttttttttttttttttttgagataaagtctctgttgccaaggcagtgcaatggtgtgatctcagctcaccataacctgtctcctggattaaagtgattttcctacctcagcctcccgagtagctgggattacaggtgcataccaccatgcctggctaatttttgaatttttagtagatatgggatttcgccatgttgcccaggctggtctcaaactcctgagctcaggctgtctgcccacctcggcctcccaaagtgctaggattacaagcgtgagccactgtgcccggcctgtttctccttaaagctcacatttttgagcttctgcctggagaacacgggatcatattctgactggcactgaggataggtgtagcttgtggcttctgcagtctttggcaacaagcctgggatggatccatttgtgtccagttgcagcagaagtccttgaaaggcagggcagcagtttgtacccatggtagtaataaatgcttgccctgcctctcttttgttgtgaaaagcaaatgaaaataagcatgagaaagtacttcagaaactcccaagagccatatgcttgggagatactgatcgcaatgacgattgataggcacgtggtttaaaggaaaaacacacagttttgttgtgagaagacctgggcttgggtcttcattcactcacttactagctgtgtggccttggacaagtcttttcatctttcagagcttattttattgttgttttttttctttgtgggcggggtggtgtccgtttgtaaaaatgggaatagtcctcccgctacctacctcatagggttgggctcatatcaaaatagaaaacaaagccagggaacagtggctcatgcctgtaatctcagcagtttgggagactgaggcgggcagatcacttaaggtcaggagttcgagaccagcctggccaacatggcgaaaccccgtctgtaccaaaaatacaaaattagctgggtgcagtggtgcatgcctgtaatcccagctactcaggaggctgaggcaggagaatcgcttgaacccaggaggtggaggttgcagtgagtcaagatcgtgccattgcactccagcctggacaacaagagcaaaacactgtctcaaaaataaataataataaagtctaaccaaaaagagaccaggcataggcccaggctgctctcagctgggagtctttcccatgtttttctttcttctgtgtggcagatcccaaggactttgtcctctcttttggtaattaccatcatccactccactccttaagagttctctgcttcataatagaaaatactggctccccaacaatcagccttcctgctatccctgaaaacaagaacacacacaccatttcaacgtggaggatttttactgttcatcactatggggaactagatgggggataaacgaaaatacaaagaaaaaaagggggggaagttacaacggtgacagttttcatattactgagctctcctctagttcctaactcactctgaggtagtaaatggaagtccttttggctcttgttttcagcttctatacttgaaagttgttcttctcaaccagcagcatccccccaacccccatttctcctaagttttgggctccccgtgagtaagtaactctgtctgagttcttagtatcctcagtgcttagtacagcctggcacatggggccaacacagattgagcaatggctacgcatcaagtactataggaagcctttacatgattatgtcactcagatgaccctttgaggacattactattttttgttttgctttattttgagacagagtcttgctgtgttgtgcaggctggaatgcagtggcgtgatctcggctcactgcaacctccgcctcccaggttcaagtgattctcctgcctcagtctccccagtaactgggactacaggtgcgcgccaccacgcctggtgaaattttttttttttttttttttgaggaagagtctcactgttgcccaggctggagtgcagtggtgcaatctcagctcactgcagcctccaccccctgggttcaagtgattcccatgcctcagcctccaaagtagctgggattataggcacgtgccgctgtgcccggctcatttttgtatttttgtagtgacagggtttcaccaagtggcccaggctggtcttgaactcctgacctcaggtgatccacctgcctcggcctcccaaagtgctaggattacaggcgtgagccaccacacccggcaatttttgtactctttagtacagatggggtttcaccatgttggccaggctgctcttgaacctcaggtgatccccccacctcggcctcccaaagtgctgagattacaggcgtgagccaccacgcctggccgacgtcgttactattaagtcctcatttatttatttgacatatggtctccatttgtcacccaggctggagtgcggtggcacaatcatggcccattgcagcctcagcctcccagactcaagcaatcctcccacctcagcctctcaaaatgctgggattacaggtgtgagccaccgtgcctggcctatgtccccattctagagaaaaggaaacagaagaacagagtgaagtaagttgcccaaggacacacagctggtaagtggcacagctagaattcaatcccaggctgtctgactccagagctatactctttttttttttttttttttttttttttttgagaaagtgtcttgctctgttgctcaggctgcaatgcagtggcactatcatagctcactgtagacttgaactcctggactgaagtggtcctcccaccttggcctcccaaataactgggaccacaagcatgcgccaccatgcccggccaattaaaaaatttttttttgtaaagatgaggtcttgctatgttgccaaggctggtcttgaacttctgggcccaagtgattctcctgccttggcctcccaaggtgcagggattgacaggcatgagccaccatgcctagcacagaacccatactctttttctctttatttttgagacagagcctcactctgtcgcccaggctggagtgcagtgccgcaatcttggctcactgcaacctccatctccttgattcaagcaattctcctgcctcagcctcccgagtagctgggattataggcgcctaccatcacgcccggctaacttttgtattttcagtagagacgaggtttctccatgttggccaggctagtctccaacacctgacctcaggtgatccgcccgcctcagcctcccaaaatgctaggattacaggtgtgagccaccgcgcctggccacagaacccatactctttttttgtttgagacggagttttgatcttgttgcccaggctggagtgcagtggcgcgatcttggttcactgcaacctctgccttctgggttcaagcgattttcctgcctcagcctccccagtagctggaaatacaggcatgtgccaccatacctggctaatttttgtatttttagtagagacggggtttaactatgttggccagactggtcttgaactcctgacgctgtgatctgccctcctcggcctcccagagcgctgggattacaggcatgagccaccgcgcccagtcagaacccgtatcttttttttttgagacaaagtctcactctgtcacccaggctggagtacagtggcactatctcagctcactgcaacctccgcctcccgggttcaagcaattctcctgcctcagcctcccgagtagctgggattacaggcgcctgccaccattcccggctaatttttgtatttttagtagagacagggtttcatcgtgttggccaggctggtcttgaactcctgacctcaggtgatccgcccgcctcagcctcccagagtgctgggattacaggcgtgagccattgtgcctggcccagaacccatactcttcatcactatgctggtcatttaagtatttgctgaatgtattaaaggaactcttgctcacctcccaacacccttgttcatctcagtcctccccattccgtagcccaaactctctccaactattacttgcaatttacaatagcttggtcactgttcttcaaaggactggtggttttatttatttatttattattattatttttttttgagagggagtttcactcttgttgcccaggctggagtgcaatggcgcgatctcggctcaccgcaacctccgcctcctgggttcaagcaattctcctgcctcagcttcccgagtagctgggattacaggcatgcgccaccacatccagctaattttgtatttttagtagagacagggtttctccatgttggtcaggctagtctcgaactgctgaccttaggtgatccgcctgcctcagcctcccagagtgctgggattacaggcgtgagccaccgtgcctggcaggaccggtggtttttaatcttcgagtctcaatgcctgtggagaatttgacgaaagctatgggtatctacccaaattaacatccacgtacacaaaaatttggtgtacaatgctgggagtagcggggagggggagtagcacagattcccaggctttggggatgggggtgaagatttatgagcacagtttgttttaaatccaaacaagaatcctcaggttttttccccattgcttgaggtggttatgatggtgggagtgtgaaaattgaaagtcctttgcaagactaaccaggtcaggtctcccttcctagcctcatctcatcacatactttttttttttgagacagagtttcgctctttttgcccaggctggagtgcaatggcgtgatctcggctcactgcaacctccaccttccgggttcaagccattctcctgcctcagcctccggagtagctgggattacaggcatgcgccaccacgcccggctaattttgtatttttagtagagacggggtttctccatgttggtcaggctggtctcgaactccggacctcaggtgatccgcccgcctcggcctcccaaagtgctgggattacaggcgtgagccactgcgcccggccaccacttcttttctttttttttttttttttgagatggagtttctcttgcccaggctggagtgcagtggcgcgatcttggctcactgcaacctccgcctcctgggttcaagcgagtctcctgcctcagcctcccgaggagctgggattacaggtgcgtgctaccatgactggctaatttttgtatttttcgtagagacggggtttcaccatgttggccaggctggtctggcactcctgacctcgtgatccgccggcacctcggcctcccaaaatgctggaattacaggcgtgagtcaccgcgaccggcctcatcacatactcttaaatttagggtttaagcaaagaaggcaaacactttcatatcttagacatttgtttcttaagttcaggctacttggaatactccatccctacctgacacacttttcatcgatgttcagtttgaatcttacctcttagaagccctgacatcccaaacttcctctctcccattttagaaatggaatgactccttcaccttgtatgactgtaacagtgcttattcctgtgatagcatttaacattgttagttgctaaggagcctctctcgagtcattgtttgctcctcccgaacagggatggtgtatcaggcatcactgtatccccgatattctagaacatgcatgacacacagtaggcgctcacaagttttactaatttagtttttgggcagcacggctcccattcggaaccagcaagttcactgcaggtttggagaaggctaacacgcttaaggagagagctgaggtcggcgcggtggctctcgcctgtaatcccagcactctgggaggccgagacgggtggatcacgaggtcaggagttcaagacccagcctggccaagatggtgaaaccccgtctctactaaaaatacaaaaaaattagccgggcgcggtggcgcgcgcctgtaatccctgctactcgggagactgaggcagagaattgcttgaacccgggaggaggaggttgcagtgagttgagatcgcgccactgcactccagcctggcgacagagcgagactctctgtcaaaaaaaaaaaaaagaaaaaaaggagaactgagtcttgttagaggaggcgggtggggaatcagcctaagagacagtgagactgcggccaggattctgagggtggcgacgaagatttactagaagcgcgcggagacggcatgagtaaaactcacgcaattcgtcgtaagtctcagggtcagcaggaggaaaccacgcactacatgctgggagcggcgcgacggaggaccgcgttgtatgctgggacttgtagtctcgcccttagccagacccctcggaccacttaagttcggctacattcaaccacgtccttacaccgataacgtacacccattggttgtctagcacagaatagcgaggttctgcacggcgagtctacctaacaacactcttcagagcaaaccccgtttcggcgatggctacccggaaggcgcgttggctgcggctacgcgtacggtgcgcctgcgcgtgcgcgacgcatgcgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagccttacaggtgagggcaggttccaacttccgagtggcggtttcagggcctagaaaagagtgagtctcctcgctgtgactacggctgcaggggtagtggggtggagggtgtcttccgacgcggatgcacaattgccggagacacagacaggcaggaggcggggaggccccagtggctgctcagccgtcaaggaagggagagaagcgtggagcccccggcggcggtgatgaaacgccccgtagatcgtgaaccttcacctctctgtcaacatttctggaggccgctgctccctcgtcctcttcctttcccatctctccaccttctagcccgtagcggaagggaagagctaactgccattcggagaggcctaggtactttgttacaacaaccctgcaagatgcctgccgtcatcaccattttaaagaatgagaaactgagattcaacggaggaatcgaccagcccaaggtcatggagttagactagaagagttgtctcaaacccaaagcagtcatgtcatagtttacgctctttctaccacgtggtgctaattgaagggcacagttaacaatctttttagaagtctttagttggtgattgtaataataacacagtcagacatttattgagcacttactgttggccaggcatggttttccccttacatcacatttccacatgataggcactgttattccattttataaagatactgaggcttagatgttaaaccacttataaatgtcacaaggaggtggaggcttgatatcattgcctgagatgacactgaattatacattaagccttgaagtgcttagtcatgttttcttttcttttcttttctttttttttttgaaactgaatcttgctctgttgcccaggccggagtgcagtggctcaatctcgactcactgcaacctccgactcctgggttcaagagattatcctgcctcagcctccccagtagctggaactagaggcatgcgccaccacgcctggccaatttttgtatctttaatagagacgggatttcgccatgttggccaggctggtctcaaactccagacctcaggtgatccgcctccccttggcttcccaaagtgctgggattacaggcgtgaaccaccgtgccctgcttagccttcttttcttatgccgtgtgttttgtgctgtgtgttgtacgtacctgaattgtgctagttttgtgtcctctagaatttgtgcaaatggtatttaagctatctataaatttataaagattaattaaagggccctgacaagataatttataccaactaacttcctgttgcaatccagtttgtaatagttacatagtagacaatcattaaagtatcagtaattgtggttacttcatgcaatgtaaagaaaagagcctgggcttcaggggtgaacttccccagcgtctgtgagcggggtgtattatttaaccccttcgagcacctgtctgaaaattcattcattcacaggtgttaattgaggccaattgtatgccagccactgttctgggcactgaggagatggcagagaacaaagagattggatgtgtgtttggttaagagaatgattatttatgtatttaattattttttaagacagggcctcctgttgcccagactggtgcagaggcacaattacaactcagtgcaaccttgacctcccaggttcaatcgatcctccatcctcagcctcctgagtagctgggactacaggcatgcaccaccacacccagctagttttctgtagatggggtttcaccatgttacccaggctgggctaaagtgattcccttgcttcagcttcccaaagtgctggggttacaggcatcagccactgcacctggccaacagaatgaattttttttttttttgagacggagtctcgctgtgttgcccaggctggagtgcagtggcgctatctcagctcactgcaagctccgcctcccgggttcacgccattctcctgcctcagccttctgagtagctgggactacaggcgcccgccaccacgcccagctaattttttgtatttttagtagagacagggtttcaccgtgttagccaagatggtctcgatctcctgaacttgtgatccacccgcctcagcctcccaaagtgctggaattacaggcttgagccaccgcgaccggccttatttttattttgagatggactcttgctctgttgcccaggccaaattgcagtgatgtgatcctggctcacttcagcctcccaagatgctgggcttataggtgtgtgccaccatgccaggctagatttttcaacatgagcaaaagtggccatttttagagcttgctaacattttctaatgtcaaggttgttttaaatagaatctggctgcatcttttcattcaaatattaatccttaggtgacttgttttattaagccaaatttgttcatgttccagctgtacaaatttgggagcactcgttattattgtgtatgtgaaagagagaaacaggcactaaacactaagctttgtgtgaagctgtgactaaggaactgcggttagctgtcttgttccccaagtgagctcataacctgccatgggcaagttttatatcaggtagtgtacacaggtgagaggtggcatccttcagggtacgtgctgttttcacagatagagtcatcaactggttgggcggggtggctcacgactgtaattccagcgctatgctggcgctgaggcaggaggatcacatgagcctagcagtttgggaccagcctgggcaacataggcagatcccatctctacaaaaagattttttttttttttttttttttttgagacggagtctcactctgtcgcccaggctggagtgcagtggcacgatctcggctcactgcaaactccgcctcccgggttcaggccattctcctgcctcagcctcccgagtagctgggactacaggcacctgcaaccgcgcccagctaattttttgtatttttagtagagatggagtttcactgtgttagccaggacgtctcgatctcctgacctcgtgatccacccgcctccgcctcccaaagtgctgggattacaggtgtgagccaccgcgcccggccaagattttttttgtttgtttgtttgagacggagtcttgctctgtagccaggctggagtgcagtggtgcgatctcggctcaccatgatcttgactcaccgtgatctcggctcaccgcatcctccgcttcctgggttcaagtgatcctcttgcctcagtctcctgagtagctgggactacaggcacgtgccaccactcccagttaatttttgtatttttagcagatactggatttcaccatattggccaggatggtctcgatctctttacccatgatctgtccacctcagcctcctaaagtgctgggattacaggtgtgagtcaccgcgcccggcctacaaaaagatttttaaaaattagctgactgtggccggacatggtggctcacgcctgtaatcccagcactttgggaggcctatgcgggcggatcacctgaagtcaggagtttgagaccagcctgatcaacatggagaaaccccgtctctacaaaaaatacaaaattagccaggcctggtggcgcatgcctgtaaacccgggtactcgggaggctggggcaggagaattgcttgaacgtgaaagtcggaggttgccgtgagccgagttagcgccattgcactccagcctgatcaacaagagcgaaactgtgtctcaaaaaaaaaaaaattagccaactatggtggcaactgcctgtactcccagctgcttgggaggctgaggtgggagtttcacttgagcccagaaggttgaggctgcagtgagccatgatgatgccactgcactccagcctgggcaacagagtatgactctttctctaccaaaaaattaataaagtcatcaactgagaagccatgtggtggcgagcctctatagtcctagctactcaggaggttgaggtgggaggattgctggagtccaggaatttgaatttggcctaggcaacataatgagacccctgtctcttaaaaaaaaaaattttgaaaaggtcattaactcagcgtccaaacactagtctgtgatcttgtctcaaatctagtagtaagatgacataacaacattttagatgtgacttttcttccaagcagaaagaaagcagttgttggtggccaggtatggtggctcatgcctgcaatcccattactttgggaggtgggttgatcgcctgaggtcaggagtttgagaccagcctggccaagatggccaaagcttgtctctactaaaaatagaaaaagttggtcaggcgtggtggcgggttcctgtaatcccagctactcgggaggctgagacaggagaatcgcttgaacccaggaggcagaggttgcagtgagccgagatcgcgccactgccctccagcctgggcaacaagagccaaactccctgtcaaaaaaaaaaaaaaagaaagcagttgttggacagtgggttggccattcttagaacgacttggaggcttattttattctgggttgttctaaaaaggacaggacatttactggtcatatgtgataaaataaatagtctattaaatgaaatctaattattgttaatcattgatgccctatggataatgtcaaaagtcatcagactggggatggtggctcatgcctgtaaccccagcactttggtaggatgaggccggcggatcacttgaggtcaggagttcgagaccagcctggccaacatggtgaaacttcttacctactaaaaatacaaaaattagccaggtgtggtggtgtgcgcctatagtcctggctacttgagaggctaaagcagaagaatcgctcgaacctgggagatggaggttgcagtgaaccgagatcacaccactgcactccagcctgggtgacagagtgagactctgtctcaaaaaaagaaaaaacaaagccatcagtcttgtaattaaacgtgatttgtctttatccacatgcagttttgtgcgttactatctctgtactaactcctgtccgtgttctctgcccgtaatgttgaagccacagctgccacaggtcactaccagcctccgccttgtggcattggaatgagtggtgagagagaggctggactgggccgggcaaccccttactccgaaataaaaagagggttgagtacaagttcaataataagtcaggtctagtgttttctcaagtctgactgaagaaacacaaagtggtctcctgacccctactacttccagtgtgctttttgtatcccgaggatattgggtgtgccaaacacacggatttatttcctatttctaattttaagtatcctgaccattcctatccattctcctgtctgatcatcctttacctggcctcctacttggatgtgctcaaccaacctctggttgtgttttgtgctgattaacttcgagtagtctcccaggcttcctagagttgtttctcttttttttttttcaggtggagtcttgctctgtcgcccaggctggagtgcaatggcgcgatcttggctcactgcaacctcagcctcccaggttcaaacaattctcatgcctcagcctcccaagtagctgggattacaggcgtgcaccaccatgaccggctaatttttgtatttttagtagagacaagatttcaccatgttggccagcttggtctcgaactcctgacctcaagtgatccacccgcctcggcctcccaaagtgctgggattacaataggcgtgagccaccttgcctggcctagagttgtttctcatgcaaacctaatgggttctttgtttaacatttgcagtggctccctattgctcttaggataaaatccagactccttagcatagctctaaggcccttcctattcctaggccccattaatcgttatcatctctaaccaccactaccaccactgccatctagtttagttataggtataaatctgtatggattcaaagtcctctttagcctatttctgtctctctctcttttttttccatgtcataagtttatttacaaacatctagtatgtcatataagttcaagtctttgatccatttatttatttatttttaatagagacagggtctctgtgttgcccaggctggtttcgaactcctgggctcaagcgatcctcacgcctcaggttcccaaagtgctgggattacaggcgagagccactgtgcccaggcttatttttctttctttttttttttcttttttttttctgtgatggagtttcactcctgttgcccaggctggagtgcaatggcgcgatcttggctcactgcaacctctgccccccaggttcaagcgattctcttgcttcagcctccttactagctgggattacaggcatgtaccaccacatccggctaattttgtatttttagtagagatggggtttctccatgttggtcaggctggtctctaactcctgacctcaggtgatccgcccgccttggcctcccaaagtgctgggattacaggcaggagccaccatacccggcccggcttattcactttttaaacagatttcatctattaaaacacctccagtctgggcgtggtggcacacgcctgtagtcccagttacttgggaggctgaggcaggagagtcgcttgaacccagcaggcggaggttgcagtgagccaaaatcgcaccactgcacgccagtctgggcaagaagagcgaaactccgtctcaaaaaacaaagaaacaaaaagcctgccgggcacggtggctcacgccggtaatcccagcactttgggaggtcgaggcaggcggatcatgaggtcaggagatcgagaccatcctggctaacacggcgaaaccccgtctctactaaaaatatgaaaaaattagccgagtgtggtggcaggcgcccgtagtcccagctacttgggaggctgaggcaggagaatggcgtgaacccgggaagtggagcttgcagtgagccaggatggcgccactgcactccagcctgggcgacagagcgagactccatctcaaaaaacaaaaaacctgctcttcctatctgttaagtggatgaactaaaacatccttgtttcttaagcagttggtgtcttgctattaaaaaaggtgctgtgaatccagatccaaagtacaaagtcatcctagttagtaaccgccatttgttttccactgaaagtggcaaatgctttcctgggcagcttagccagtttctgcagcttaacagctgatgcctagaagttcttccccgaccttcttagattgatttgtcattggttctcagcaggggacacttttacttcccaggggacatttggcaatgcctggagacggggagttctctactggcatctagtgggtggagacctcctgagtttctggtgaatgtctggagtagggcttgaacatctgtgttttcatcagtctaatgatgctgttggtccagggagcgcagtcttgagaactgctccttaagtagatacccaaggctgcaagatagagggaaaagaatgtggggagttgttaagcattaaatgtgacagaaaaatatgaaaatatgaaaatacctagcaaatggtaagtgctcatgtggcataagaggggggagctgaatccctttttaatcatctcccagtcaggagtattattcctttagtggtttactgagaccactccagtagtataagcgaggagaatcagcctcatccaatactctgacatagtttaatattaattgaatactgtggcttccttagccattattgaagtgcattagggaacagccctaaagctgtagcctgtgtattagtctgttctcatgcagctaataaagacatacctaagactgggtaaattttaaaggaaagaggtttatttaactcacagttcagcacggctggggaggcctcagcgatcgtggcggaaggggaagcaaacacatccttcttaacatggcagcaggaagaatgagcaaaagggtgagcccctcataaaactatcagatctcatgagaacttactatcgcgagaccagcatggaggtaaccgctcctgtgattcagttacctcccatcaggtccctcccatgacacgtggggattatgggaactaaaattctagttgagatctgggtggggacacagccaaaccttatcagtttgtttgttccttcacagatatagcctggtgggtcatgtactcacagttttcttttgttgagaacattcccagagtgattttctttgttttttcctttttaggaacaaaacataaccctttcatttgtactgcctccttccacacgagtgcccctttggccaaagaagattattatcagatattaggagtgcctcgaaatgccagccagaaagagatcaagaaagcctattatcaggtctgtatggaagtcaggttttggtgaccaaattgtagtaggaatgttgttgatcccatgtgatcctgatcagtacagcgtatgtgcccatatgaataggtctcatgagctgatagtatagaagggtgtgataaagctggactttgctagactgtttttcgatgcacaatgctgtagaggttggtgcttcagaaaaaagaggtgagtccaaaccagagattttaagaagtttttttttctagagctgttttcataattaaatttaatctgtattttctgaatcagtagatatgctagtctaagttttaggtagttattttttgcatccagataaaagtttagaggtttagaattacttcctttcctttcttttttttttttttttttttttttttttgagatggagtctcactccattgctgaggctggagtgcagtggcgcaatcttggctcactgcaacctctgcctcctgggttcaagcagttctcctgtgtccgcctcccaagtagctgggactataggcacctgccaccacacccggctaattttttttgtatttttagtagagacgcggtttcactttgttggtcaggctggtcttaaactcctgacctcaggtgatccacctgcctcagcctcccaaagtgctgggattacaggcgtgagccaccgcgcctggccctttcttaacctggaaaatgtgaaattcccattgtatcccagggtctattagggtagttagggtagctgagtaaagttgtatacgagatgtctacaccactggttcctagacccttggtttgctctgaccaacaaaataaaatcaatattggaggcaccattgtaggattgacagctttttataagtgcacagttcactggagttgtgcacctgtcaccacagtcaactttaggacattttcattacctcgaaaagaaactctgtattcattagcactccccttccattgtcctctctccccggtccctagcagctgctaatctgcgtcctgcctctttggatttgcctattctcaatattcatatacagggaatcatacaatatgtatccttttgtgtgtcttggcttctttcattcacataatgttttcagggttcatctgtgttatagtttgtgtcaatacttcatccctttttatggtcaaataatctgttgcatggattaatcacattttgtttattcatcgtttgatggacatttggatattttccactttttgctatcatgaacagtgctgctatatagacattcatatgtaagtttttgtgtagacatgttttcagttctcttggatatttaggagtatagttgctgagtcatatggtaactggatgtttaaccttttgagaagctgccagcctttttcaaagcagctgcaccattttacattcccaccagcagcatatgagggccatgatttctccacatcccagtgaacacttaactattatcgtctgtctttttaattacgaccctagtgaataagaaatgctatctcgttagagtttcgatttgctttttccctgatgactaatgatggtgagcatctttcttgtgcatgttggctattagtatgtctttggagaaacgtgtgtttggatccattgcccacttttaactgggttgtcttttttttttaattgggttgtaatggaatgaacagaggcatggggacaggaagcagagatcctggcctgtgaagagcgaatggcctgtctcttcctgagctcaagagtcaggtgcctgatccaagagtgggaaaagattgaaaagatggaggctgggttggactcacatgacagttgatttgaggcccttagtaagtcccagagacataatttaagagaaagacttaatttagagaaccattcagatttttaggcacggaagtaaaaagatcaggtaaagctgtagcaattactgtattttatttacctacaaaaataattgaaacagcagagacgtctatttattcagtcattttcttccctttttaaaaattttttcttttttcagacagagtctcgccgtgtggctcaggctggagtgcagtggtgcagtcttggctcactgcaacctctgtctcctgggctcaagcaattctcctgcctcagcctcccgagtacctgtgtttataggcgcgtgtgaccatacctggctaatttttgtatttttagtagagatggggtttcgccatgttggccaggctgttctcaaactcctgacctctggtgatccacccagctcagcatctcaaagtgctgggataacaggcatgagccactgcgcccggccccctttttaaaaatttgtttttcttttttgttcatttacctattctaagccatgctgggtgctaagggcaaagatacatcagaatcagttcctgccctcaagttaagagatggatacattaaaacagatcattattattattattttgtggggcggacagaatctcactccgtcacctaggctggagtgcagtgcctcgatctctgctcactgcaacctccacctcccaggttcaagtgattctcgtgcttcagcctcctgagtagctgggaccacaggcatgtgccaccacgcctgactaattttttctatttttggtggagaggggtttcgctgtgttgcccaggctggtgttgaactcctgagcttaagtgatctgcctgccttcacttcccaaagtgttgggattacaggcgtgagccactgcacccagccgagagacaacttttataaagggaacataattatgactggtatttggggttctgttgtatcgggggttttgttgtttctggtatttggggttcacattgtatctggagtaatttatcatgtttttcccttagcttgccaagaagtatcaccctgacacaaataaggatgatcccaaagccaaggagaagttctcccagctggcagaagcctatgaggtaatatgacttcggtgcatgcggtcactgctgttcagctatgtgtatgaatcaaaggttgcattgctacctgggacagcctggtgtgtcatacagtccagtgtgaaggccatgtccctgcgccaagtaatcttgttaagaaaaataaaaaaaaagagattccaggccaagcatggtggctcactcctgtagtcctagcactttgggaagctgaggcaggaggatcacttgacctcaggagttggcttgaccctaggagtttgagaccagcttgggcaatgtagtaagaccacgtctctacaaaaaaaaaaaaaaaaatcaccaggcgtggtggtggcgcacctgtaaacccagctacttgggaggctgagtcaggttcatcacttgaggggctcaaagctgcagtgacccatgatgccatgattgtgccatagaactatggtctgggcaacagaaaaagaccttctctcaaaaaataaaaaattaaaaaaaaaacaaaacaacaacattctaagactaacttggaatctcaatgaagaacaggatccaggccaggcgtggtggctcatgcctgtaatcccaacactttgggaggccgaggcaggtggatcaccaggtcaggagatcgagaccatcccggctaacacggtgaaaccccgtctctactaaaaataaaaaaaaattagccgggcatggcggcatgcgcctgtagtcccaggtgctggggaggctgaggcaggagaatggcgtgaacccgggaggcggagcttgcagtgagctgagattgcgccactgcactccagcctgggcgacagagcaagaccccgtctcaaaaaaaaaaaaaagaacaggatccaataatctgtactaataaagttccccaggtaatttacacttgtagctggatttgggaattcacagttggattaattaattcagcccttattcaatgacatccccttcctccacctcagggcatcactgctttttggggatagaggttattgtaaaagtagaagcccattattgtcctataagaatgtcaatgtaatcagaggacaaagcatacatctctgaaaacagctattgaccccacttccatagttttctgaaagtagacctttttcccagattttttgacaatcttttctttttttttttttttttttgcttaagagacagggtccctctatgttgcccaggctggtcttgaactcctgagctgaagagatcctcctgcctcagcctctcaaattgctaggattataggtgcaaggcaccagacctgcccgactttggccatcctaaaggggttcagtatatataggagctcatatatctataagagtagacagccacgtagaagaacaggctcaactcagtaaatcttttttgagtaaatatctgtcaactagatctaatgaaaagtttatttactagtgtaattttaaaataatatgttcttattaggtaactcaaactaattgataacataactaaacagtcttggaacctgcttctatggaagataagattaatttttttttttttttcaagagttgaggtctcagccaggtgcagtggcttacgtctataatccctataatcccagcactttgggaggccaagacaggcagatcaggaggtcaggagtttgagaccagcctggccaagagaccagcctgagcaatatggtgaaaccccatctctactaaaaatacaaaaattagccaggtgtggtggtgggtgcctgtaatcccagctattcaggaggctgaggcaggagaattgcttgaacccgggaggcatcagtgagccgaagattgcgccattgtactccagcctgggcaacagagcgagactcccaatcaaaaaaaaaaaaaaaagagttgaggtctcactctgttacctaggctggagtgtagtggcgagatcacagctcactgcagtctcaaactcttgggctcaagcagttttcctgcctcaacctcaacttcctgagtagctgggactacaggttccccactgcacccagaagattcaatttttaatggggcgggggggtgttattcttgtgaatgtgtttttccacatggttagttgatctgatgtttctgccaggggcatgagttttggagagtcctaatccaccgtgttgctgacttctgtcttcaagggggatgttattaaacggaccgagcctcagaacctaagagcagcaattccttgggaagggctggaaccaggagataaaacccaccaggaagtcatgaactcccacctgactcctcctctgccagccttcctcctttgcatcttaactgggtgccctaaaagttaccctaggcaccaagctgtcctccacctgctttcttagtccccctccattctaggtggaagtgtcttttcctttggaggaagcgtactcttttctgtttggccttaaggatagtgcctatttttttgagatagtgtctcactttgttgcccaggctggagtgcaatggtgcaatcacggttcactgcagcctcaacctcaacctccgtgctcaagcaatcctcccacctcagcctcccaagtagctggaactataggcgtgcaccaccattcttggttaatttttttgtatttttcttgtgatggggtttcaccatgttgcccaggctggtcttgaactcatgaactcaagcagtccacctgccttggcctcccaaagtcctgggattacaggtgtgagccaccatactcagcctagggcagtgtctttttaattaaagaaaaaaaaagtaagacaaacacataaaaaaaagatacaaagtgagggccaggcacggtggctcacgcttgtaatcccagcactttgggaggctgaggcagacggatcacgaggtcaagagatcgagaccatcctggcaaacgtggtgaaaccctgtctctactaaaaatacaaaaaaattagctgggcgtggtggtgcatgtctttagtcccaactactcgggaggctgaggcaggagaatcacttgaacccgagaggcagaggttgcagtgagccgagatcgcgccactgcactccagcctggcgacagagcaagactcccgtctcaaaaaaaaaaaaaaagatacaaagtgaatactacatttttccttgtccctccctaatccccctttttgaggtagttagtccttattaacagttttgtgggccaggcccagtggctcatgcctgtaatcccagtattttgggaggtcgaagtgggaggatcgcttgaggccaggagtttgaaagcagcctgggcaacatagcaagaccctgtctctacaaaaacttaaaacaatttgccaggactggtggtgtgcacctgtagacccagctactgtggaggctgaggcaggaggattgcttcaacctgggaggttgaggctgcagtgagctaggattgcaccactgctattgtcgttgctgttacttctgttactccggttgttctggcttgcagaaaacctttcgatgaaggtaagggtaggaagcataaattctctacgaggtaatgtcccctgaggagagaggtgaagtgtgaatctgtgaagaatccagggtgcctgtgaggtcaagcgaggatcaacacaaacattttcccagcatgcgcgacggcgggagagttcgtgagacttttggaagcacttcacgccctacacttagcattcagtttggtcatctcatccctcttctaggtgctagtcacaggcccaccccaacctcataggatgtgtttgcacacagggccacttaataaatgttatggctgccttatttgctgtgaactcttgtctgtattcctgggccttggtagacctgggatgcccagtggctctgcctttcactgtaggttttgagtgatgaggtgaagaggaagcagtacgatgcctacggctctgcaggcttcgatcctggggccagcggctcccagcatagctactggaagggaggccccactgtggaccccgaggagctgttcaggaagatctttggcgagttctcatcctcttcatttggagatttccagaccgtgtttgatcagcctcaggaagtaagttcctcacttggaagaattattcaaattttagactaagtatgggtcaaacaaatttttttatcagtttctgtttctcagaaaggcaaggcagcttaaatggagtgatctggaggcagccattttagtagaaaataatttcagtatttgaaaaatcgcataggtagtaatgagtatgtccattctgatggtattcttaacagttgcataatgaggtagcacctaaggctttcagagcccatgagggtgtgagtgttgtctctcatctgctacagtattccaggagagttctgtccggtgggaaggcactgctgatcctctctcatttatgtccttataagacactgtcagagtggaagagagaggggatatatttatgatctaaattatgattgtggatcattcaggctgtttttaagtgccatgtacgagtatttatctgtgaacattttcagtctgttgaaagtacgttttcatttaagtcatacattatctcttaaaaatcccaaagagtagggcagaattcgttcagtgagtcctacctatgcttacttggcagagtgcaagtaagtacagtggtgaaagagtgactgaaaatgtgggccagtaccctcctttccctttagagccgagcgtcagttttggtcgttgcaaacaaaagttgacaggctgtcccttggtttctttagtacttcatggagttgacattcaatcaagctgcaaagggggtcaacaaggagttcaccgtgaacatcatggacacgtgtgagcgctgcaacggcaaggggaacgagcccggcaccaaggtgcagcattgccactactgtggcggctccggcatggtaaggctctgcccgagactccacctcccacggcttgcaccactgactgagaagagctggttgtggcactgctcccagagaacgtatgctgggaattgggggagttggtgaactcagcctggctgtctttcccccgtgaccctgaggagacgagcctgtgctcctctttccctgataccacaggctcagcaaccagagcacagcagctccgggggcggggcgggggattgcatccagttgtcactttcttctttatttttctaacaattgctttggtaattcaaggggaaataatcttttttaaatgtactgttcagctcccaggagtcttcaggtacttctgtagacaggcggtatcatatttttcagtgtcgtgtggtcaagttgatgatctggagtgcagaagtttgtgtgttctagaaaatcagatgaacagattgaggccctgcacctgggttcctaggcagtgtgtttgagtgcacatgcacataaaaaacaagccttaaagagacatttttcttacgcacattgtggtcccagaaccacccatcagtttacctgcgtacttaggttaccatttttcttgtttttatcaggaaaccatcaacacaggcccttttgtgatgcgttccacgtgtaggagatgtggtggccgcggctccatcatcatatcgccctgtgtggtctgcaggggagcaggacaagccaagcagaaaaagcgagtgatgatccctgtgcctgcaggtgggtgcttgggcccgccatgtccaggagcttggagagggcagacagggttgaggctaccacaccgtgtggagagggtggacagggccgaggccactgcactgagtgtgagtgggctcttggtagaagttatggttgaggccctggagccccaggctggaggaggaactggagtctccttgaatctttctgtttctgccagttatccttaaaatttacactttgcatgtcacaatggggagaagagacctgacgtgcctactctgcttcttcctggtgagggagcagcttccaacccccgggctcctctcctctctcccctgtcttagtcaccgaagccatcattgtccctgctgccaccctatctacatcagccccacggatcccacccctcactccatgtctactgttcccttgcccaaaactcactttctgctttcttttttcggttaactttattcatcttggagatcccagcttgagtatcccttccctagctagcctcacaccctcctccctgttcttttttttttcttttttgagacggagtctcgctctgtcacccaggctggagcgcagtggcccgatctcggcccactgcaagctctgcctcccaggctcatgccattctcctgcctcagcctcccaaggagctgggactacaggcacctgccaccacacccagctaattttttgtatttttagtagagacggggtttcatcgtgttagccaggatggtctcgatctcctgacctcgtgatccacccgcctcggcttcccaaagtgctgagattatagtcatgagccaccgcgcgtggcctgctttactgttgtttagatgtctgtttctctagagttgtgagcatttccattgaagagcatgtctctgtttgtagttatgcattagtgctatcgtttggttaacacccatcaccccagtgagaccatgaactccctgaggtactgcctagaccaagcctgaggcaggtgctcagtcatcaggtgtctgtgttgcatctctggaaggttacccatgtgcctcttagataatgacattgttcctcgttaataagaaacaggagtggggaagaagctgtgggttacaagtggatcttgggtggaaagtgctgtgggaggtctcacaataactgctccctttcttttttttctttttcttttctttttttttttttttttaagacggagtctcgctctgttgccaggctggcgtgtagtggagtgatctcggctcactgcaacctccgcctcctgggttcaagcgattctctttcctcagcctcctgagtagctgggactacaggcgtgtgccaccacgcccagttaatttttagtagagaccaggtttcaccatgttggccaggatggtctcgatctcttgacgtcatgatctgcccgcctcggcctcccaaagtgctgggattacaggcgtgagccaccgcgtcctgcctaacttctccctttctaatgtcccttgtaggagtcgaggatggccagaccgtgaggatgcctgtgggaaaaagggaaattttcattacgttcagggtaggtgccctgccccgcacagcttctgttgggcctttcctctcttcgggtgggtgtggctgaggctgctcccatgtaatcaaagcttcacaggaacatgtctcgccattcatgtttctgaggggcacagtggccacctagatgtggtttttagctgtttgttaccttcaagattctgtgccttgtgtggagagaagacaacttcttcaacatgctaacaagttagaaatacaggtcacataaaaatacaggaaacatcttgtgtttttatgataagattgttgatgaggcagtgagtgtgaaagttacaattttacatactgtatacaggggcaaaccttggttttctgagatggtggaaacattaatgaagacaatgccttctactggcaattgccctcctatgtgtacacctgagaaaaacccacacaagcctagcaggcgataggtacaaaggggtgcacaagagtcctgtccatggtagcaagacactgccttcctccaacaagagaatggctcagtgagccgtggtggtcagaggctgctgcagggcagtcggaaggaaagaatgagagctgaactcaagggatgctccaggcgttgcaggtacagacagcagggatggaaggcagcttgccagtggctgtagggcctcagagaccatctgtgtaaagttttaaaacctgtgagatggcattatgtattatttagggacacggaaatacatagtaagtagaagcttgtaggaatgataaatgttaaagtcagggttgtggttagctgaggagggcaagactcaccggtgtttatgatgttttattttattttactttattttttgaggtggggtattgctttgttgcctaggatgaaatgcagtggggcagtcttggctcactgtagcctcagactccctgggctcaggtgatcctcccacctcagcctcctgagtagctgggactacaggcacacgccaccaggcccggctgacttttgtatctttagtaaagatgaggtttcaccatgttgcccagggtggtctcaaaccccagggctcaaatgatccacccaccttggcctcccaaagtgctgggattacaggtatgagccactgcgcccggcctgtgatattttgttacctccactgggttgtgggtatgacatgcttgttatattatttactcttcccttttttttcttttttttttctggaaagagagtcttgctctgttgcccagtctggagtgcagtggcatgatctcagctcactgcaacctccacctcccaggttcaagcgattctcttgcctcagcctcctgagtagctgggactacaggcatgcgccactacacccaggtaatttttgtatttttagtagagatggggtttcaccatgttggcaggctggtctcgaattcctgacctcaggtgatccacccaccttagccttccaaagtgctgggattacaagcgtgagccaccacggctggcctatactttctaataaagtaagatttttttttttttttttttgaggtggagtctcgctctgttgctcaggctggagtgcagtggtgtgatctctgttcagtgcaaacttcatctcccaggttcaagtggatcttctgcctcagcctcctgagtagctgggattacaggggcccgccaccacacctggttaatttttgtatttttagtagagacaaggtttcaccatgttggtcagtctggtctcaaactcctgacctcaggtgatccactcaccttggcctcccaaagtgctgggattacaggtgtgtgccactgtgcctggctaaagtaagattaaaaaaaaaaaatcaaaagccagttttacatttttgtttcccttcacgattgaatggcttgatctgagactgaggaaatccaggcacgcttccatttcggcatttcaagtgtgtagaacattgcagtgttgaaatatgtagaacatgtcattcctgggcctgggatggtgtctccttgttggaaggacagttctttccctcaacactgcactttatgtatggaaggggtgtgtagtttgtcaggtctgagcttgggcctggccaggcatgcagctggtgtttagtctgcagtggacttatcttcacatgcatctgtcatgtttggccttaggtgcagaaaagccctgtgttccggagggacggcgcagacatccactccgacctctttatttctatagctcaggctcttcttgggggtacagccagagcccagggcctgtacgagacgatcaacgtgacggtaagagggtgtgagaacacctttgtcacccctgtactttattgctctttttctgaaatggaaaagaactgaccagtggcctggaacccatgagtgaccagcatgtgggggggcactcacaggggaggacatgaggaattttaggctgctccttgagtgtggaccacaagccacaggccttgagtctataatcgcatgggaagcagttcctggctggcatcactcccacactggttagcggggcctgggaactgggcgcattcaggacacagaagggttcaccctgggttgtgctctctgcacttgcttctgtccagtgtctggctccaagagcagaagactcgggcggtgcatatcccttttgccacagtgatggctgcctgtgtgctgccagcacctgtcccccacctctctcttgacctgcccctccagctcttcccacctccaggccacatcattctctgtattcgcctcagaaccttctccagcttctttgtggggaaccttggggtaacctccatgaaggaggtgggcattttgggccaaggctttctcctccatctgggggctattccctggcttctccagggtcctgtggttccaagggccagggagcgacctcagccacgcaccctgtattggcttttcctgctttgctccctcactcctgcttcctgggctcacttgcccaaactcttgccccctcatcctagtcacaggctctgctctgggcagacccaacttagctcatttccatgtgcttgtgggcgggcttggcccagaaacccaagtggtggttctttttttttttttgagatggagtctcgctttgtcgtcaggtgcacgccaccacacctggctaattttttgtattttagtagagacagggtttcaccgtatttcccaggctggtcttcaactcctgatctcaggcagttcacccgcctcggcctcccaaagtgctgggattaaaaggcgtgagccactgcgcccagcccagtggcagttcttttttttttttttttttttttttgagacagagtcttgctctgtcgccaggctggagtgcagtagcgcgatcttggctcgtggcaatctccgcctcccaggttcaagcgattcccacctcagcctcctgagtacctgggcctacaagcacgcgccaccatgcctggctaattttttgtattttagtagcgatggggtttcaccatgttggccaggaaggtctcaatcacctgacctcgtgatctgcctgcctcagccccccaaagtgctgggattacaggcatgagccactgcgcccggcctttttttttacccaccccctccaccaccgctctgccgagacagagtcttgctctgtcagccagagctggagtgcaatggcacaatcttggctcactgcaacctccgcctcccgggttcaagcaattctcctacctcagcctcctgagtagctgagattacaggtgcacgttaccatgccctgctgatttttgtatttttagtagagacggggtttcatcatgttggccaggcaggtcttgaactcctgacctcgtgatcagcctgcctcgacctcccaaagtgatgggagcgtgagccagtggtagttcttttcaaggaattcctatcaagattgtcttcatgtagtgaaaactttttatttgagcaactggggaccaggggaaaccacagattttctttctttatagatcccccctgggactcagacagaccagaagattcggatgggtgggaaaggcatcccccggattaacagctacggctacggagaccactacatccacatcaagatacgagttccaaagtaagtgccccctaggctgtggccaagcccgcctggtcctgcggtggcactgcccttggagctctgtggcttgggcaggttactgctccctgtaagtcaggtggttcctgcccgagttatctgtctgtaaagtggacatagtagaatggtcaacttctttttttttgagatggagtctcgctgtgtcccccaggctggagtgcagtggcgccatctcggctcactgcaacctccgcttcccaggttcaagcgattctcctgcctcagcctcccgagtagctgggattacaggtgcctgccaccatgcccggctaattttttgtatttttagtagagatggggtttcaccgtgttagccagagtggcctcaatctcctgacctagtgatccacccaccttggcctcccaaagtgttgggattacaggcgtgagccaccatgcccggccagaatggtcgacttcttggagttgttgggagaattaaatgaacaacacataggaattgctttgctgctgctgctattgttgattttcttcttttttttttgagaaggaatctgtcactgtgttgcccaggctggaatgtggtggtgccatttcagctcactgcaacctcctcctccccagttcaaatgattctcctgcctcagcctcccgagtagctgggactacaggcgcttaccaccacgcccagctaatttttgtatttttagtagagacggagtttcactggccaggctaatctcgaactcctgacctcaggtgatctgcccaccttgacttcccaaagtggtgggattacaggtgtgagccagcacgcctggcccgttgcttttcttgttgatgttactagcactgttaggagctggagaggtggcctgggcagagtgctgtgggtacctagggcgggacatgcctgactcccctcgggagcactcatgctttttgttaattagataatttctttttttttttttgagatggtgtctagctctgtctctaggtggagttcagtggtgcaatctccacctcccagatttaagcaattctcctgcctcagcctcccaagtagctgggactataggcatgtgccgccacgcccagctaatttttgtattttcagtagagacggggtttcaccttgttggccaggatggtctctatctcctgaccttgtgatccgcccaccttggcctcccaaaatgctgggattacaggcatgagccactgcgcctggcctaattagataatttcttacttgcttcacatacacactggtaaaatctgtttcccctcctgtaaactgtatttagcatagccacagtgacacttgtttaaatgacttagtgtagggtgttttaggagcttttctgtacagaagctttgagggcatggtccttaggttctcaccgctgcactggctcagggtgtccgcccctgccaaggttgggtccctctcttcccatgtgctgcgagggtgctggctgcctgtgagttctttccaaagcttcccggcggaagccttggctgctgactctgctcggtccacaggaggctaacgagccggcagcagagcctgatcctgagctacgccgaggacgagacagatgtggaggggacggtgaacggcgtcaccctcaccagctctggtaaggagtctgaagactacatggtgacacgtgggggcctcagagccccccagggtatggacaattcagggcagcatgttggggtttccacttcgggttcttcatgaagcctttaaaatgtgcagttgaaagaggggggctgtgggcggggacagcgggcagggagccgcagcccccagtccaagcttcgcctcctctctctgtgtgtgtttctgtgctgaggtgagagcaccagggcacttcctgcaggcagctctgcgtgtctcagacccagtgttctgagttctattcttggttctgccacttgccctgtgacctcggacaaatccttccctgagagctcctggcaaaagcgtaaggagagagcatggattggaaggatttgtgcacttcccacctgggacactccgccaggatttcagagtgtcttaaaacaacagcagccacagcagtggagccgcagtcagcagactccgtccgccgctttagagcaggactccctccaagttatctagccgtgaacagatgcaccatttaccctgagctcagacatcgtgctagcgagtggctgtgttagggatctgtcaccagaacacctgctgtgggcgctgagacaatggcaccccagctgcagcccctcttcccatggggtctggggcctctttcctgggactcctggctcagggcagggcaggctgtgcccaggggtccttggttcaggcggcatgtatttcctcctcattgcatcattttgtttttgtttggatcctgggtggagttctcagaacttgagcagccttagattagtgcatggtaattcgtagcaggtgtttggagctgggggccgattttccaataaagtggaggatttggagctccaggggcaggggcaggggctgggatggaagtccctggaatttcactgagctcctgttgctcccaggggactggaattcctctgttaaaaagcagctgccggccgggcgcagtggctcttgcctgtaatcccagcactttgggaggcaggggcaggtggatcacttgaagtcaggagtttgagaccagcctggacagcatggcgaaaccccatccctactaaaaatacaaaaattagctgggtatggtggtgcatgcctgtaatctcagctactcaggacgctgaggcaggagaatcgcttgaacccaggaggcagaggatgcagtgagccaagaccacaccactgcactccagcttgggtgacagtgagactctctgaaaaaaaaaaaaaaaaaaaaaaaaagggcctggcgcggtggctcacgcctgtaatcctagcactttgggacgccgaggagggtggatcacgaggtcaggagtttgagaccagcctgaccaacatggtgaaaccctgtctctactaaaaaaaaaaaaaaaatacaaaaactagcggggcatggtggtgggcatccataatcccagctactctggaggctgaggcaggataattgcttgaatccaggaggcagagggtgcagtgagccaagattgcaccactgcactacagcctgggtgacatagcgagactctgtctcaaaaaaacaacaacaaaaaagcagctgccacaaaactctgtagcccaaccaggttccaaatgtcacttattttaatggtttggtacatatactgtgtatatgtatactatcttttgttcttgttgtatctcttgaactaaaatagaagtggtaatagagtagctattccccggaactctaatcagtgcacctgtggcttctccttcctcaaaccctacaatcacataacatgcgagattggttccatagacagctgtccttccctcctcccgcccatcagggtagcttgaggtgtgctacggccgggccctgggtgggttcgtgggtgttgcttactctgttggaggttgggtattactggtcaccagttgatgttttgaccctctctctgatactgtaagttgaaagttgattccgccacccactgagatcctttgtcacttccatggttacttgtcctgatcactcagcctcactcagctgttccctcactcagccaggatgtcttctcctgtgtgcaagacactgtcagctcttccttttaaagatcttggtgaggccggatgcagcggctcacacctataatcccagcactttgggcggctaatgcaggaagatcacttgaacccaggagttcgagaccagcctgggcaatatagcgagactctgtctctacaaaaaatttcaaaactagccaggtgcaaagtagtatgcacctctatcaccagctacttgggaagctgagatgagaagatcacttgagccttagtactcaaggctgcggtgagtcatgacagcgacactgtactccagcctgggtgccagggcaagactctgtccctaagcatacaccgtcacatgtcagtctgctgcctgtgggtggttaagtctctcattatactgtgaagacagttagttttgcatccacatatgacagtattacaggacatataattctcatgtcctaagaacttaagcaacagtgggatttatttatttatttgaggcagagtcttgctctgtggcccagcctggagtgcagtggtgcagtcatagctcacggcagcctcaaactcctggactcaagtgatcctcccaccttggcctcccagagtgttggaattacagacatgagccactgtgcctgaccagcatagtttttgatgcgtttagtatcttaatgtagctgctgaaaaccttaagagctgaccccggtctcccagaaagaccatggtgtgcttagagactcagcacttgcagggataaacaggtccatcttctggcgaacagagagggaactgggggggcttgcaattactatgtgactttttgagtgagagacacagtatggctccttgttgttctttttttttttttctttttttggagacggagtctcactctgtcacccgggccggagtgcagtggcgtgatctcggctcactgcaacgcactctgcctcttgggttcaaccaattctgcctcagcctcccgagtagctgggactacaggtgcatgccgcccctggctaattttttgtattttagtagagatgggtttcaccatgttcgaggccggtctcgaactcctgagctcaggcaatccgcctgccttggcctcccaaagtgcggggattacaggcgtgagccactgtgcccggccttttcttttttgagactgggtctcactctgttttatgtagcctccctcaccccttcccggggacctgtggccccaaactttggacctttcactagcgaaggcaccttcttacttagactgaggcctttactcttttatgcactgtgcgtggcctaggtctctgagcacattaaaaatgagctctacaattaacatgccaagttcaggtctatattctaactcacaacaaaagtgtgcactccttgtctagtagttggcaaatctgtaacacgtttgtgtgagaaagtacctctagatggtgtcagcctgggccctaaagaaattgcagcacagcttccctaggttgagagcatttaggttaggtgccccaaatggggacaacttgctcagggagatagactgctgatgtgagggatgagatggagtgcctgtgacaaaggattgtgcgtggccgtgactcccacatgggctgttctgcagggtctttgcgcacacagcagcatggaatctggccagttggtctagagtagggtttttcttggcagtcattatttaccttcttatagccaacagcatggtggttgagtctcagctttggagtcagactgcatgggctcgcactcagtcctccctcccgcttgttggctctgtggccttgggtaaaccctgtaacctctctgtgcctcctttttttgttttttcatctgtgaaatttgcctgtaaggaagtgtatggcctggcctgggaggtgcctggcacttgactgtgtttttgtcactgttgctcagatagagacagctgtcatagtccgtctctatttcttgtttccctgctgtgggtccttgattgaaagagcagttgggagaccctcaggctctgagtggcctgttcacctcagtcgtctgcaaggtgaggcatcctgtgccatcttaggagtggcccccactcttcttgaggtggcacttggccgcttcttgaacgtgggcccctgggtggccaggcgggggtaggtgggccctgggatgtgactgtggaagtgcaggcccatgacgccagttctttctgctgtttgtgcccaggtggcagcaccatggatagctccgcaggaagcaaggctaggcgtgaggctggggaggacgaggagggattcctttccaaacttaagaaaatgtttacctcatgatatcccagccgaggtaggaaaaccctggaggttttttttccctttgttttcctctgtgaactaatcctggttttctcccactttaaccaatattgtgcccccacccccaggagttggaacaggtgccagtccaaggtgtggtaaacctagctccactaggagctggcctctcagcctagggaatagatgacgtggcaatcagcctgtagtgcaggactggctgggctgccgcggccagcctctggctgtgtcttcttcctggggaggtggcgatgctggggctgttgtacagcccccctgcagtggtgggtccggcttgcccatggtcacagagggcgagtcaggcagagccaggcctagaactcagatctcctcacgtcctgcctgcttggaagctgccctcctgcgtggacagcgcagggctgtgcaagcctgggggctgctccaggggtagcgcttgctcgccgtgtcatcttgggacccactttggtttattatgctcatctcagcaagtggggttctcgcccctctcttggcacagctgctttccagggattaacagacgctccccacaggggtgtgttcccttgaaatgttgagtataaggtaacagcctatctctttggctcaggaaaaagatccactggaaactaggccgggaagcagcagcccctccaagggccagggcacctgggagacgggaggattccagaacagcagcactgagctcccacccgcagagcctctggacggccttggcaacagcaaaatcatgggacaacacctctctccacggaaaggtcacagtggacagcccgggcagtaggatgcagccccagaggctggtggcagtttcctgtccattggtaggtgacggcccctggctcaggcagagggagatggttagactcttgcagggctaaaactctaatttggaattgaatattgtggatatcttagttaaaggccatgcttacagcttagaaatgaagccttaagctgcatcaagttacgaagtgattaatttccttctcagcaaacctccgggaggttccagaatgagttcttcctgacaggttgtcttcactgggagcgtggggcccccaggccccaccagcaccgtcctcccctaatgaggggccctgccgaggcatcagctgctctgctcagttagtttttattcccggggtaccaagcagctgcacagtcggtgcctgggaggcacgtagaggcccagagagtccctgggggttctgctctgaccgtgtgggtggtgatccttgtcaggatgtacagtccttgctcccaccccatccgggatggccgcctgtccctgactattgagtcctgttgttgtaagccaggcatggagggctcctgcccttctgctgagccacagcccattgcagcactgtgctggccagacttcagctgccttgggaactgaagccctgccactgttgctagtcaggggcttggttctcccacttacactgttgacatctattttctgaagtgtgtttaaattattcagtgctaatcattgttttttcctttgtaaatgttgattcagaaaaggaaagcacaggctaagcagttgaaggttccccaccattcagtgagagcagaacccccattccccagcctctgctggtagcatgtcgcagtttccatgtgtttcaggatcttcgggctgtcgttagacaggttaatgaagaacacttctcaacagtttcctttttgttttcctttataattcactaaaataaagcatctattagtgtctgatttaggaatgtaaaatgattctgtattaatgtaaataagattatctattgcaaaaagatatttcaaacctaaattgtggtcatttcttctttgaaagaattcagacagcctctgcaggtggcttatgggggttacaggagacttggctggcctcatcctgtgctcacagccacccagagcacatagaggcagatgggtctggggtgccgacagtgctgaccctcacttggattccagagcagggtgcttgccatgacacaacagtcccctgtgagtgaatgttctagaatctggatgtgacttttttcttgggagcccatgctgtgagagctggccaatgtccctgggtccctgcatttcagtctccctcactggattgtttcccttcattctttccagtctttgcatcttttacattcaattttattttattttttttttaaatggagtctcgctgtgtcgcccatactggagtgaagtgataccatctctgctcactgcaacctctgcctcctgggttcaagcgattctcctgtctcaggcttctgagtagctgggactacaggtgcatgccaccacgcttggctaatttttgtatttttagtagagatggggggtttcaccatgttggccaggctggtcttgaacttctgacctcaggtgatccgcccacctcggcctcccaaagtgctgggattacaggtgtgagccaccatgcctgaccaaaatttttatgtattatagtttggctactctgggttcccagccacgctctatgcctggcgtggctagaggggccctgatacacagctcagtccactctggcactctgggctgagcagggtgagatgagagtctgtttgctgggtcaggtggagaagagactcgggaaagagctgacggacaggagaggctcagcagtgacattctgctcatctcagatacttcccagtattttcatcaatgaaatactgattgcctgcctactgtggacactcagtatggaccaggccctattctagttcctggggatacagcagtggggagctagaccgtgtctcttgtgaaagcttgggcttattcctggaacagtcaccctgagtctcattcatgtcctattgcttcaaagcagaagtctagagaaagactttggaagagaaaggtggattttcttgctaaacagaaaccattgttgtgttgaagcatccttccctcaagggattagaggtggctgtgcatgaccaggcgaggtggctcacacctataatcccagcactttgggaggctgaggcgggtggatcacctgaggttaggagttcaagaccagcctggccaacatggtgaaaccccgtctctataaaaatacaaaaaaattagccaggcgtggtggcacatgcatgttatccaagcttctcaggaggctgagacaggagaatcacttgaactcaggaggtggaggttgcagtgattggagatcatgccattgcactccggcctgggcgacagtgcgagacttcatctcaaaaaaaaaaaggtggccgtgcaacagctgtagaattcagtgctctttctgggcctgggtttggtttatttccacttgtgctcctgatgtatttgttaccagacttctttatagcttctgagtagtagtatgtatttaaaaatataagaaaagggccaggcatggtggctcacgcctgtaatctgaacactttaggaggccaaggagggaggaatgtgtgagcccaggagcgagagagtgagacccccatctctacaaaaaaattctaaaaaattagctgggagtggtggcttggcacctgtagtcccagctacttagaaatcttgaggtggcaggattgcttgagctgaggagttcaaggctccagtgagctgtgatcatgcaactccactccagtctaggtgacagagccagaccatgtctcaagaaaataaagtatttctaggcctgtgagcctgtgggaggtacatgtttggcacttgcttaaacattaggagggtgggccgggcgtggtggctcacacctgtaatcccagcactttgggaggccaaggtgggcggatcatgaggtcacgagttcaagaccagcctagccaacatggtgaaaccctgtctctactaaaaatacaaaaattagccagacttggtggtgggcgcctgtaatccgagctactcggcaggctgaggcaggagatccgcttgaaccctggaggtggaggttgcagtgagccaggattgcgccactggattccagcctgggtgacagggtgagactccatctcaaaaaaaacattaggagggtggacaaggccagctctcaggcattggtcctcagccccattcccacctcaggcctgggactgggttgtttccaacctgagccccctcctcactcatagtcctttgggttctggtggcctggcctttgtttccttccctgtcaaccaaacagtgtgcaagaattctctccaggcccacaggcctccagctgcccctgcccctctgtgtttgtagcactgcagagccggctctgatgtggaggacggcagctgcacggctcctggaagaggcttgtttcacactcttgcttgttaataaatactgtgcaggtcttatcttttaactagaagttctgcttatttctcatgactcttcaagggtcacaaatgggccaggggggaacataaaaggcgaagtgggtccatagttatatggccaagggcatgatccacagaccttagcttactggtcacctcccccgatgctgctcctgtccccatttatttatccttcctgttttgttttttgcagcccttatgtcaatttgttttttgggttttgttttgtttttgagacaggctttcactctgttgccctggctggcttgtggtggtgcaatcacagctcaccacagccttgacctcctgggctcaagtgatcctcctaccacagcttcctgagtagctgggagtacaggcacatgccaccacgcctgccaccatttcttctgtttttttgtttttgaggcagagtctccctctgtcgcccaggctggagtgcagtggtacaatctcggctcaccacaacctccacctcctgggttcagctgattctcctgcctcagcctcctgagtagctgccggcacacgccaccacgcccagctaatttttgtattttttggtagagacagggttttgccatgttgaccaagttggtttcgaactcccaacctcaactgatccacctgccttggcctcccaaagtgctgggattacaggcatgagccaccacgcctggccctagtttcttttgtatttcttttttttaggtagagatggggtcttgctatgttgcccaggctggtctcgaactcctgaactcaagccatcctccacctcagcgtcccaaagtgccggaattacaggcgtagatacataactatttattgtgtgtttctatcaggctctcccactaaatataagctcctcaaggcaggcagcataactttttttgctacattgtatttagggcccagcatactggtaaattgtcaaagaaatgcttcagtcaatggatagaatgaatttttgtgcctgggggtgccagagccagggtggggaagtaaaaaaataaaaactgtgatggtagtcacacaaacctaaatgtgttgaattgaaattcacagaactgctgggctcagtggctcatacctgtacgataatcccagctactcaggaggttgaggtggaaggatcacttaagcctgggaggtgaaggctgcagtgagctatgactgtgccactgcactccagcctgggcaacagagcgagaccttgactctttaaaaaaaaaaaaaaaaaaaaaaaaaattggccaggcgcggtggcttatgcctgtaatcccaacactttggaaggccgaggcgggcggatcacgaggtcaagagatcgagaccatcctggacaatatggtgaaaccccgtctctactaaaaatacaaaaattagctggacgtgatggtgcatgcttgtaatcccagctactcgggaggctgaggcaggagaatcacttgaacccaggaggtggaggctgcagtgagctgggatcgtgccactgcaccccagcctgggtgacagagggagactccgtctcaaaaaaaaaaaaaaaaaaaaaaatcggagctgccatggaccacaaactctcaggcaaataactggtctctcggcctctgaccctcttctctgtgacccaccccagcaagcaaggtgggttgtttctccttcagttttgcttcccagcagtgtccaattactgtgcgttgtggaccacagctctgccacatccgattttcctttttccaacctgtttgaagttcacctgtgtccaggatggtaccccaaggccggctccttccaggacaaggatgaggagagaaagggagaagcccatatctcccccgcctccctgcagagcctgtctccagttcacatgtgcagatggcctcactagctctggagatgaaaggggtgtgtcagaagctcggctcctggggctcctctgtgtcctgtgctatgtccccgtctgtgaatgaatttcaaatgtgggaacagaggctgctggtcagagctgttctgctagctgaggtcagaacaggccacttcacacctgtctgactaaacacgtttaggtcactcgtcccagtcaccaagtgatcccttcagccttggaccctcccttactgctgtgttggtacagccctggagccaccccttactgctgtgttggtacaaccccgggtcccctcacttactgctgtgttggtacagccctggaccccccccccccgctccaacttactgctgtgttggtacagccccggaccctccccaaccacttactgttgtgttggtacacaactaccaccccaacccaagtcctggaagcagagtcctcttctcctggaagccatctgggagaacaatggctttattcagatgttggtgcctctgcccctctggtgcccccgatccccacaaggggccgcgaggcgggcaggtcacagcaggttgaagtcccctttgtgctgttccagccactggtccagcgtcagggccttggggttgagtctcagggtcagctcgatgtcacggtcgggtctcagggcatagaaacggaacatgttggccaggtcccgggcaccgggaaagccaagcttttcgtagtcctcaggagtcatctggaagcagaggagcctgtcgtggccggcgtcctccagtgccccgggaggtggcggggcagggaggccggatgggctggggtctcccgacctgctacacccagagccactattgtctcggtccctgacccaggtcctccgtacaaggtcatttgaaaacttctaagagccgaaagttcagaaactgctgctctcctgagctgcctgacattgtagatcagtttaaagattgttcttggccagatgctgtggctcatgcccgtaatccctgcactttgggaggctgaggcaggcaaatctcttgaggccaggagttcgagaccagcgtggccaacacgataaaaccccgtctctttcaaaaatacaaaaattagccagcctggtggtaggtgcgtgtaatcccagctacttaggaggctgagacaggagaatcgcttgaaaccaggaggtggaggttgcagtgagctgagatcaccccactgtactccagcctgggcaacaagagtgagaccctgtctcaaaaatgaataaataaaaagactattattttcagatcatgagacgaaaatatctcagtcccttccaaatcagagacctgcctgcatcactttctttctcaaaaaccaaagcttgaccagacacagtggctcacacctgtcatcccagcactttgggaggtggaggtgggaggatcgcttgagcccaggagttaggcccaccacgccgggctaattttttgtatttttagtagagacggggtttcaccgtgttagtcaggatggtctcgatttcctgaccttgtaattgcccgcctcagcctcccaaagtgctaggattacaggtgtgagctaccgcgcctgacccaactttcgtcttttaaggactccagtgtttcccagattcttttttttttttggagttggagtctcgctctgtcgcccagtctggagtgcagtggcatctcggctcgctgcaaactctgcctcctgagttcaagcgattctcttgcctcagcctcccaagtagctgggattacaggcgcctgccaccacacccggctaatttgtttatttttagtagagatggggtttcaccctgttggccaggctggtctcaaactcctgacctcaggtgatccacctgcctcggcctcccaaagtgctgggattacaggcgtgagctactgcacccagcctcccagattctttaatgagtatgtcttactttcctaatggtaatgacaaacattagaaaccaggtacccaagagtctgtccagtaggcctcctgcccacccagccaggccaatgggggcaggggtcggccctatctttctagcctctttccctttaaatcccctcccacaggggaggggtcgggtctatctttccagactcttttctcttcaaattccctcccacagaggagcccggcagggcctgcattttcacccctccttgccttggctcctatggccctctcctcctggaagcttttctctctatttggtcaaaacatctaagccagaaatttcactctgtggccagttagctcctggaacagcagaaaataaacgttgacgatgaacgaatgaatttagatgtactgcccagaggtgtgggcagccctggacacaccctccctacgggagctagaaagccctgacaaggatgcctgagtcacctggggcgggaggcccaccttggcatcgtgcacgaccttgcgggtgtgcttggtgagcagggcagcgtactcctcggccgtgtgcctgcaagtgctcagcccgatgttctggccgacgtatttttctggcatcttcaaaaggctgagcaccacaggacccaggtcagacacggacatgccatccatgggaacgtcacctgtgggcaagcctgtggggcagagacgtgagctggtatatgtcccgagggcagacaggggcagggacagagcccctctccaaagggtccaagctggttcttcccagcagtcagctgcacactccagcactcgggcatagctaagacaagtcttgctatttgtggtagcacagaggcagcagtggaattgagtcaggaaacgggatggaatccgggtactgccacctagggcaggctgttgaggctctctgagcctgggttgctgcattcctagaatggggctaagaacctgggcctgcccagctctctcagcgctaggatgacagagaagggacaaaggaaaaggactctgaaagctgctacagagagtgtggctggagcccagggtctccgctaatctggaggcaccagcctgaagtactctgtcatatcctagattcctggaagctggaacgtccacctctgagtagatactccaaataccaactcacttaccaggaatcctgattaaccagacaccaacggctggcctagagcagcacgtccatgataaatgcttcataaatcctgaatgaatgaatgactcgcaaacttccaggctgaggttttgtagatggggaggctggcaactgtctgggtgtggcctgtggaatgcttgggtcctatcctccttacctagagacaggggccagtgcagcttcctgttcagatcacctgggagctcgagggcacagagcgcacagaccggagcaggagatatccctgactgcaggtttttttttttttttttttttgagatggagtctcgctctgtcgcccaggctggagtgcagtggcgcaatcttggctcaccacaagctccacctcccgggttcacaccattctcctgcctcagcctcccgagtagctgggactacaggcgcctgccgccacacccggctaagtttttgtatttttagtagagacaggggtttcaccaagttagccatgatggtctcgatctcctgaacctcgtgatccgccctcctcggcctcccaaagtgctgggattacaggcgtaagccaccgtgcccggccttttttttttgagacggggtcttgctctgtcacccaggctggagtgcagtgccacgatctcggctcactgcaacctctgcctcctgggttcaagcgattcttctgcctcagcctcccgagtagctgggattacaggcgtgcaccaccacgccaggctggctaatttttgtatttttagtagagatggggtttcacaccatgctggccaggctggtctcaaactcctgaactggtggtctgcccacctcggcttcccaaagtgctgggattacaggcgtaagccactgcgcctggccagctttgcaaactataataaatggtggtaccaaagggctactgttaccaccagacttggcccgccaggtgagcaggactcccatgggctgggcccttatgcgagggtgacctggcattcaaccagagggtaaggagtggccagccagaggcaccaacccctcctgccctgatcactgagtgaccagcaggacacaggttgggtgagccttgttcccagccagggccagtgcacctaacctgtttatagccccaatgggcactgagaagaaagagctttcctagtttgtgaaatctgcaactgaacttcattttccaaatcctctcctcgtctttggtttttttgttttgttttgttttgttttgtttgttttgagacggagtgttgctcttgtcgcctaggctagagtgcagtggcacaatctcagctcactgcaacctccacctcctgggttcaagcgattcccctgcctcagcctccctagtagctgccagtacaggtgggtggcaccacgcccagctaatttttgtatttttagtagagatggggtttcaccatgttggccaggctggtctccccgcctcagcctcccaaagtgctgggactacaggcataagccacagcgcccggccctcctcatctttgaaggagaactgacaatcactaggtcctctctgtaaagccttccaatggaccaagcgaatatcgtgtcaccaccatctcagcagatcttgccacccctgcaaacattggtatagagcccatctcacagaacaggaagctgaggccccgcaagctgacaggatgtgctcagtcctgggcctaacgtgagggagccacggcttgaacctggcaccacgtgacagcggcccgcggtctgttacaccaacggctttacagggtgagagctctgcctcaccgtgtgcgagaaagggcacttactcagcaagtagctctttccgtctggggctttctggggcaagaagtgggagaggaggttctcaaaatagcagggcagccgcacactggtcatgggaacgccaatgtcccggaaatattcctccacctcccctttgccgtcaaagtgcgcggcggccaatctccctgccgtcagcttcttgatgttctccaggccgctgtagaccacatagtggaggcccaggcgcctggccagatcagcgagcagcttcccctggagggcagggaaggagagatcacaaggctcagaagaaggatgtctgtccctggtcacagccccagcattctaatcccggagcggccaccatctgcgaggttaacatctagaccccacttacccttgaggaggccccctctcctggaatgatgttcacacatgacaccacgcccgtaaacacagccccggaagccttctaccagccactgactctggcccaccatgtgcaacataggacgggggggcaggtcggctgcagggggacggcctgcatggaggtctaaaggagaatgcacacgtcccatctctgctggtgtgagaacaccctgcccatggagctcagccatcttccttggagagccctgggaggctatacagaggcaccacagctgcctaggttcaaatcaggctctgccatgtacgagcagtgtgaccccagagaagtgatggcaccatcctgacctcgctggtaaaatgcagatgacaacactacctactgcatgaggtgacgcagagattcggacggtggcctccaaaaagatatgccgcatcctcattcctgaaaactgtgaatgtgaccttattcggaaaaagggtcttggcagatgtaattacgtgaaggatcttgagatgggaacatcctgcactaactagataggcgctaaatccagtaaccagggtacttataagagacgggagaagagacaacacctggagaaggccatgcgaagagggaagcggagattggagctttgtggccacaagcccaggaacacctggagccatgagaagccagaaacagtgaagaaggatttccctcaaaccccttgttttgttttgttttttaagatggactctcactctgtcacccaggcaggagtgcagtggcgtgatctctgctcactgcagcctccgcttcctggattcaagcaattctcctgcctcaccctcctgagtcgctgggactacaggtgcccgccaccatgcctggctaatttttgtattttttgtagagacagggttttgctgtgttggccaggctggtcttgaactcctgaccttaagtgatctgcccacctcagcctcccaaagtgctgggattacaagcataaactaccacgcctggcctccaagactctggagagagggtgacattgctgacaccttgattttgaacttctagcttctagaatatcagagaatcgatttctgtggtttttgtttttgtttttgagacagagtctagctctgtcgctcaggccggagtgcagtggcacaatcttggctcactgcaacctccgcctcttgggttcaagcaattctcctgcctcagcctcctgagtagctgggattacaggcgcccaccaccatgcccagctaatttttgtatttttagtagagacagggtttcactgtgttggccaggatggtctcaaactcctgacttcaagtgatctgcccgcctcggcctcccaaagtgtggggattacaagcatgagccactgtgcccagctgatttctatggttttaagccacgtggattgtggtcctttttcgtgacagtaccaggaagcccacagggaatcatcaggattagaaataagatctgctgggctgggcgcagtggctcatgcccgcagtcccagcactttgggaggccgaggcaggcggatcgcctgaggccgggagttagagaccagcttgaccaacatggagaaaccccgtctgtactaaaaatacaaaaaaattaccagggcatggtgacgcatgcatgtaatctcagctattcgggaggctggggcaggagaataacttgaacccaggaggcggaggttgcggtgagccaagattgcgccattgcatgccagcctgggcaacaaaagcgaaactcggcctcaaaaaataaagaaagaaataagatcagctcagggccgggcatgtggcttacgcctgtaatcccagcactttgggaggccgaggtgggcggatcacctgaggtcaggagttcaagaccagcctggccaacatggtgaaaccccgcctctactaaaaatacaaaaattagttgggtgtgctggtacacacctataatcccagctactcgggaggctgaggcagaagaattgcttgaatctgggaggcagaggttgcagtgagccgagatcaccccactgcactccggcctgggcgacagagcaagactcagtctcaaaaaaaaaaaaaaaaaaaagatctgcgttaatcagagaagttgtctttgtctgctctatataatgggcttctaggtaagaccataattgaagaaagggtcaaggctaataacaagtttggatgggtacacgtggacatgaaggcaacaacagacactgggaaccacgggagggagggaggcaagggttgaaaacctacctactgggtactgtgcccactacctgggtgacaggtccagtcacaccccagacctcagcatcactcaatataccaatgtaacaaacctgtgcatgtacccctgaatctaaaataaaagtggaaattactttttaaaaaaaacttctaacatttttgattaaaaaaaaaaaaaacaaacgaacaggccaggcgtggttgctcacggagactgagacggcctcaaacaaacaaaaaaaaagtaattggatgagaaagcaacagcgtccacctgcttcacagcctagagcaggcagaggcatgaagaagagggaaaggcctgcagtgctccaacctccctgcagagtcggagctcctcccaggcgctctgctcctagcctggccgggcctccctgcagctcctgcctgccctcacctgcttgacctcctgctcctggctgcagctctcccagtaattggtcacgatgaaggtggcgtaagccccattcagggccagctccatgatgacctggtcatcttggtctccctgcactacttctgcaccttgcagcctcagctcctttgctgccttcttcctagggtttcgggtcaccactcgaaccttgaatgtcccatcttccaggagtgtgcgggccacggagccaccctgggcacctacaaagaatcaaaaagacctctcaggtcagacctacctgaaagtcccactgaagggcgaaaccccgaagggagtgctccaccacagcaaggagcatccaggaaaccttctcaacgacgattctcattcaggtatttttattttctttattttatttttttgagatggagtctcactctatcacccaggctgaagtgcagtggcacgatcttggcttggtgaaaccccgcctctatcaaaaaatacaaaaattagctgggtgtgaaggcacatgcctgtactcccagctactcaggaggctgaggcacgagaattgctggaacccaggaggcggaggttgcagtgagctgagattgcgccactgcaccacagcctgggtgacacagcgagaatctgtattaaaaaaaaaaaaaaaaggccaggcatggtggctcacgcctgtaatcacagcactttgggaggccaggccgagtggatcaccaggtaaggagaccgagaccatcctggctaacacagtgaaaccctgtctctgctaaaaatacaaacttagccgggcgtggtggcacccgcctgtagtcacagctactcaggaggctaaggcaggagaatcgcttgaacacaggaggcggaggttgcagtgagcccagatcacgccactgcactccagcctgggtgacaaagtgagattccctctcaaaaaaaaaaaaaaaaaaaaaaaaagggcctggtgcagtggctcacacctgtaatcctagcactttgagaggccgaggggggtagatcacctgaagttgggagtttgagaacagcccgaccaacatggagaaaccactgtctctactaaaaatacaaaattagctaggcgtggtggcacatgcctgtaatcccagctactcgagaggctgaggcaggagaatcgcttgaacccaggaggcagaggttgcggtgagccgagatcgcgccattgcactccagcctgggcaacaagagcgaaacttggtctcaaaaaaataaaggtaaaaatatttgtgatgtaataaagtaaaaaaagtagaatacaaaaccatattcaggctgggtgcagtggctgtaatcctagcactttgggaggctgagacaggtggatcacgaggtcaggagctcaagaccagcctagccaagatggtgaaaccccgtctctactaaaaataaaaaaatgaggccgggtgcagtagctcacaactgtaatcccagcactttgggaggccgaggcgggcggatcatgaggtcaggagatcgagaccatcctggctaacacggtgaaaccctgtctctactaaaaatacaaaaacttagccgggcgtggtggcgggcgcctgtagtcccagctactcgggagactgaggcaggagaatggcatgaacccaggaggtggagcttgcagtgagccgagatcgcgccactgcactccagcctggacgacagagcaagactccgtctcaaaaaaaaaaaaaaattagctgggcatggtggagcctgtaatcccagctacttgggaggctgaggcaggagaatcgcttgaaccagggtggcagaggttgcagtgagccgagattgggccactgcactccagcctgggtgacacagtgagactctgtctcaaaacaaaagaaaaaaccatattcagatcttgatgggatttgaattcttcctgaagtagaatataaagccatattcagatacacaaccatattcagatctgctcaaaaacgagacaaagaaaaatagttaacagaaaggaatacaaaaacttattcagatctcgatggagcttgagtcacacaggcatgcgcatcggtcagatgtacccttaagattttgcgcgttgcagctgggcccaggggctcatgcctgtaatccagacactttgggaggctgaggcacgcagatctcttgagctcaggagtttgagaccagcctgggcaacatggtgaaaccatatctctacaaaaaaaaaccaaaaattagctgggcgtggtggcatgtgcctgtagtcccagctaccagggaggctgaggctggaggaaagcctgaacccaggaggttgaggctgcagtgagccgtgatcacaccactgcacgccagcctgggtaacagagtaaggccctgtctccaaaaaaaaaaaaaaaaaaaaattctttattatatgtatattttacctcataattaaaaataatctataaacaaatactgaattctagctaatgttatgcatgctttagtatggaagggcggtgtacacatatctgcaatttacacagaaatgcatcaaaaataaggactgaggccgggcacagtagctcatagctgtaatctaagcactttgggagggtaagggggatgggttttgcttgaggccaggagtttgagaccagcctaggcagcagggtgagacccagtctctacaaaaaattaaaaaatcagctgggcctgttagcgctcatctgaagtcccagctactcaggcgaatgagtcaggaggattgcttgaggcttggaagtcaaagctgtagtgagtgatgattgagccactgcactccagcctgggcaacagagcaagaccctgactcagaaaaaagtgtacaccaatgttccatggcagcattattcataatagccaaaaagtggaaataaatcaagtatccatccactgacgaatggacaaacagaatatagtctatccatacggtggaatattactcagccataaaaataagtaaagctgtcaggagttcgagaccagcctgaccaacatggtgaaaccccgtctctactaaaaaatacaaaattagctgggtgtggtggtgcacacctgtaatcccagctacttgggaggctgaggcaggagaattgcttgaacccgggaggcagaggttgcagcgagcagagatcacaccattgcactccagcctgggcaacaagagagaaactctgtcttaaaaataaaaaagtaaagttggccgggcgcggtggctcaagcctctaatcccagcactttaggaagctgaagtgggcagatcacctgaggtcaggagtttgagaccagcctggccacatggcaaaaccccatctctattaaaaatacaaaaattagccaggcatggtggctcacgcctgtagtccctgctactcaggagggtgagacaggagaatcgcttgaacccgagtggcagaagttgcagtgagcagagatcacgccactgcactgctgcctgggcaacagagcgggactctgtctcaaaaaaaaaaaaaaaaagagtaaagcccggacacacactacaacatgaacaaaccttgaaaacatgctaactgaagaagccagagagaaaaggctacatattatgattttattcatatgaaatgtcccgaatagacaaatccatagaaaccaaaagtagattggagctttctaggggttggctgggaggagtaagaatggggagtaactgttcacgggttcatggagttcttttttttttttttttttttgagatcaggtctcactctgttgcccaggctggagtgcagtggcacaatcaggtcactgcagccttgacctgctggactcaggtgatcctcccacctcaacctcctaggtagctataggtgcatgacaccacgccccactaatttttgtatttttttgtagagacgagattttgccctgttgttcaggctggtctcaaacacctcagctcaagcgatctgcccatttggtccaactaaagtgctgggattacagggttgagccactgcacctgggccagagtttctttttggagtgatggaaattttctaaaattgattgtggtgatggttgtacaattctatgaatacactagaaaccagtgagttgcacactttaaacaggtagattgtatagtacgtgaattatatctcaataaagctgttagagatattaaatatgtataaataagaaaaaataggaatgaaataatatgctatcatttgaaaaaatgataacatgttatctactctggcaggatattcaagaaacttggtaacagcaatagatgaggtggaagaggaggctaggaagaagatttaattttggtatcatgttcaagtactcctattcaaataagttaagtaactcatttttttttaatttggaaagcaggtctggcgtggtggttcatgcctgtaatacctgcactttgggaggccgaggcgggtcatcacctgaggtcaggagtttgagaccagcctgaccaatatgatgaaaccccgtctctactaaaaatacaaaaattagccgggcgtggtggcatgcccttgtaatcccagctactcgggaggctgagacaggagaatcgcttcaacccgggaggcaaaggttgcaatgagccgagatcgtgccatcgcactgcagcctgggtgacagagcaaaactccgtccaaaaaaaaaaaaattggaaagcaatttgggcctcgttcctgcgaccacagccccaacctgggtcgggggtcccagtgaccttacccctccctgcagaccccaggacgggcggtcttcagggctaggcgccctggctctgcaagggccccagtctggggtttggctcacctgtgcctccgaaaaccaccaccagtttcttgtccaccatgaggacgagaatgggacgaatccggtccagagatctgggggtaatgggaggcgtggagttgggggtggggccggggttcccgccaggagcgacaaaggacacccccattgtctatgcatcgagtatgtgtcgaagggggcggctgggcccggagcggcaagacgcctgtcccgagatatcggggtcccgcgacccacctcgtgtcccttgggcccgatcccctcctccttcccgcctcccccggttccagtcacccgccccccggcccgggtcccaccggctggagtgacctcctcgccgcggcctgggcgggacaagttccaggagcccgggaccccgattctgcggccgagtccactgcagaggcggggatggagctgcgcgctaggcgccaactccctccccgcagctccggccccacctggcagagcgccgctcacggaagcccagcgtcggaggacccctggctgcagccgccaatcccgacgtgtcggccgaaacccctcctccggcgcagttggctcctcctggatcccgcgggactcggcgtcgtttccgggtttgcccgccccaggcacgtgcacagtgagtttgtgtaaatccagttagaccaaaatgagcgaggtggagagcctcttaaccggatgctacgggtgatgactgggaggaggagaaaaattacctctttatcttgcatgaacatcttaattttcaggtattgggcgtcaggcaaagataattaaagctatgtccatgagtcttatcccttgaggccttgtccgcttgatattttctttgcctaactcacttttaaaattttattatttttatttttttgagacagtgtcttggtccgtcgcccaggctggtgtgcagtggcgcgatctcggcttactgcaacctccgccccccgggttcaagagattctcctgcctcagcctcccgagtagctgggattacaagcatgtgccaccaagcccggctaatttttgtattttttagtagagacggggtttcaccaggttgaccaggcaggtctcgaactcctgacttaaagtgatccacccacctcagcctcccaaagtgctgggagtacaggtgggagccaccgtgcccagccctaactcacttctgaagttgctgctacttgcactgatttcagtttttttttgtttttgttttttgttttcaaggtggagtcttgctctgtggcccaggctggagtgcagtggtggtgcgatcttggctcactgcaacttccgcctcttgggttcaagtgattctcctgcctcagtttcctgagtagctgggattacaggcaggagccaccatgcccggctaaaatttttttgtatttttggtagagacggggtttcaacatgctggccaggctggtctcgaactgctgacctcaagtgatcttcccgcctcaggctcccaaagtgctgggattacagacatgagccaccacacccggcccacgatttcagtaatttctttgtgttcagtaaaactaaaaaatgactctgggctgggtgcggtggcctgtaattgcagtgatttgggaggccgaggcgggtggatcacctgagctcaggagttcgagaccagcctggccaacatggtgaaacccccgtctctactaaaaatacaaaaattagccgggcgtggtggcaggcgcttgtaatcccagctattcgggaggttaaggcaggagaatcgcttgaacccgggagaagggggttgcagtgagccgagatcacgtcattgcactccagcctgggcgacgagcaaaactcggtctcaaaaaaagaaaaatcattctgtcattctggccgctgtttgaagaatgcgaataatgcaacagggagatcagatacaagactggtaaccgaggtgtcagagttgagactcagtttcgcagattgcattggcaagtgaccaagtgggtggtgccacggttgacaaccctatttcttacatcactgagtggatgtacaaggattaaaccacactggggaagaaaagtgctcaaccctgaggcaccctcacacacctcggctcttgtgaacactagtgttcctgccgaagcacgcctacttaccccgctgagcagagcctgagcctgcaacctccagagacctggggaaagccacatactccgcttcccgcccccggcaagggcgtgtcagctacaaggggcgtgtcatctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggtgagctgtccgcgccctcccggggccttccttccgcccggcttctcggaccgcgctgcgtccttcgcgggccctgcctcggtccaggccttcggacctgggcttggccgggccacagccctttgggtcccctgcgccggtctgaggggagacccggccgggggcggccggaagctgggtgaggccgggcagaaggacgaagaagggcgtggaggggctgtcaggggagggcgaaaccgcggacgccgctctccagaagtcgtctccccgggggcgcggggaggcctgaatggctctctttggcgtccccgttgggcccaccctctcccagcgtcacggctatgctgggcgaggtgacccccggggtcgtagctgggggcgtcggcggtgcagacaggggatgccggcagagattggagcccggcttggctgtttcccgggctgttggcattgaccggggctctgcccttcctctaatgcccttatctctataggaagtgccccttgagtgggtgtcgtgacttcacgagtgaaccctggtacgccctggagcagagtcggactgggagggatcaagtgtgggggcagccggttagtccggacgcgggtttacctattactttctgagcgcagtgctctgggtggattaattgccctgcaaaagctgccgggacctccttgcagtctttgcacgaggcctgcctgtgtcatgccatttaaatcgcgtctgggccgggtcggtggctcacgcctgtaattccagcactttgggaggccagggcgggcggattgcttgaggtcaggagtccgagaccagcctggccaacatagtgaaaccccgtctctactaaaaatacaaaaatcagccgggcatggtaacgtgagcctgtagctccagctacttaggaggctgaggcaggagaatcgcttgaacccgggaggcagaggttgcagtgagccgagatcacgccattgcactccagcctgggcgacagagcaagactccatctaaaaaaaaaaaaaaaaaaaaaaaaaatcgcttctgatgagccggttgtcgtggcctgtggctgtccatccttacgtactgtgttttgttgatggcgctacaaaccagacaaggtggagtgtgattgaagaaagaaacgctggccggtgcagtggctcactcctgtaatcccagcactttgggaggccgaggcaggcggatcacctgaggtcaggagttcgagatcagcctggccaacatggtgaaaccccgtctctactaaaaatacaaaaaagttaaacgggcggggtggcgcgtgtctgtaatcccagctactggggagtttgaggttggaggatcacttgagcccacgaagtggagattgcagtgagctgagatcgcatcactgcactccagcctgggtgacagagtgagaccctgtctcaaaaaagaaaaaaataaattatcacaagacaaaatttgtgcttatcaggagttcacagttaagacatatataagcttacttggtgaaattagaaaaagttatcagataaaacattcaggtttaaacactggtgagggtgtgggaatttgtggagccttggaaacacactcattgaatgacctcatctacctggggatgtgaagagggaaatcctgtgattcctccattgtctgacttgatttccttttttccttggctgtggcaacatgttgaagtgctgtgagtcaccaaaagggggaacgtgagcaactctagaaatgccagtgccagtgagttacagacaataaagcattgaccgcctttagctcacccctcatcaagtctgttgaaaacttgtaaaattggacagctagagctaccttgattttttggtttccttttaacagctgactctcttcacaggacagttgggctctacatcaggattgcacccaaaactggaatatcactcctccaggaggaagatatatttgaaaattagaattgtgggcccggtgcagtggctcatgcttgtgatcccagcactttgggaggccgagatgggcggatcacctgaggtcgggagatagagaccagcctgaccaacatggaaaaaccccatctctactaagaaaaaaataataataatacaaaaattagctgggcatggtggtgtgtgcctgtaatccgagctacttgggaggccgaggcaggagaatcacttgaacctgggaggcagaggttgcgatgagccaagattgtgccactgcattccagcctgggcaacaggagcaaaactgcatctcaaaaaaaaaaaaaagaaagaaagaaaattagaattgtgtatttcactgtaaaatttgaaattcagctttaactccttggaaaggaaagagatgaaaaacttgacctagactgggtgcggtggctcacgcctgtaatcccagcactttgggagaccaaggcgggtggatcacctgaggtcaggagttcgagaccagcctggctaacattgtgaaaccccgtctctactaaaaatacaaaaattagccttgcaaaaagtagcctgtaatcccagctactcgggaggctgagcaaggagaattgcttgaacctgggaggcagaggtttcagtgagccaagatcatgccattgcactccagcctgggcgacaagagcaaaacttcatctcaaagaaaaaaaaattctatcagagtgaacaataagtaggatgctagcacatacctgtaatctcagctacttgggaggctgaggcaggaagttaatacttgatgagcctaagtttttggtgtctttggatgctgcttgtcgatctaaggggtttccaaacgcttcttttttggtaaaattgggattatgactaggaatctgttttttggagtttcccaggtgatccttgtttggggtccttgtctaaggcacaggctggaaagaggagggagtggactggcagggaagatagagcagtaagcgaatagaatacctggggaaagggacgccagaagagtgattgttgtctggtgaactgtgctgtcagtgtgtatgtcagaagccaacaaagtggatattctcttcactcagcttagggaaaaaattaatttttgtttcacagatagattcgtttccttcccaggagtattataggcctaattactgtcatagttctcagtaactttaaaaaggctgtggggaagaatggcataacagactagtatcttgtacccagcctgcctttttcttattctattttttttttttttttttttttttttttttttgagacagtcttgctctgtcacccaggctggagtgtggtggcacaatctcagctcactgcaacctccgcctcctgggttcaagcgattctccagcctcagtctcctgagtagctgggattacaggcgtatgccaccatgcctggctaatttttgtatttttagtagagatgaggtttcactatgttggccgggctggtctcctactcctgacctcaggtgatccgtccaccttggcctcccaaagtgctggggttataggcatgagtcgctgcgcccggcttttttattttttattttttatttttttgaaacagagtctggctctttcacccaggctggagtacagtgatctgatctgagctcactgcaatctctgcctctggggttcaagcagttctcctgcctcagccttccaagtaactgggactacaggcatgcaccaccatgcctggctaatttttgtacttttggtagagatggggtttcgccatgttggccacgctggtctccagctcctgacctcaagcgaaccaccctccttggcctcccaaagtgctagtattacaggcgtgagccacagcacccggccttttttttttttttttccttagagtcttgctctgtcaccagggctggagtgcagtggcgccgtctcggctcactgcaacctctgcctcctgggttcaagtgattctccttcctcagcctccctagtagctgggattacaggtgtgtgccaccacacccagttaatttttgtatttttagtagagacggggtttcaccatgctggccaggctggtctcaaactcctgacctcaagtggtccacccactttggcctcccaattagaattagaggtggagcgaccgtgcccggctaagggcctactattttttttttttttttttgagacagagtttcactcttgtcacccaggctggagtgcagtggtgtgaccttggttcactgcaacttccacctcccaggtttaagcgattctcctgcctcagcctctggagaagctgggattataggcgtctgccaccacgcctggctaattttttgtatttttagtagagacggggtttcaccatgttagtcaggctggtctcaaacttctgatgtcaggtgatccacctacctcggcctcccaaagcattgggattacaggcgtgagccaccgcgcccggccaggcctcgtatttttgcttttgctcatgttttcatgtctgagatagagggcctactattaaagcactgtgctgaggctgcaagaaggtactagtgtgattaaaacaatctggtccgggcgcggtggctcgcacctgtaatcccagcactttgggaggcggaggcgggcggatcacgaggtcaggagatcgagaccatgctggctaacacggtgaaaccccgtctctactaaaaaatacaaaaaaaattagccgggcatggtggcgggcgcctgtagtcccggctactcgggaggctgaggcaggagaatggcgggaacccgggaggcggagcttgcagtaagcagagatcgcgccactgcgctccagcctgggagacagagcgagactccgtctcaaaaaaaaaaaaaaaaagaaaaaaataaaacaatctggcattataatgccatcctgattttagttaatctagttgactggctggcctcataagtagctgtgatgatcataatttttatgcgaaacacctgtcattgagcatacaggtgtactgaaagaattgggtggaacagggtatttgaaatcagaattgttctggaaagtcgggtacataaagctctatctttagcacagttgtctgtattgcacaattaatatttatagaatggtacaccttatgttatctttttatttttccacctaactctctctctagattgaaaggtacttgacgtgcagagcaagatcttatctttctttgtagtcacagtactcaagagggtgataaatgtttgttgatgataatgtaatgtcacctgtccaagtgtagccatcatcttcagtagttacttgatctgctgttgtgtctggcaagactgctatgtgctgctgcagaggagccattgtcaccttgaactatctctgtggcagtctggaggagggcaggagggagaagggaaggaataaatgagcaaagctgagtgtggatagtagtgtttgacggcagatgaaaaagcaaacttggtgaagtgtggcctgggtggtcatctaacttctacctagaagacattaaacctttactctcttctttttatgtaggaaggcagagggaaagtcaggccttcggttggcttggtaatagcaggtatcccagtaattagaaaataacttaaaaaactccattcctctaccatatacttgagaatttgtcaatctcagcaaaattttcaaatgtctgtgttcagtgtcatatttgtcctgctctgtaagactttttgtgtttataaaaaggcaagtggacccagaaggggaaaaatatgctgttctgagaaactagctgctgtaggttatgcttttctgtctttgcttgtggctcttctggttatttgagaaaggcaaaaaaacccaaagtcttttttctactctgttcccacagtcactcaacacaacacttctgataccagatatatgggagttgtttccccatacaccaagcaattctctagtagacacaccggtgcggtgtcctctaagtcagttaaattctgatactctatctggagatagcgtcagatcccaccaattgagggctcagtcccacaaaactgtcccaacttgaggcactagtcacaagtagtaaattgtcacctatacttctgacctactagctataaatcgaaagttctgacaatccctcctcgagtttgattaatctgctagagtgggtcacagaactcaggaaaacactttacttacatttaccaatttactctaaaggatattaagaaggatacagatggctgggcgtgctggttcatgcctgtaatcccagcactttgggaggccaaggagggcagatcacctgaggtcaggagtttgagaccagcctgaccaatgtggtgaaaccccatttctagtaaaaatacaaaaaaattagccgggtgtggtcgtgcatgcctgtagtcccagccactagggaggctgaggcaggaaaatcgcttggaccctgggggcagatgttgcagtgaaatgagatcacgccaccgcactccatccagcctgggcgacagactggaagaaaaaaaaaggatacagatgaatagccagatggaagagatgtatagggtgaggcatgtaggaagaggcatgaagcttctacgccctctctggaactttcgtgtattcagctatcctgaagctaatgcaaaccctggtgtgtgtgtgtgtgtgtgtgtgtgtgtgtgtgtgtgtgtgtgtgtgtgtgtgtgtgtgtgtgtttatggaggcttcattacaaaggcataattgaatacgttattggccactggtgatcaactcaacctttagaccttctcccgtcccctgaggttaagggggtagggctgaaagttcccaccctctaatcacatggttggttccccaggcaatcagcccccatctaggagcccaccaagagttacttacttacaacaaaagatgctcctattacccaggaaattccaagggatttaggaaattacaaaagttttaggagctctgtgtcaggaactgaggttaaagaccaatatcagaatgaaggattctcctagtgcccccatctacaaaggttttaggagctctgtgccaggaacctagggtgcagatcaaatatatctataaatctttttgtttgtttgtgttttgagacagagtcttgctgcgacacccaggctggagtgcaatggcgctatctcggctcactgcaacctccgcttcccggattcaagcgattctcctgcctcagcctcccgagtaggtgggactacaggtgtgcgccactatacctggttaatttttgtatttttagtagagacggggtttcaccatattaaccaggctggtcttgaactcctgacctcaagtgatctgcccacctcagcctcctgaagtgctgggattacaggcatgagccgctgcatccagcctcaaatttatctctgtatcttcttctaaattacagtatcacacccgtgcatatgcccaaaaatttttttttttttttttttgagacggagtcttgctctgtcgcccaggctggagtgcagtggtgcgatctcggctcactgcaggctccgcctcccaggttcacgccattctcctgcctcagcctcccgagtagctgggactacaggctcccgccaccatgcccggctaattttttgtatttttagtagagacggggtttcaccgtgttagccaagatggtctcaatctcctgacctcatgatccacccaccttggcctcccaaagtgctgggattacaggcgtgagccactgcacccggcctcatatgcccaaattttaaaggaggcaccacattcaagtccaaatgcctaaaggtagaaggatcaagaaacagtagtatgaggccatttgagaagtatatatagttatccctcagtatctgtggagattagttccaggacccctcaagggtaccaagatccaggatgctcaagtttcttttcttttcttttttttttttttttttgagacggagtcttgcactgtcacccaggctggagtgcagtggtacgatttcggctcactgcaatctccacctcccgggttcaaatgattctcctgcctcagcctcccgagtagctgggattacaggtgtgcaccaccacgcctggctgatttttgtatttttagtagaggtgaggtttcaccatattggccaggctggtctcgaactcctgacttcaggtgagccgcctgccgcgggctcccaaagtgctggtattacaggcatgagccactgtgcccagcttaagtttcttatataaaatggtgtatagaatttgcatataacctatgcatatcttctgtattctttaaatcatctgtatttataatacccaatacagtgctatgtaaatagttgttatactgtatcgtttaggtaatcatgacaagaaaaaaaatctgtacatgtgtagtacatatgtagccatctgttgttttttttttccctgaagattgattggttgattgagacggcatctcactctgtcaccgaggctggagtgcagtggcgcagtcttggctcactgcaacctccacctcctgggttcaagcgattctcttgccttagcctcccgagtagctgggattacaggtgcctgccacaacccccggctaatttttatatttttagcagattccgggtttcaccatgttggccaggctgatctcgaactcctgaccttaagtgattcacccacctccacgtcccaaagtgctatgattacaggggtgagccaccatgtcaggcctttttctgaatatttttaatctgaggttggttgaatccactgatgcagagcccatggatatggagggctgactgtactgtattgagcttctaaggtatgcagagtattggcactgaggggatgtgcaaatacaacaacaaaccaagcatagtctttgtttactaggagctggtagtaactgtgggaagacacaaaacagtaaaatcactttgtaaggtttatgagagttttgagaggccagggaagttaaagagtggagaaatggagaaaatgggagaacttgtactgaacccattaggacagaggaggaagggaagagaaggaaggaggccaaagaaagaagaaacccttcttagagcactcagggtcttactgaaaactttacccataaaaagagaatgtcactgatagactccttttagaacagggattgatttttttgtttttgtttttgtttttatttttgtttttgtttttgagagaagtctcgctcttgtcccccaggcttgagtgcaatggcttgatctcggctcactgcaacctctgcctcccgggttcaaacaattctcctacctctgcctcccaggtagctgggattaaggcacctgccaccacgcccggctaatttttgcatttttagtagagacaaggtttcaccatgttggccaggctggtctcgaactcctgacctcaggtgatccacccacctcagcctcccaaagtgctgggattacaggcttgagccaccatgcctggccacaggcaacatttttaaaccatacgattgtcctggagagagaatctgaagccttgctctgattctgaaagggatttgcaaccaaaaaaggataaggattgttctgacaagtaccctttcttcccatcttcaaaagtacacatctcttaatttgtgtcttcaaacacaaattgtgttcaaaaaaggaagtatttgagtagattaaagacagaaaccctaggacattcctttgtaaacaaacagccttttaccaaacaccaactgtcaagggacttgcctgagtacttgtccaaaggacagcgtgtccccatgtgtaggcagtggtctaatctggttcctaggagaggactgctgaggccacagcaacttaactggctagtgtgggtgaggcagaagtgtttgaagctcaaggtctgtcaaggacagctgattagagtatgtctgtccctaatacagggttagagctcagtaccaatgctggggatgaggtgagttgaagacacagaaactacatggttttttggaaggtcacgaacttttcaaggaactagtgggcaactggaaatgatatgtgaaagagtagagggagctctggcctagctgccagaaaactctgggcaggtcaggtctgggaacagtggctaatccaggcccagcttcccactgttgatttggacatacaggcctaagataagagaccgtgcccagagccactggtcacttagcacaggtagtgggaaatggtagccagcaaatgtttaattgaatatcttatgtctcctagaccacagctgagcaaactaggccaagctcaaggtcctgaggggaatgaggagctgagctcagtcccttttggccccctttctctttccctcctcattttaagtatggaagctcacttatttcctttttgtattggccatttgtgtagggttttgtttgaaaaagggcttgaggctgggcgtggtggcccacgcctgtaatcccagtactttgggaggccaaagaaagattgcttgagcccaggagttcgagaccaacctgggcaacatagtgagaccctgtctctacaaaaaaatttttaaaattagctagacatggtagtgaatgcctgtagtctcagctgctcgagaggctaagttggaagtatcacctgagcccaggagttgaggctgcagtgagctctgattgacccagtgcacttcagcttgagcaacacagcaagaccctgtctcaaaaaaaaaaaagaagttgggcacagtggctcaggcctgtaatcccagcactttgggaagcctaggtgggcggatcacctgagatcaggagtttgagaccagcctgacctctaaaactacaaaattagccaggcgtagcccagcggctcatacctgtaatcccggcactttgggaggccgaggcgggcggatcacctgaggttgggagtttgagaccagcctgaccaacatggagaaaccccatgtctactaaaaatataaaattgctgggcgcagtggctcacacctgtaatcccagcacgttgggaggccgaggcgggtggatcacaaggtcaggagatcgagaccatcctgtgaatggcgaaaccccgtctccactaaaaatacaaaaaattagctgggcgtggtggctggcgcctgtagtcccagctccttgggaggctgaggtgggagaatggcgtgaacccgggaggcggaggttgcagtgagctgagaacaccagcctgggagacagagcgagactccgtctcaaaaaaaaaaaaaattagccgggcgcggtggcatatgcctgtaatcccagctactcgggaggcagaggcaggagaactgcttgaacccgggaggcggaggttgcggcgaggggagatcacgccattgcatgccagccttggcaacaagagcgaaactctgtctcaaaaaaaaaaaaaaaaaaaaatgtagccgggtgtggttttgcatgcctgtaatcctagctactcaggaggctgaggcaggagaatcacttgaacccgggaggcagaggttgcagtgagctcagaccgtgccattgcactccattgtttcgctgcaacgagagggaaactccatctcaaaaaaaaaaaaaaaaaaaacaggcttgagtatacctctcacagccctggagaatgcctgagctgttggacagttgccttttccattatgtctgcttttttctaaagctattcattcattgttgcctaatcatgtcctcagtcagtagttgatgttctgggctatttgaatttcctctgaataatgattaatggagataatgatgtttgaccagttctgggaactcttgggaattaaaggaattaaactcttggacattaaacttcactttaatgtgtatagttgtgggtgctgccccattggagaagattgtgacaggaagttacacagttttacagcaaactgctgggattttttatttttttttcagtaaattatgataactgtagcattttcctttgcaataatgataacctaaggccttggtgtttcctctaaaatgtacatagatacaggatgtgggtttgttacaaagttgtataactattgcctttttgtggctgaccccttccctagagaacaacatgaagagaccttgctgctgctatgaaacccagactctaaggacaacttgggggacattggatattttttcacagatgtagacatcaaggagtcagtggtttgtgtatgcgttgagtggagaaggctggcaagcatttgctaccatgactgttaaaaatgtgcctgtacatttctttttttttttttttttgagacaggatctcactctgtcacccaggctggagtgcagtggtgtgtttttggctcagtacaacctccaccattgtgggctcaagcaatcctcctgcctaggactcctgagtagctgggatgacaggcatgtgccaccacgcccagctaatttttgtagtttttttgtagagacagggtttttgccttgttgcccaggctggtatacatttctttatataaggagggggcaagtaacacagtgttatgctaccaatcaggctttcagagaccataaaacaaaatctaaaaggtacgctcttagtagtcatatctgtggaatgtaaggaagccagtttaagaccaatgtaatgcagcattttcccttcacacatgaaacagtgagttactcgagcacaaagcatcaaatgcttattccccccacaaggccattcttatctttcaccaagtgtttagtcactaggcagccatcatcctccctccctctctcccttcctcccttactttcttcctttcttccttttgcagtggcacagtcatgggctcaagtgatccgcctcagcctcgcgagtagctgggaccacaagcactcaccaccacatccagctagttttattttatttttaaaaattttttgaaacagagtcctgctgtgtcacataggctggagtgcagtggcacggtcttggctcactgcagccgccacccccagggtcaagtgatactcctacctcagcctcccaggtagctgggactacaggcatgtgccaccatgcttggctaagttttgtattttttgtagagatggggtttcaccatgttgcccaggctggtctggaactcctgtactcaagctatccacctgccttggcctcccaaggcgctgggattacaggtgtgagccattgcgccgagcctcatccagctaattttataatttttggggggaggtagcaacagagatctccatatgttacccaggctggtctgaaactcctggcctcagtgatcctcctgcctcagcctcccaaagtgttgggattacaggcgtgagccaccgcgcccagcccattattcttatatctgagattcacctttaattgccctctgtcatcagcactttgagaatgcctcaattttgagaataccttgtattctggaaatcattcattcagtcaacaaaccctgactggtgtgtaattgggcagtaggaggccaagataaatgacctgtaatctggaaaacaaacatataaacatacacataccataacgagatatgagtgctaggatggatcacaaaaggcttacttaggtagctctgaatataatatcaggcctacaatattatcacttatgttgttttttggatcttatttttagaaacagcacaagctttttcttggaggaaatatagcaaggaagaggggagctgttctgactgaagcagggtatgggaggcccacagcctttcctgctttgcctcctgttcaaagccatcctccctgcagttcactgagaaatgactccttggagctccaaggaagtcctacagctagctagtagcagacctggtagtagaagttagttcttctgattcttagctttcttagcagtcaggtaccagactgataaacgaaaatcaaatttctcccagttatatgttccatcccacaaagaagtaataaacacatttctgtcaggggcttcagcctgcctggatttgttactgggtttgttttaaatgtttagcttccaggcatccaaatacatacaaaaaaggtctattcccaggaacatactgtaacccttttcattgtcatttgtgggcagtgccaagctgcctctaatagcttcttctgtttttttggtggaaattcagtttcctcagaaatctatataagggatatttgataaaggtgactaacaatctcgtctctgtaaattgatgaagggatgagaggggtattagactcatgtcctcttttgaatgcacactgcttttgtggtccggcagggtttctcagcgttagtgctgttgacattttgggctagattgtttgtggtggtggggtatgtgtgtgtgtgtgtgcgtgcgtgcaagcacatttgtgcgctataggacattgagtagtatccctgacctctacccactattgtcagtagcacactcccgtctttcagttgtgacaactaaatatgtctgcaaacatttccacgtctccaaacatgttccttgggggacaagttggcccccagtggagaaacactggattggagattggttgtcatgtgataaaaatgcaaatcagatttgtcacaggacaaagtaaattttcagttacctaattaaacctttactttttataagtcgctctaaagaaacaaaagtgtgtcctgtcttccatcctgattctcggttactggagggcccttcacctaagtcatgttcaggatctccttgaaggagttaaactaaaacaatacaatatcttcccttaggtcttttgcagaatttattttgctaggccgggcactatggcccactcctgtaatcctggcactttgggaggccaaggcggctggatcacttgagttcaggagttcaacactcgcctgggcaacatggtgaaaccccatctctacaaaaaataccaaaaaattagctgggcatggtgttgcatgcctgtagtcccaggtacttggggggctgaggtgggaggatcacttgagctcaggaggtcaaggctgcagtgggccgagattatgccactgcgctccagcctgggtgacaaagtgagactctgtctcaaaaaatatatatattttgctagaaatcccaagatttttctctcttttctttttgtttattttctttctttttttgagatggaatctcactctgtcactcaggctggagtgctgtggcatgatctcggctcactgcaacctccacctcccaggttctgagaagctaggactataggcgcatgccatcacatctggctagtttttgtatttttagtagacgcagggttttaccatatttgccaggctggtctcgagctcctgaccttgtgattcacctgccttggcctcccaaagtactgagattacaggtgtgagccactgtgcctaacccccatatactttcaaacaaaaaatggaaatatcactgtctccatgaaaagccatacaggcagcatcaaaactacactaggggccaggtgtggtgcctcctgactgtaatcccaacaatgggagggtgataggattccttgaggctaggagttcgagaccagcctgggcaatatagtgagaccctatgtctacaaaatactttttaaaattagcatagtggtgcgcacatgtagtcctagctacttggaaggatgaattgggaggatcgcctgatcccaggaggtagagactgcagtgagctaatatctcaccactgcactccagacacagtaaaaccctgtctctaaaaaaaaaaaattaaataaataaataaatggtttacactgagggtcacagactttgagttgaggttcgtcatgaagaatctccattttcattctaatagcactagatacaggctgggtgtggtggctcacagctataatcccagcactttgggaggccgaggtgggcagatcacgaggtcaagagatcgagaccatcctggcgaacatgctgaaaccccatctctactaaaaatacaaaaaattagctggatgtggtggcacgtgcctgtaatccctactactcgggagtctgaggcaggaaaatcccttgaacccaggaggcagagattgcggtgatccaagatcacgccactgcactccagcctggcgacagagtgagactctgtctcaaaaacaaaacaacaacaacaacaaaaaacacaaaaaaggctgggcacagtggctcaccttgtaattccaacactttgggaggccgaggcgggcggatcacttgaggtcagcagtttgagaccagcctgggcaacatgggaataccctggctctactaaaaatacaaaaattaattgggtgtgttggcacatgcctgtagccccagctactcagaaggctgaggcacaggaattgcttgaacccaggagtggggagaaaaaggaaatattaggggacatttgttaagtttatatttttttcttttctcttctttttcctctttttttgagacagagtctcgctctgtggcccaggctggaagctggaattcagtagttcagtcatagctcactgccgcctttacctcctaggctcaagtgatcttcccacctaagcctcctaagtggatgtgaccacaactgcatgccactccctccacccccgtctgcctaccagctaattcaaaaaaatttttttttgtagagatggggtctccctgtgttgcccaggtcagtctcaaactcctaggctcaagcaatcctcctgccttggcttctcaaagtgctgggattacagacatgagccactgggctcagccattaattttaaattgcaagtgacatattctttagtttattaatcagcaccatatgatgtcacagttttataactcatttatctcatttaattctcatacccaccttgtggaattgttatcactgtcctttacagatgaagaaagaaactccaagaaattaagtagctggcccaagtccacccaactgggatgggcagaaccagggtttgctcttggttgtgcctttctacagcctgtgccttaaccacatctatgtgctgcctcttggcctctgtgtggccagtagattctctcatggctaggctcatcttaattaacatttgttgggtgcctactatggctcaggctctagagatcattgtaaaatccagtccactgccccagctcctcgtgtgtcttttgaacacattagtattgtgctgtgcagaaaggacttctgtgcatatgcctgctattacacttgttgaacccaatttctacaaactttcattcagatggagggattcagtcttcttatcatataatacatacagaaatacaaatatttaaatatttatctaaattaatagtcacatatgccatttatacagttagtgagttacagccaagtgacagttgtgatgggaggctgtgtctggggagttacatactggtgaggaaactagaaaacatggctgtcgggccggcactgtggctcacgcctgtaatcccagcactttgggaggccgaggcgggtggatcacgaggtcaggagatcgagaccatcctggctaacacggtgaaaccccgtatctactaaaaatacaaaaaattagcggggcgtggtggtgggcgcctgtagtctcagctactcaggaggctgaggcaggagaatggcatgaacccgggaggtggagcttgcagtgagccgagatagcaccactgcactccagtctgggcgacagagtgagactctgccacaaaaaaaaaaaaaaagaaaacaaggctatgaaaatttaacacattgactgggcagggtaatgcatggtgatctgttttctcttcgctccaatcctgaaaggtttctttgaagagctggagtgtctagaaagctttcctagaaagctagtgtacattttgctaagtaatcactgtgtcacttagattttctgctctttaagtgtggttatgagatgtgttccaaacaatttgttactaaccatgaagttgatgaatgctttgcctttaaaaaaataagtttgggtggggtgcagtggctcatgcttgtattcccagcattttgggaggctgaggcaggcagatcgcttgagtccaggagtttgagaccagcctggacaacatggtgaaaccctgtctttactaaaaatacaaaaattagccaggtgtggtggcgtgtgcctgtagtcccagctgctttgggggctgaagcaggaggatcacttgagcctgggaaatccaggctgcagtgagctatgatcacaccactgcactccagcctgcgtgaaaaagtgagactgtctaaaaaaaaaaagtttggccaggcatggtggttcatacctgtaatcacagcactttgggaggccaaagtgggaggattgttgaggctaggaggtcaagaccagtctcggtttgattgggttaaacattatccctgtaagttggctctcattctgagaagttgtttagagtagaagagagggctgcatttacagctaattgctagtaatttcacatcatctgcaatatattttctggacactctgcccgactagtcctatgggacgttgtcattcatgtgcaaatcaggccctatatactaagggaggaaaacagttgaggacctcctttttttaggcactcttggtgccttgtgcattaagatagtgagtcagaggataagaaggaagcagattccattccccttaccactctttgggtgtaggcagggcctgctggtagtgctgggaaagccgaccatccttctttgagcaagtccaatagctgctgctgctagttctgtcccaccataggcacagtctatgtaggatgagccaaccatatgtggagttactggttcttggtctgggcttgttcctttccccaatttcagtccccaccagaatctgggcagtcattgtgaagaagcctaggaataataccttactctataggcctgtggaaacgtgtaaagataccttgcaggcccagagtgagaaattggagccaccttgttcgattgaccaaaggcttgtcctatggagttactaattttacaggaagtttatgttaacatactttctatccattgcactaccatttctgaggcacaatatatttcagtaggcagaaagatagaactgcttagattttaaatactcaatacatgcttgacacagtttagtctatttctcttcagttactatggcagtgggtgctatagagatgtgcagaccctattgtgacctccctttggtatagggatgctctggagcccctggcttcattgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggtgagtgttttagggacaagcagcatcaacttcggaatcttcaactgggcctgagcacttatttctcagaaataatagaatcttgctcacttttctttctttttttttttttttttagatggagtctcgctctgttgcccaggctggagtgcagtggatcagtctagctcattgcagcctccacctcctgggttcaagagattctcctgcctcagcctcctgtgtagctgggattacaggtgtgcgccaccacgcctggctaataattctatttttagtagagttggggtctcaccatgttggccaggctgctctcgaactcctgacctcaagtgatctgcccgcctcggcctcccaaagagctgggattataggtgtgagtcaccatgcctggcctcttgctcacttttcatactaaaacaacaaattacaggctgtagtttaacctctctactgcatgcataaatgcagtgtggtacgagtgcctctgtagcccataacttcagtttccttgttgctagcagtctgtggtgacactatactaatctcacatgcaggaaccaatgaggattagccagggacacaggaggagtcaccttgcattcagaatgactcaagtttagtctcaacttgaccattagctctctgagtgatcttgcccatgttaattctcttgatcttagtttcttcagagccagtgagacattgcttgaaagtgacttagcctggtatacccaggtctgtcagacttatagtctggtgctctcttgggtgaacttgagggccttctgccaaggcaggaatggcttcttttaaaaaaaaattattttattattatttttttttttgtagagacggggggtctcactatgtttcctaggctggtctcaaactcctggactcaagtgatccttcagcctcggcctcccaaagtacagagattataggtgtgagctaccagtaccagcctccaggaatggcttctaaggcttcaggctgtttatagagaggaaagcacctgggagctgatggcactctcaggtttcccaaaatgacagttctgcatatgcatcttaatcacctactttttttccctccacccccaaatgctattcacagtccttgtttatgatagaagctgaagcttacaggtgacaatttttgtgcctgtatgaaaggaaacatgactgactccacttatccacacgacacctgctttcaaggttgttcagtgttggaataatttttgcttgatggtaacctagggatgacccaaggtttcattagttaaagccagccctgtgggatgcatgaagtctagcctctgtccctgtaaaaatcccaccagaaccattttagaattcactcaggacttcacccctcccgctcctggtgctgcttatggaactaaagaatcctcatcttctcagccctgggacacattgtcctcatataaagcgaggtggcaatcagggaacaggggcgagtcttgtgcttatttcagttataataggaaggctctaccaggactcatcattgtcccaacaatagtcgattccaggccccttctttgaactcatttcagtgtctcaggttctgtccttggtgtctgtcttcactgcttgctcagttgtatttgaacatggctagagatgagcacacttctcttctccagtaaaaaagcctgcaagaaaagtcttggacttcttgaactgctattcagttgtcttttttattcaatgtattttttgagatggagggggtctcactttgttgcccaggatggtgttgaactcctggccacaagtgatccttctgcctcagagttccaaagtgcagagattacaggcttgagctaccacaaccggtctcttgtcagtttttgaggttacttaagaggttaatgcctttaaattagtttgcagttgttttgcttttgcctgccttcttgcccaaatgcgcaagtgcttatttagtaatctgactcaagtgctttgtgtccccagagtccccacttttccaggattcattgtctttttttttttttttttttttttgagacacagtcttgctctgttgtgcaggctggagcgcagtggcactgtcggctcactgcaacctccacctcctaggttccagaaattctcgtgcctcagcctcccaagtatttgggattagagtcacacaccaccacacctggctaatttttttatatttttagtagagatggggttttgccatgttggccaggctggtcttgaatgcctgacctcaggtgatctacccgctcggcctcccaaagtgctgggattacagacatgagccaccacacccggctggattcagtcttaacttgctctttttttttttttgcatctcactcccttgccaggctggagtgcaacggtgtgatcatagttcactgcatccttgaactcctggggtcaaaagatcctcttgccccagtttcccgagtggttgggactacaggtgtgtgtcaccacgcctggctaattattttatttttcgtagagacaaggtctgactgtgttgcccaggctagtcttgagctcctaggcttaggtgatcctcccaccttggcctcccaaagtgtcaggattataggtgtgagccactgcacccagcctggatttgctcttttatcaagaggttaatatttattcttccgttcagtgaaccgtgggattgaattcccccagcgattgaaatgaaagggcttatgtataacatttcctgaggaatggtagtaccagagttcagaggagacctcaggccatttattctataaactcagaagctgtagttctagatgatgtggcttcttcagggtgttgagaagtctctgttatctcgtgccttgttggattagaactgattgagctctgtctgctgccccaaacatgtggctcagccaatctccagtggcatctgcaatgtgggtattctagcctccagtgctcacgtggctcaccttagaaagggcagatattcctatttcctgacgctgctggagaatgaggtctgagtcagaagtcctcaggtgtgacctgcccagaactatctgaaattgctggatttcttgttcttcctcagtgtttaacaatcacccaattgctcattctcaccagcgacttcctcagtaagagctcaatatttgaggtggtgctgcattttgtcaaacattcatgcgtgttagcccacttagtcttcgcagcacacagtggattaatggatttttaaaagctggtatttatgcacgatggaatactactcaaccataaacaagaaggaaattctgtcatttgtgactacatggatgcatctagaggacattatgctaagtgaagtaagccaaagaaagaaagacaaatggtgcatgatatcacttatatgtgaaatctgaaaaagtcagttatagaaggagagtgtaacatgttggttaccagcggctgggggaagggaagggtgggtgtggaaaggggagatgttgatcaaagggtacaaaatttcagttaggagaaataaggtctgatgatctgccttacagcatggtgactatagttaatatggttaatattataatagtattgtatacttcaaaattggtaaaagagtggattttaaaagttgtcaccacaaagaaatgataagcatgtgagctgatggatatgttaataaccctgatttaattattccccaatgtatacatgtgtccaaacatcacactgtaccccataaatataattgtcagttaaaaacttaggagtcaagtcagatctgaagagaagtcaaaacagatttcatacagttaatttagagacatgggacccaattaaaaatttgtattactttacttggtattttagaatttagctgttattttcttgttacacacacaggcacaggcacacaaatcctctatttaactggctttctcagtaggaactccatctgtgtatttgcaacagctgtaactcaggttggatgctccccagggtgctggcctataagtcatattggaccctgatctgaatctgagggaatctggatctctcttgtaggaagcttttggtttaactgggaagacaggatgacagtcagttgtggaagctgaagcgtaatcacctcatattaatatggtggcaattttatatcggagtgagctctgagctgcaaacagccttctaggaagcaggcaggggacccccatccagggtgatggtaagaatcctgatgcccaactgcaaggtgttcagcagggagggagcactcgtggagtcccagtgcagaagtctctgagcagccacttagcctccctgtgtttgtggggtaacaacccgagttcatgttgtgggcatctcatgcagtgtagtagctggtcactgtcaagtgtcactatttcattgagtcagaagcctgcagaattgttctcattccagggagtgagtcagtctgctgttgcttactctcggtgctggctgagctcagcaacctgctctcttccttcagttcaggtttctccagggcaaagaagtctttattgttcctttctgtatgaccagatgggaaatgaattataatatagtccttagattatattcccacctggtagcaatgcactgagttacctgacctgaaatttgttggacttagtctccatggaggaggatttaccatcttcgttgtctcagaagtcctggtagtgcctcatgccagcaatttagcaggagcaaaagctttgagacagtgttctggatctgctgagctggtctaaaggaacctcttttgcttgaagtaactgtgataggaactttgttactgcttctgttagctcaggtgttggaatgagaatcagcagctgatgaggtgaacagctaggagtactggaattatggagtagtggaggtagattttataaacagagggtcccagttttttggaaatgggaaagagagagggtagactggcctttctagaatttgtaacagaaaagaggacccaggagcttccattgactagttagttaatgcagtgcgggatcttagctggtttgcttggtccaattcctgtctctcggtttcttttttcccttcccttcgctgccttcccctccctcttccctttttctttccaagagaattgagtcactccatataaaagaagcagccagttggctaaaaagtccaacaaaaaacaagtatttatagctctccaaatttcccacttgtcattatcagtatacttttgcacacagttatagtcggtgtttgggatcctttttaaaaaaataaaaagtttctgtaggcttttccatgcatgaacacagcttatcaacttgccccggctgtgccaggattccattgttgactgttgtttgagcagtcatgccctttgttcttaggctgtgtgttgtttttttcctaacatcatagtatggctgggtattattttgatacagattacaattactattactatttcttgaagtgtatttcccagagtggaatattttaggatctttttttctcttttgtgggggtggggaacatgtagcttcttgtggatattagacattgaagtctaaaaaggttctatatttatgatttggccctcaattttctagagattccaatggttcctgcaaagaaaagagcattcaagtatagaaaccagccagactaagtctggacatgtagcttttcagaaagtgaaaaaaaattatgtttctgcagttgcaaggtggcctctgaatgccacactgtgtggccactcccttggacagtggctaggccacagggtcgcctcccctggccccagtctgtgggttgaatatgctaaccgagccttcccaggagcctcctctgcccccagcccccaggtctgtacagatggtagttggtactttcagcccgccttgagaactcagtattcttcctgttagctttccttcaaagtaaaatcggtagaacctattttgagtgtagaaaatttgaagtcgtggacagcagattacaaaaaattgcccaccaccatgcctggctcatttttgtatttctagtagagatgggctttcaccatgttggccaggctggtctcgaactgctgacctcaggtgatctgcccacctcggcctccctaaatgctgggattataggtgcgaaccactgtgcctggctcctttttgtatttttcggagaagcacaaggacttgttgtttaattaagcaagactatactctcccagagcatgcagttattattgagtaaaacacagttaatgagatttaatcacgttccctatcactgttgtgcagcatgataagtaggtgcaaatggcaagaagcacgctgaagttactgcagttggtaacctgggccatggatggcacttgtctttgcctcattttgcctgtaagaagcatggggcctgtggtcctggggtacctggaccctcagcctggtgtgtgtgtgccctcagcctggtcctttacttccatcacccatctagaggctccaggaccctttactgcacccctccctcctctagatagctcagtgttttcatcccagcacctttttctctgctgcctgagaactgagcagccagagacaaattttggctctcagggtcctcaagggtgtacagcaaagctgttcttattatttaaagtattttatttatttatttttgagacagagtcttactttgtcggccaggctggagtgcagtggcatgatctcgactcactgcaacctctgtctcccaggctcaagaaatcctcctacatcagcctcccaagtagctgggattacaggctggagtgcagtggctccatctcggctcactgcaacctccgcctcccaggttcaagcgattctcctgcctcagcctcctgagtagctgggattacaggtgtgtgccaccatgcctggctaatttttgtatttttagtagagacagggttttaccatgttggccaggccggtctcggactcctgacctcctgatctgcccacctcggcctcccaaagtgttgggattacaggcgtgagccaccgcgcccggctagcaaagctgtacttttaccaaaaaaaaaaaagaaaacatttataaatcaaggtctgaaggcccatgtgaggcttattctacagcttgcaatgcctgtttttgccccttggtaagtggacgcacagctgggcagccttatgctatctctgtgaactacccatttctggctttgttcataatattcccttgatctggaggccctcccccagccctgccccaaatcctgtctgtgttgagggtcctgccccaggaagccctctgcatactcttccctgcatgtaatacctgcctgctttcacattcttctagactgtgctgtgcatcgtacagttcatcagcattattgcagagtagagtgtctctgatttggagtcaagagaaggttccatttttctgtacatcccgatgtttattttctgagtgttctcagacatcactaagcctcagtcaaaataaagtatgatcatgatgtaacattcattgagtgcttatcacatggtaggcattgtgctatatgagttattgcttgacttcctaaaataatcccagtagagatgctaaatctaaaggtgagagagatggttcaaaaagacctcagtgagcaaaccatgtactataatatcctaaaagataacaaaaatgtaactaggtatctagagaaaactcaggaaggatatgtgccttgggccttttaaggaccatttcttaacacttctgtgttcttcttgacacctgtttctgggtagagcacatagaaaatgctcagtaaataagttctttttccttggcccagtttggcctgatttggccccagttctgtctttgtgagttactttattagttgtcggtgctactgtgctgctattcatgtggaagattccccaaatgggctgcgccttacattgcctgagcagaagccccgagggatggaggatgagcttgccttgttatgggactgtgtttccctggctgacaaaggctcagcatttgcagcaggcaatgggaattgattggccaacttaatatttccttcagcctagcaaagtcctgagtaggctagggacagtctgcttttttggtaactcctgtaggctgccttctgcacaaggcacccagcctctcacaggtaggatgaactggcctcagcacgcttgcagaggggtggaactgtgcgttgcttgccaagctttttgtttccctaaggtttttgaggttttctttgtttttggtaactttcaattttttttttttttttttttttttggacagagtttcactcttattgcccaggctggagtgcagtggcgcgatcttggctcactgcaacttctgcttcgtaggttcaagtgattctcctgcctcagcctcctgagtagctgggattacaggcacgcgccaccacatccggctaattttgcatttttagtagaaacagggtttctccatgttggtcaggctggtcttaaactcctaacctcaggtgatccacccaccttggcctcccaaagtggtgggattacaggcatgagccaccgtgtctggcctaacttttaattttgatacggtcttttttttttttttttttttttttttaagacagtttcgctcttgttgcccaggctggagtgcaacggcgtgatctcggctcactgcaacctctgcctcctgggctcaagagattctcctgcctgagcctcccgagtagctgggattacaagtgtgcaccaccatgcccggctattttttgtatttttagtagagacagggtttcaccatgttaaccaggctagtctcaaactccagtctgcctcggcctcccaaagtgctgggattacaggcatgagccactgtgccctgccttgatacagttttaagcatacagaaaaatggtaagaatagtacaaagaactctcatacctcttccccagattcactgctaggattttgccttgtttgcttttctgacttgccagtgtcccccaccctgcagcatatgcacatgcacacacactgtcttctgaaccatctgacagggagttgcaggcagtgtacctttacttctgaataccccagtgtgtatttcttaggaacaaagacattctcttatataatcgcagtacaattatttttaaaaaccagcaagcttaatgtcaatacaatgctattacctaatacattgttcatattcagattttttccatattccactatggtcccagtaatggcagagctttattttaaagaaaacaatcctggggtgtgtgggtgtcaccttggttacattcgctctgaggaaagcagaaccgacaggtatttggggaagtgactgccgtgggtgccacatcaccagctccttgtgtctctgcaggaccagaggagcgagagcagcaagaaccacacccagcagcaatgtcagcggaagtggaaacctcagagggggtagacgagtcagaaaaaaagaactctggggccctagaaaaggagaaccaaatgaggtgagcgatgggggctggctgcactgaatcaggtgggcccagcacctgtcgtgctcagcacacctggttttgtctgttggcagcactggggagtggccatgggccatgagctctggacccctgggtgcctgcttggccctgcagggaccgcatacagcttcggctgcttagaactctccccactggtccattgtctcatccaaggaggcagggcaggtgctcctgggagtgctgataggatttgatggtagttatccttttttctttttaaaaacttgtgcgtttcctcatctgggctgagaaagggtaaacgcaggcaaagctggctctgttcagtcttttaccacataaaagactgcagggcagcctttccttactctgtatagggacagctcatgctaaacctgagcttccaggccctgttctgcatcattagcctctcatagccctgtcattggccaagttttttttttatcccttgaaataattgctaataataaattgattctcagcacatggatgataacgagctaatctcctaaagaagacagcagaagccagaccatgataaggccaaatttttctcactcttgtagatggattgtgtggacacatgtaagcccctgcccaagtaccaccatctttaggatcacatgttttctaccttgtccatccatccacacacctttacaactgtgtaatttcgttaagcagcacaaacccagcgtcctggccctagcctctcggttgtctcctttgcatccttccgtgcttggtcctagtcacatatagtctcaaagaagctgtgggtccaaggtgggaggaaggcagtagggccatctgaggagacccatggtcacagccttactgaggtgtgtgaattccagaagacacgttccaaggcaggctgttcttagagaagccagcaaatactgaagggaatacagatgtgtgtctcttcgaccactaggtggccacagaagcaaagcattgctcatttgggtggttcccaacacagacacatggacgtgggtactactctcaaggagcaggccacagttatcccttgtgtcctgagtccttggagcagaatgtcatgtctgcttgtcctgtgttccctgacaagttgctgctatttgtgttggagtgaagtgtctgagaagccccagcctccagtacaacaggtggtcaccttggggtgtggactcaatcttctctctatggtcctttctggaaagctgggaagggctaattgacacacaaacacctcccatctctccacagaatggctgacctctcggagctcctgaaggaagggaccaaggaagcacacgaccgggcagaaaacacccagtttgtcaaggacttcttgaaaggcaacattaagaaggagctgtttaaggtttgtgccccgcattgggttccagactgtcatatggggttggggtgggggccttggtcccatgagaaaagtgcccctggagccactctgagggaaaagctgggcttttctccacactccattccttcttgacgttaagctctggctctcggctgggtacagtggctcatgtctgtaatcccagcactttgggaggccgaggcaggtggatcacttgaggccaggagtttgagaccagcctggccaacatggtgaaaccctgtctctactaagaatacaaaaattagccgggtgtggtggcgcgtgcctgtactcccagctacttgggaggctgaggtgggagagtcacttgaacctgggaggcggaggttacagtgagccgagatcgtcccactgtactccagcctgggtgacagagcgagactctttaccccgccaaaaaaaaaaaaaattggttctcatggcttagatagaataacatagtggtgtgaaggaagcaaaagtatgcgtgttccaaagacttcaccatgccattcctttaagaaacaaaagcttccttgtgtgttaaataattcactacataaaaatggaccataggattgggtctttggggttgggggttgtcacttgagcctctgcatccagctgctcggatgtggtgtgctcaggcatagctggcctcctcctgtcacctccacagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcaggtactattgggggctgccagctgctagggctgaagagggaaactttgacagtggtagcagatccatagtggcccatgaaggcacacatggcattaggacagatgagctgcagggtgccgagaggaaggtggccaccagattggccaccagagcttgtgggcccagtgggtggttcccagcatggaggcctggtgtgatagatgccagtgggtagtgttttgggaagggtgagtcctctcgcacatagaggggtctggaagaatggagctggcttcctccctcattgcaggatgctggtcttgaagaatggttaattttcttttcaagttttgctctgagaagccctgctttataagttaatagagagccagtgccaccaaggagagtaaataagctctgtttacaagtagcctttagatgaggctgaacctggggaagcttactctgtccccaggtcctgtcagcttccactgaggcctcccagggcactcaggatgagtatgccctgccacagtctcattctcccatgttccaggttttctgttgcttcttgataaaaaaataaccagcacctagaaatggggatgtactcatgccctcctgtctgtgctgtggtagtttcagtggcttgagccacctcagagaaggctacatctctggtcagttcccaggggagacccagcatttggcagccttcttggggtaccaatatccacacctccccagagctcttgctagggagggaagaccatcaggcagtgcagctgccgcccaccagtgctgcttgctgtgtagttggcacacctgagcaagctcacctgctccagctcactctctctggagggcgtcctctaaaaggagagtgtagccaggcgcagtagctcatgcctgtaatcccagcactttgggaggctgaggcaggggcattacttgaccccaggagttgaagaccagcctgggcaaccaaggtgagacaccatctccccacaaaatttaaaaattagccaggtatggtggtacacacacgtaggaggataaggtgggaggaccacttgagcctaggagtttgaggctgcagtgagttagccatgttcataacactgcactctagcctgggcaacagagacctcatctcaaaagacatttaaaaaaaaaaaaaaagtatgggcagcccaaagatggctcagtcgatcctctgctcctgcagatattcaatgaactggaccaggccggctccacactggccagagagaccttggaggatgggttccctgtacacgatgggaaaggagacatgcgtaaatgccctttctacgctgctgaacaagacaaaggtaggtctgtgtgtcctgagctcccctcctggggcaggtgtagcaggagactccactgatgccatgtctcctattggtgctgccacacaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagctacctccttccctgcctcctggcaccgggtgggtcaagccacctccccataggagagtccctcagaagcaagggcatgttatgtctgtgtggggagtggacatcgtccatcatggctcccagcagccacctcctgctctgggtctactctccagcacctctagtctccaaagcaaagtcactctaaccgtcttgcaaagatctttaaagtgtatccagcactgctattttttagctcagaaataccttagaggtttcctacttaaaaggtttttttaaaatatatatatatatttaaaaataagggttttaaaaaagcacatatttgtatttaaacaattcattctctaaaagagaaacatgaacttaaataattttattaataggaatctactacctgtaaaagttttatttcaaaaagggttaaaaagtagggaaactctttaaactactgaccaagactgccaccttcataattcagatgagttagtgcagagatggccagggccagaggtcgcccagaacctgcgtgtgcagactgcgctctgttagtcttctgcctgtcagcctcagcccagtctgtgttgcttaagggtgcgcctccccagggctggatgatgctgtgctcaagcctgcgggtaggagggctccagcttgcagatcccatgcgtggatgccatatatagatggttgaaaccagcatcagaggaaggaaggtgaccttacagccactgccgagaccaacgtgtgccctggcccagtcacagctggaaatcccagggctggtctacacccgactctggtttggtttaattaggtccttacgtgttggtgttgtcccaggcagttggcatggcatcagcactgagggtgtgagaccctgaggactcagcctcccgtcctgccagtagactgcctgcagccccaccctctttccctcaaaaaagaaggaagccaggcaagagagcagaggcccagggcgggggagtgaaagggccaatttaatgagaaactacaaactgagactgggccacgattcacagtgacaggaggccatgcagtggcagtgcgagaccaggaaggacagtggcaggatacagtggtccaggtgagcaagttcacaaaccattcaggaaataaagacagggcgaggctggtgtccaccaaggcagttctaccacttgtggctgctccttcctcgtccctagcccagtgtgcctgcaggagcaggtgtgagcaggcacagcaacagcctgtcagctggggtgaggggcccggcacttacagggaagaaaatccatggagaaggctctgcacatccaagcgcacccacaagggggaccctctgccatctcttgcccagttgggatacaccagccaccaggcagaggtcatacccacacgcagtgaggacacagggcagacgggaaggggctaggctcaggggctccttccggccccagcaatacagggttcacagaggcatggcctgaaagggggtctgcacactgactcaaagggacaagttccttcttagctaccagggtctgatcattcacccaggtacagtgtcctctctacctgacaccaggcagctctcgggcactgggacagggtattagacatcctgggcttctatacctgagagttctgagggccagagttggcagttttacttccagccaccatgccccacctctagcaccccagaggcgcaaagtacccagaaacaaacccaggctttgtgaccctgtcctacgtgggcccacctgactccagacaacttacccattctcggcccagcaggtcagaaacgcctgtggccacaggcctggggactaactggctaactgctctggctgctgttggtcccagggggaaagagtctggactgaacctgtaccttgtttggaaacagaggcatcaggaccccagcaggagacccctcccagcttatcttcccgatcacacacaccaagcagaccaacaacacacaagctcattgtcagccccctgccacccactgacccttggccttaaatcccaacagaatttttgccagaagagtcagcggctcaggtagggcagggtgaagaggacaggacttctaggggatggtggcacggctcccagccccaagtgggagcgggaaagtgaccactgagcacagggagcaaagcacagggggccagactgacaggcgggggagtcccgagtcccagctccgttagcacaggcgcttgtacgtgtagatgtaggctttgcagctggggcatgtgtgcgtcacatccttgaagtcattgatgaggcaggggatcaggcagcagcccagatcacatctgaatcagagacagggaagaacaggctgaggcctgctgcggaggaggcagaggcagccagttgaccctggtgcagcccccaccctaccagtgcccacaccacctaccccatgaagcaacagaagaaacccagcacgaaattcatcaagccaatctcgtaggagatcttggtggtgatggcctgctggcagtggggacacaccgtctgcacaggcgctccctcaaagatctctccctgcagcactgtcaccgtggtggcagctcctgaagggaccaggactgtggctgtgtggcccccagggccagggtagggccctggcgtgtagggccctggggggtagtagcccatgggtgggtgggggcctggaggagggtagaaacctggaatggcacagaagatggaggcgagaggtcactggcctgccacctgcaccagacaaagagattggcgcaaagccccacggtccacagcgcccagcgtgcaaggctacgcctcagacctcctaccgccctcctaacgggccagtgggaggccttacagctggggccctaagtcaagtggggccacattctcccagcccttcctggtccccaccccttggggcccatgacagatgtggcagagagccaggcacatggcccggtccctctgctcctctgtctgtctccagcatgcaaggacagggcactcagcctcaagcccatgaccaagagagggaaagccttgcgggtcacccacccctctcctgcacacaaggcgcccctccccacccatgtcaggtcctggtgtgccaaggaccagcccttcctgaccagcctgaataagagcagtcccaccttcccacgtccacagtccctgtccacacacagcctgagccctaggcaagggctggttgggcgtgttggagtccctgccctacagcagatgcccacctgtactgaggacagccagcgcaggccagacagcagccaggagttccccatgctcccctcagatcccttccccactcacccggaggcatgtaggtgccatctgcactcatgtgtggtgggatgaagccaggctggggcattgggtgacccggcggctcatagggtggggggccaatgtccgcagggggcagtggcatgcctggagggggctgcatcacagctggggaggaacggcctggacagagagaggcagaaagaggagactgagctggagcctctgcacgatgagctcgaccagaggccactgttttgggacacagatggggcccaggggtaaccctggagtgggcatcaccacttagagagtcccaaccatgccatggcggcagggggctgcaatatggagcctcaggaacagtgaccccctacctggggtgggcggggctccacttttctcttccagaagtggggctgtggggcccccaggataaggagggggaggctcgctggacatcttcgctgcttctcctggacatggagggaaaacccagacatgaactaagctcccagccaggttccttctccttcagccctgtggggtggccaagatgctgcacaaggcgtgtgaccatcctcagaagggtctgcctccaggcactggggatcccccacctttcccagggccacctagcccagagccaccatcctcacctctcagtagtcacctgctcttccctgtttggaagctgaagggcaaggacagaacccaggaagcagggcccagtgaggtaaagtcccccaaggagcctaactcagcacttgccccacacgagagcagtttggcaccgagctctcccctccccaaacgtttagcgggcactaaggcagtcggaggagacactggaccgatctctgccacaggctgcactgggaatgggggttctgggggatttcttacctcaaatccgtgctactcagagaagggaggcaggtgaggctccttcagctgctggcctggatggacagggaacaggcagggctccgggagctgtttcaggggaaggaaaggcagggccctcagcagggagcaagggctgccaagccagggctgggcccaggggcctgggcataccacacagttcctccccttccacatccggcttctccctagctgtcactctgccatccacacacccgaccacccctccattcctcggtcccgtcgcaggtctgcttcctccctcccccaggactgctggcacccaagggccacggctgggccctctgcctcccctcccaccaggcctgagctcccatgcatgaggactggactgccaggcaagctgtgctctggcctgtgcccttctggtttgtttgttgaggtgggggtcagggggaagaagagtcaagtgaaatcttttccctcatttctgtcaccaaactctctgagcacagctcagaaaggtgggaagcttttgctcttacttagcatcataaaggacttgggaagtggggttcagttaccttagctaaaagtaataaaatgagacaaaaatcagtttcagtggaacaaaaaatacagggaaaggagtgtttcccagacagcccagcacctgcaggggatggagggcacataagtttgaatataaagtttaacaaatcaggggcagggccagaggaaccaagtccaagctcttgggttcaactataaagtaccatggaagtttgaaaactgaaagagatcaaaaagctgttagaagaaaatgcaggcatcaatctttatgaccttcgattaggcagtggtttcttagatatgacaccaaaagcaaagcaacaaaagaaagaaaacttaaagtggatgtcatcagaatgaaaaactcttgtgcttcaaaggataccatcacattttataattcatagatctgataaaggacttgtattaagaaatacaaagaactcaactcaataacagaaagacaacccaatttttaaaaggatttgaacaaagacttctcaaaagacaaatggccaaaagcacatgaaaaactactgagcgtcttttcataagggaaatgaaaaccaaaaccacaaggagaccatttcctatctactaggatggctaaaatttaaaaagacagtaataggcattatgtagaaaaactggaaccctcatacactgctggtaggggacagcccctgcaaaccttttgaagaactgccagcccctgttccccttttgaggaacagtctggcagttcctcaaaaggttaaacctagagttaccagatgacccagcaattccacccctagttatctgcccaaaagaaatgaaaacctgtctacacagaaatttgtacacaaatgttcacagcagcatgaatcataatagccaaaaagtggaaacaacccaaatgtccatcaacaaagtggataaacaaaaccgtaggctgcccagacaatggaagacgattcggctataaaaaggaaggaagcactgacaccctacagcatgaactctgaaaacatgcttggtgagagaagccagacacaaaaggccacatactgtatgatttcacttatatgaaatgtccccaataggcaaacccatagaaacggaaagtacattagtagctgtttaggtctgggggagaggggaaatggggaacatggaatctccttctggggtaacgaagatgctctgaaaccgattgtagcaacagttgaacgattctgtgaataactaaaaaccactgaattgtacactttaaatgggtgaattgaatggtacgtaaattatgtcaataaaacttatttttaaaaaaaatgagggaaaagaaaattagtcctactgcagcccatctccacatgtccctgctggtctgtatgcacaggcacctgtaccttttggttttgttttgtagagacgggggtctcactatgttgcccaggctggtctcgaactcctggcctcaaacaatcctcctgcctcggcctcctaaagtgttgggattacaggcaggagcaactgcgcccagcccataccatataaaaatatagttgctgtcctgacagttttaaatcctttttttttttttttttttttttttgtgagacagagtcttgctctgttgcccaggctggagtgcagtggcgcgatcctggctcactgcaacgtctgcctcccgggtcccagcgattctcctgcctcagcctcccaagtagctgagactacaggcacacggcaccacgactggctgatttttgtatttttttagtagagaagggatttcaccacattgaccaggctggtaaatccttttaatgctgtgtcacacatattccatcttacaagactccgtgaccgttgatattaatattccacaaaatgggcatacttgaccaaaccctattaagacatttaggcaaggccctacttgctgctttcatgaaatacaagagaacacctctgtccaccgctctttcccttttgttagattatctcctcaggctaagcttgtcagagtgagatgactaggtcaaaggacatgagcattttatgcctttttgaaaggatgccaatttatagtgccagttattaattttcatattaaaatgtcacttatttttatatgcatttctttggcaatcaggagacagaacatctttccaagtgttcagaaattacacctcttctgagttgccttattatccacagaagacatggaggcctagaaaaggatggggcggggcataagtctaggaccccagcatgactctcccaccctcctgcctgcacagtgaattccaatggcacagggttaagaaaagggagcagtggccaggtgcagggacttattcctgtaatctaatctcagcactttgggagactgaagctggcagatgaactgaggccaggggttcgaaaccagcatggtcaacatggcaagactcttgtctctacaaaagaaaaatttttaaattaggcatgataatgtatgcctgtagtcccagctactggggaggctgaggcaggaggatcacctgagcccaagactcagaggatacagtgagccatgatcaggccactgcactctagcctgggcaacagtgcgagaccctgtctcaaaaaacaaaaaaaaaaaaaacagaacagggagtagcagcagtgcctcttggggctggtcctggggtcccttgcccaggctgctcctagcctgccaggtgccctcctgcaggggagaagagggcagcctttcatggggctttacctgcgtctggaaaactgctccaatacgttgagttggaataagtgccagcccctgctacaaactcccagactcccagaaaatgctctctggcgcctctgggtggcaccaccgtccaccaagtggcccaacactgtggtctgcagtggtcttgctcatcggggaatggtccaggccctgggatgctctgagcagaccaggaaaataagctgcactgtgcttggtgagtcactgaagcacctgcagatcccagcctgggtcccttgcagggagcacacacacacacacgtgtgcacacacaccccatctctgagaatgcaggtgttgcctttctctggcccatcttttcatcaaagtcaacagatataatcctatgatctcctagagctcaaaaattctatttctggaattccacatacagccttgcccatgatgatagggtgtaagcccacagggcatagccctcctttggtgttcacccaacctgggtacagaaaatgcaggccacagggaagggtctggacctgcacagggctggcttcccctccagctcgatggccacaccagagcccaccttctctttgcccctcaccgggggccgcagggccctgttgctcctccgtgtcttccccacctagggccatgcctgctactcactgctccccctcacccctccatatccacatgcgtcctcctgctgccttcctgaaccccagcagagactgcagggcaggtccttctctaccaaggagaggatctggaaaacagctcatgaagatttcccgaattcaaacacccattctcccagtgccttccaatacaaaatcaaacatgcattcccacaaaaccatgttgtgtagggtgtaataaaaactacaagaataatctttcaatcacacgatcagaagcaaaatagttttccaataaaacgagtactgttcaaattaagctacaaaatggaaaatgtctgatctgaaaatgcagccccagcacctctgctgtgggaaggtgctggtgagggagggggctaggagacctggggatctgcccagttcccaacagaggaggaaggggagacttgcggggtctggggagcccactgaagtcaacttgcagccctgacaaatccaagagaggcttcttggccttcttgctttaaatcttggatttattaattgcaaacaaaataggtgcctgtttgaaaatctttacaagtcaatcacaaacttaatagtaagtcactcctatggaagaccagaggcctctgcaaagtctacccctccacaccctctgggttctgtggcatgtgaaggtgtggagaaaaaacctgtttctcctctgctttcacaccataacaatcaacagaaaagacttctgtggcaaaacatgtgggggtttctccccaataacaagcaagcagtcagttctgcagcggacaccaggtggacgtcttctagtggcattcaagtctgatgctaccgtgtcagatcccacaggttgagggctcagttccatgactgccccccacttctgatcatcgcaattcctagcttgcgacctgcgcttctgacagactggctacaaatcactatcttgggagcggattccttgtaagaggattagctagtcttttgtgggtgcctctccccgcggcccttccaccatgggatgacacagcaagaaggcccttgccagatgctggcagtgccttgatcctggacttcccaagcaccacagttttgatgactgatggtgaggcttaatgggagttgtttgggacatgggaggtggattcctcatgaatagataaatgccctccctggggtggaggagaagcgagtgacttctcactctgttagtccccgcatccttgctggttgtcagaaagagcccagcgcttcccctccccttctcaccccctctctcgccatgtgatctctgcacagagaccccccgtgccttccaccatgaatggaagcagcctgaggccctcaacagaagcagatgttggcaccgtgccatcctataaagcctgcagaaccaggaaccaaatactctcttttctttataaattactcagcctcaggtaatttatagcaacacaaatagactaagacaccagcctccagaactgtaaggagataaattcctcttctttatgaatgacccagtctcaggtattctgttagagaagcacaatggactaatactacatcaagacttgacaagtggtaggttttttttttttttagacagagtctcgctctatcaccaggctggagtgcagtggcgcaatcttggctcactgcagcctccgcctcccgggttcaagcgattctcctgcctcagcctcctgaggagctgggactacaggcatgccacccatctaatttttgtatttttagtagagatggggtttcaccatgttgaccaggatggtctcaatctcttgacctcgtcatctgcccgcctcggcctcccaaagtgctgggattacaggtgtgagccaccgcacttgaccgacaagtggtagtttcttaagggttagttgccacaggaattggaagccttaacaatggtttttttctaatgtgttacattagaagtcattggtgtaccttgcatttggaatgggtcttttacatagacatgatttcttaacatcatgtgtgggtcacctgaaaatacgggttcctgtaatgcagatctaccaatgttgacacatctcattgaacaatatatatttttttaaatcacattgctggtatcactaccaatgtcattaaagtcactaaatattgttaacgctaatcatcatttgaaagcttgaatttcatcactggcaacaaagcactaacaaatatagaaacagcaacatatacaaaaataaaaggtcagttgtttcccttgaagtagcaagttcactttgctcattttcaagaaagtgtatgctaaatatccaaatctgaataaccacggtgtgtgccagttgttctttaagtgaagatggagtccatgaaaaaggcagctagttcggcccacacttcaaatgaatgcacgtgtgcttttcctcacgacagcatcaaactccatttgacatacttcatgtgtgcctcatttcgtcacaaaggatcttaaaaagctgtggactcatgggtcaggacttaataaagttgatttttactgctttttctgatgcaacactggtgtgtgtgtgtgtgtgtgtgtactgtgtgtgtggtggtgaagactcaattacaacaagaccagcacagtgtggtgccagtcttgagtcagtgcaggccccacagcttgtttccgcactgctcctacaccatcaatgtgaaagccatcacaaacaaagaggcatggtaacaaatcatggccgtgttattattaaaacagttctgatcctagccccccgagtggtctcaggaagcccccaggagactgcagatcacatttcaagaactgctgtgctagaggaacccccactagaagttaaggggtgcgtatcagccaagtgcagggctgggacaggacttcacaaccagaaggatcaagagtggcctgcaagtcttggagtcgctcctggggaggccctgagtttgttgttctggcaaggccccaccccagggatgtgcttgccacccggtggaaggctttaaatgaaacaagcagtcaagaacatgggctctgggccaggtgtggtggctcaggcctgtaattccagcactcggggaggccgagacgggaggattacttgagcccaggagttcgaaaccagcctggacaacatggcaagacgtcatcaatattaaaaaaaaaaaaaaaaaaaaaaggcgggggggcccgctctgcatcagcttaattcaaacccagacccccaagacccaccactttccagctgagcgagctgagcctcggtttcttcctctgtaaacagagatgatcatgcctacctctcagggtgggagtgaggttgaagagagactgtgtgtgaaacgcctgcagcagaaacgctgggcctagcacacaatgacgctaaataaatggaaactgctattattatgctttattaggcaacttccaacagggaggaaaacaacaggtattgacgcctctgccatggagtgccttctgattcccaacgaggggtcctggtgcatgttcactaatatgactacaaggggatgcctctaccggattctggagggacttgcaatcaaaaccctccctaagaactcagctcagcagcgttccctcacagcacagctcagctgggccacctgctccacggtaacccgagacaactctttgagaaggcagagacactagcagtcctccaagggccatctctcctggtgggctgtggaaatgccaggggcctgcctgggagtgcccaaggttggcaatgcccctggaaggatgctccaccaatacaccctggtggcaggggctctgcagcagctgctgcccagacacatttctcagagctgggctggcttggtgctgcatccccaggaggtgcttacccacgtggcagccatggcgtcaggacgccagctggcctcagaggggctcctctgtccccaggaggcaggtcccaggcatccagccaggaacagggctttctgctttgctgggaaaactgaaaggccgatttctgccttgcctgcagcttccatgtgctgaataaaggaggtgcccactgctccatgaggggcagagccgaggtaaaagacaaacactctctgtgcttcttgggtctgaaaagagaatggcaaggcccaaaccaggtctggaggaaaaggccaaagcaagaagtgagccagaagcaagcaggagctcacgtgggcctcagggaagatgctctcagtccagatagcagcaccctgcagggacagggcagcgggaaaaggagagcacagaatccccaccaagggtgcaggcctgaaggggacccttccagggaggcttggcccacactaggcctttccatcctgtgacatctccatccaacacacagacggattagttcaaacccaccttggagggcggtgtgagaattaagtaaggcatggatataaaaacttactgaaccactgtaacgggccatgcagcgtgagggtcattaggagggggactgttacttgcaagggatggccgctgaccacgtagctgttccgcctattctcccaagcaccccagggctgggctgaagcacagtctgtgaggtgaccacgtaacagaggccctctaaggggagggcgggggatggtgcttccttctgatagttactcagcacatcctccgtgccagatacaggctggggattaaagacacgtccctggctgggcgcagtggctcacgcctgtaatcccagcactttgggaggctgaggagggcggattacgaggtccagagatcgagaccatcctggccaacacggtgaaaccccgtctctactaaaaatacaaagattagctgggcgtggtggcacgtgcctgtaatcccagctacttaggaggctgaggtaggagaatcacttgaacccaggaggcggaggttgtagtgagccaagatcgcgccactgcactctaacctggcgacagagcgggactccatctcaaagaaagaaaaaaaaagacatgtccctgccttccagaagcttacggtcaagtgaagaggatgagcgttaaataatcacccccctcgccaaaaaaccacaaacacaattacatctgtgaccagtggtatcgagaaagtccagggcacagtagaaggacagcaagatcgccgttctggagctctaacaccatctcttcaagcaaacctgggaggaggtggcggaagagttaatgagaccagcaggcaaagggagggatggggacagcagagggaacagtgagtacacaaggcctaaggaaggagggatgtgcccctgagggtggccagatggcagcctggggccctcacagcgacccagccacagggtttgttccagagctcaaatacctcagatctccaggacaaggatgacaaggccagctggacagtgtcccaggcccttctcctcaggctttaggcttccccaggagacctccggcaccattcagccttgttgcattgtggcacttggaaacaaagacagcggtcttctttgcttgactgtcaatagaatattgggagagcacaggtctccctgggaccctgcctcgccgctgatggcctgcagccctagacaaattcctcaacctctctgagcctcagtttccccacgtgcaaaatgaggttcttggaaggctgaacaaaatcccacatgtagatgtccaggctgtattgctggagacgccttccatgaattactacgcagataccaccacccatacagagctgtgctgtgctcctccacatcacactgcaaaggaagaaggcagaataacaagatctcaaacagcaatgttccgcctaatgaagtacagactggagattgccagctgcacccaaatccactctctcccccattcttgaatacagaactccactttcactcagggcaagtccatcaaccaagagggtccccgagctttcttagagtgacaaagctttggctaatgagctgtaagcagaagtgtccagaccataagaaggcattcagggcaagccgactcagcccggagccaggcccttcatctttcctgccttcctcccatctaccacctggaagatagatgccatggctccagtagctgtgcttcaccatgagggccttgggatggaggccagtgcctaggacagccatgggacaccacaccagcaactaactgaccacctcccacatcttccacatgagtaataaaacttggtttactggttaattattggtaaattattttcaggttaagtattaacaagtgtcattacaaatatacagcacagacaggtgcagtggctcacacctgtaattccagcactttggatgccaaggtgggaggactgcttaaagctaggagttcaagaccagcctgggcaacataacaagatcccatctctacaaaaaaataaaattagccaggtatggtgatagacacctgtggtcccagctacttgggaggctgaggcgggaggattgttctagcccagggattctaggctacaaagagctatgtcacgccaatgcactctagcctgggcaacagagtgagactctatcccccctccaccacaaaaatatatctctacagttccttaggtctgaaggaacacaagttctcttcaagtgatccatgatcaaaaggatcatggctttctttaggtcacatgacacagcctcagccagtacagaggccaaggcatggggaatactccctggcgggaaggctggagcagatgcttccgtagttaaaacaggccccgagagaagtgcagctggttgccttggagcgaggacacattcttctgcaactccagtgctcatttcagcatgagcactggctcaaggaggagctgaggaggacgatggcgtgcagtgaacgttaatagagcatgcactgtttggatgcaggtgcccagcacagggacatgaaggaagtgctccaagtgaggaggtgctcaaaagggagcccctgctgtgagactgctcctgggccccaaaccctctccactcccctctccaccatgccctatccaaacctggggctaatccagccacccaagtccatgtgggaccaggccaggattccctgtggcctttcgcagctgaccagagggaccctattcccaacgctgggtgatgagcaggaaagaggaggccctccacaaaggtccactcagttgcagagcagcctctagtgaggctgagccctcccaagactcagggaggttgccaatgtgtccccttctctgggaccgttgtcctcggctgccaagttctagcacaggcaggcctggaaaatcctgaacatggcccatttcccattgtcctgatggaggcaggacgagacagtccctccctcagataacatcgcgggtggctctgaaccatttatttatttttacacttgaagatgggtgtatctgatgccttgggaattctaaacacttcaaaacaagctcaacttaagtcacagaaaggaccagaaaacagatctggttttcccatctgccagctctcctcccacccaaccctacatgctcctcctcgaccatgatgagtctcagcggaaataagacaccagcctagccaggcacggtggctcatgcctgtaattacggcactttgggaggcagaggtgggcggatcacgagggcagaagttcaagaccaggctggccaacatggtgaaactctgtttgtacaaaaaatacaaaaattagctgggcatgatggcatccgcctgtaatcccagctactcgggaggctgaggcaggagaattacttgaacccaggaggcggaggttgcagtgagccgagatcacaccgtcgcactccagcccgggcaatagtctgagaatctgtctcaaaatataaaaaatagctggtcacggtggctcacacctgtaatcccagcactttgggaggccaaggcaggcggatcacagatcaggagattgaggccatcctggctaacatggtgaaaacctgtctctactaaaaatacaaaaaaattagccaggcatgatggcgggcgcctgcagtcccatctactcaggaggctgaggcaggagaatggtgcaaacccgggaggcggagcttgcagtgagctgagatcgcgccactacactccagcctgggcaacagagtgagactccatctcaaaaaaaaaaagataaataaaaataaaataaaaaataaaataaaaataaaattaaaaataaaataaaaaagacatcagcccaaccccatggccccaaacaccactgcgccctccaacagaagcatgagccctgtgtcgcaggcagagctgcaggggcagaatcttgcaccgagtggggcacaggcatcaggccccacgcccaccaccctgccctgccacctgactctccagtctcagattttttttcatctgtgatatggcggtaggagcagccccttatcaagaattgtgatgagtcacgggagaggccatgggtgaagagcacaccactgaaggcctgccacaggagcctgagagaggaagtacacgagaaaaaagaagacactgttacttttttttttttttttagacggagtctcgcactgtcgcccaggctggagtgcagtggcgggatcttggctcactgcaagctccgcctcctgggttcacaccattctcctgcctcagcctcccgagtagctgggactacaggcgcccgccaacacgcctgggtaattttttgtatttttagtagagacggggtttcaccgtgttagccagggtggtcttgatctcatgatctcgtgatccacctgcctcggcctcccaaagtgctgcgattacaggcaagtgccaccgcacccggtgacactgttgctcttaagcagaagcaaaatcaaaaggcagacaggactcaaagaatggttctaaacctaaaagtactaaggcctctaggaactatgatgatgacaattactgtgcaatttatatcatgctgaattttagtaaaacctcctggcaaaccactctcacttggtgacactccgtccacagcacggggccacagcatagtggatcagtacaactttcctggacagccttgctacctgtacactcttatggactcaattccacttcaatgtattcgttctagaggtaaatggacatgtgaacacagattcacaggcaaagatgtttatatgcaccactgtcttgatgttcaagaaaatggaactggttacatgcatgtgattagctatataatgtaactgtattcagcccctaaaaaatgatatagttttgtttttgttttttgagatggagtctcgctcttgttgcccaggctggaatgcaatggtgcagtctaggctcactgcgacctccgcctcccgggttcaagtaattcttctgcctcagcctcctgaataacaaggattacacgcacccgccactaagcctggctaatttttgtattttagtagagatggggtttcaccatgttggccaggctggtgtcgaactcttgacctcaggtgattttgcccaccttggcctctcaaagtgctggaattacaagcatgagccaccatgcctggccaatgatatagatttttattgacatagaaaaatggttttaatatagcagtgagtgaagaataaaaaagcagtagcacagtgtgattcttctttagatgtatttacatacgtaacacattttttgtctttgttttttcctttttgtggagaacagcgtcctgatatattgcccaggcaggtctcgaactcctgagctcaagctatcctccagcctctgcctcgctaagagctgggattacaggcgtgagccactgcactcttccataacacatattaacagtttttctgggcagtaggagtttaggggatttgtttatatgtaagtacacatacagaaacgttctactgatgtggagtttctagttttttaatggtaggcagcacctttacatgactccttcctcaaaatgctcattataagtcagacacagtggctcacgcctataatcccagttacttggggggctgaagagggaggaacactcaacccaggaggtggaggctgcagtaagccatgattgcaccgctgcactctagcatggacaacagtggggaagaaccctgtctcaaaaaaaaaaaaaaaaaaaaaaaggctggccgcggtggctcacacctataatcccagcactttgggaggctgaggcacgcagatcacctgaggtcaggagttcgagaccagcctggccaacatggtgaaaccccatctctactaaaaatacaaaaattagccaggcgtggtggcgcatgcctgtaattccagctacttgggaggctgaggcaaaagaattacttgaacccaggaggcagaggttgcagtaagctgaggtcgcatcattgtactccaggccgggcaacaagagcgaaactccatctcaaaaaaatatatatatactactcctcatactcctcaatccagaaacacacctcagactataatctaatttcacctacaggagaaaatgctctgcagagcaagccagaggcctggactggttagtggcctcctctccaaagccagccccttatggccataggtctcccatgagtttggtcaaatgagtcagttctgccagatcacctcccggtactccaggcaaatggaaagtttagatctgtaaagttggaatgtaatgacctcacagtcctgctagcctaggagaccccgccaggagacccagcaggaggtcacctgaccaaagagggctggtaagaaagtccccgttggatgcataataaaaacgagtgatagagcccatgctgaggacacagccccggcctcccaactcgcccagtgatctcgccaggactctgaactacctcccaggcagaacgctgctcaagagcttgttcctgcatgctctcctgctagcagagaaaatgaaggaagcacagacaggaggggaaatgcagagcaaaaggaaaaaatcagacacagctcaaccacaagtgaataaacaagtcatctgcacctgtcccacaggcaggccttggtaactacaaggctgactaattttagaaacagcatgaacctaaagaaccatcatttaagtgctcaaaatggagcccttaaaaaaaatccttctgtctgcctgtactgagcagacacaaaatggacagtcttgggttgactctattcaaccagctgtctgttggatgagatcaagacacaccactgcaacctacaaaaaagcaccaggccgttaagtgcagtcaagacacgtggccactcacggccacccaggtggaagagtcttaattcagacacaaatgtctcctggccgtccttagccagggagctgggctctgcccgcggccaggtcttgcctgagtccccctattccgtgggtcggggtgggatgtggaaaagcaaacctctaggctttcttcctccaaatgtgtcagtcaccatacatacctgtacacagaagctccccctccagcaattttccctcagaacagtgaggacagtggctcatccctgcgacatttagatctctcatgttacagggcattctttcaattattttgaagacatttctgatgggtgaagaaagcgctctaggaactgagagtgggaatctaatttgtattttacactacattagatgcaacagtatatagcatatggaaattagttaactgagtttctatcactcttagttggcatctgaccctaagaattcacttacattggttgggtgtgaaacaaactgaattagtagtttacactgcattatatgaaacagtatatagactgggtgcagtggctcacgcctgtaatcccagcactttgggaggctgaggcagtcggatcacttgaggtcgggagttcgaaaccagcccgaccaacatggagaaaccccatctctactagaaatacaaaattagccgggcgtggtggcacatgcctgtaatcccagctactcgggaggctgaggcaggagaatcacttgaacccacgaggtggagcttgcagtgagccgagattgcgccagtacactccagcctgggcgacagagtgagactccatctcaaaaaaaaaaaacaaaaacaaaaaaaacagaaatagtatacagtaggccaggcactgtggctcaggactgtaatctcagcactttgggaagtcaaggcaggaggatcacttgagaccaggagttcaaagctgcagtgaactgagtgcgccactgaactccacctgggcaacaaagcaagactctgcctcaaaaaaaaagaaagaaatagtatatagaagtttattaggttggtacaaaagtaattgcagtttttgcctaagttcctgtaactctaagtcaacatctggccctgagttcactcatgctggctgggacagaagacttattctggaagcttgggaaaacaggagctcacgtcatgattgggactgccatctgcttggccatgtatatatttctctatgactcagacatcagagaccaggctggagtgcagtggcgtgatctcggctcattgcaacctccacctcccaggttcacgcaattctcatgcctcagcctcccaagtagctgggactacaggcgcctgccaccacacccagctagttttttgtatttttagtacagatggggtttcaccgtgttagccaggatggtctcgatctcccgacctcgtgatccgcctacctcggcctcccaaagtgctgggattacaggtgtgaggcactgtgcccggccttttttttttgtatttttagagacggggtttcgccatgtttgccatggtctcaaactcctgacctcaagtgatccttctgcctcagcctcccaaagtgctaagattataggtgtgagtgtctgctcctggccagagaacaccttttggaggttgcaaggccatcagagatgactgggtccaagtctaagctgccattcatttctgtcttaaatgtttactaagcacccatggaagacaggtgccctgtgaagtgctggagatgacggtgggcgagcaagcagtggcacagagtggggagcagtctccgaggagagaagtggctgccccgggcaccccagctgcctggagatgacagagccaagacaggacctcagctgtcctgactctctccttccacatcactgtcagccctgtttcttttctcacacattctccagaaatggttttcaaaatacacttgagtgggatctcacactcccaataaagtgcttcacacagtgtagctcacacagtgcagttccttcacatgcgttccatttacatagatttcatggtacccaggacaaaaagctgaagtggcagtgcccggtcccctgctttccctggggagggaaatgggacacagaacgtgctgtttcctcaggccccgctgggcctctagcagggggagtgcctctgagctaataggcaattcaaggactttagaggacagtttgacttatgaggtctttgctctgctagttgactttagaacctaacccactgaatgtgtactgaagaattcaacacagcatgcaaatcagcacccccaacactcaggcaatgacggagcacatgaagaccacggtccctgcgtcttggctcttaggaagatgagacggctgaaatgcaggcatggtgtatcattttattcaaccaataagtatggaccacacactatgcgtgaggcatttcctaggcactgaagatggcagatcaacgtctgtcttaatggcaggcagcttcagtggggggctgagtagagggcataaaatacagaaataaaacatcgggcctggcacagaacaaagcgtggcatggaagaaggaagaacaaggaagtggttgccacagggctgcagttgtcaccagggatagctccactgagcagggaacactccgtgttggaggatgggtgagccgggtcctctggccacagcaggatgcccacttttaccctgataagccgagaggcttgcagagagcttgggaaatcatttcgccccacgactctccattttccgcactcacctgccatgctaatccagttctccaaagttctgacatcaagtaggtggctcctagagctggggagcctgagagcactcggctaccacctccagcaggtatagttcctttttggccaattttactggggccacagagaaatgcgtcatggtgtggccactgtccctgcaaagcagctaaacacacaccacagaacctgagcttgaccatgctggggacagaaactaaggcctgaggtcaggtgacacaaaatgcctggggaatctgagatctgagaagtgctcacttgaggccttctcccctgaacagggcaggactcttcaggttcaaggatgaggccgtttcactcagcagagccatcaccatccaagttcctctcttttttgtttaagtgactacctgtttgaaaagactcatcagaccctccatggaggtcactcacctcatggtccctgccctcagggagctgcagatctacctggcaagacaagtgacacttgagaagaacttataaaaaatacacaggcaagcccagcaggagctgtcgcctctgtgacagcaggtgctccagcagagaaaaggtgaggcctgtcatgggcttcacagccctgcagggaggtggccagggaattctgggtctagggcaatggagtcactcataacatgcagaattagaaagttgtgatcaaggccatctcccagtcagacccatagctcctgcagggcagggtcagaccttggggccagtttctccagggcaccgggcagcctgtgaaacatgggttagtgggtggatgggctgcagcttggctgctgctctaggcaggaactctgctctccagccagaggacccttctgttcacttcactcccattgccaaactggatggctgagaggcgctccagacctttctcgtctccttaaaccatgaccagtcagcaagtcctactaactccatggttcaaaggccctcagatccactatctcatctaacagtcaagggtgacagggaagagtctggacttggaccatatcccagatctaccaccggatcgtaactcacactcctccaaactatctcatccccccacccttcccaagcccacccccgtactctttccctggcctccaaacacgcccacaccccacttccctgcaaacctgggccttcctgaggattctgctgccaggggattctctgtcccttgtcttatctcccctcaagaatcctgggactctcccacttgtattgttgggccctgcttggtgcctagtccatgtgtgttgaagaaatgagtgcacaggtttggggttgacctaagtggacctcctgtgccattcttttttgtttgttttgaaacagtctcactctgtcacccaggctggagtccattggtgcgatctcggctagctgcaacccccaactcccgagttcaagcaattctcctgcctcagcctcctgagtagctggaattacaggcacctgcccccacacctggttaatttttgtatttttagtagaggcggggtttcaccatgttggccaggctggtctcgaactcctgacctcaaatgatccacccacctcagcctcccaaagtgctgggaatacagccatgagccaccgcacccagccccttctgtgccattcttaacccaaaggccactgcccagggtgagaacacagccgcagccgagagagactccactgcgtcctcaggaaagtacttacgttcacagccaaatatccagacaggaaaaaacaccatttcttgaattccagtcaactccgtgatgcagtgatcacaatggggctgggagagcccacgtctccctcagctgctcttccgccacccctgctgtttcagggccagccatgggcccttctctgccattacttggcaaccatgggcaagtcacttagacactctggctgctgcctcagctggccaagtcccactgtgctgctacctccctggctgacaggtgagaacaacgcatgttcatagggcggtacactgcaaagaaccccatttcctcctgcttccccagcctgtgaggccgctgtttgcatggtttttttttttttttttttttttggtttttgtttgtttgattttttgagatagagtcttgctctgtcacccaggctggagtgcagtggtacaatctcgactcactgcaacctccacctgccaggttcaactgattctcctgtctcagcctccggagtagctgggattacaggcatgcaccaccacacccggctaattttgtatttttagtagagacggggtttctccatgttggtcaggctggtctcaaattcccaacctcaggtgatccgcccccgttggcctcctaaagtgctgggattacaggcatgagccacagcacccggcctgcatgttaatcagaattgtgacaaccaagctcgctttcttcctgaagtaatacgggttgaaattctccctaaaccctcccaaggcagctctcgcactcttctctacctacttccacctttcttggcctcttttccttcttgggggaaaaacccagacactgggactagatctgaattcagacttaattagcattgattgaacaattacatctcaggaagaccctcagtgtttactgaacccccattacacctccttgcagtaagaatcgatggtactgaatcactcaatgtacagaccaagccaggtctcacccacaaatcaggagcactgaaaaggtgacaagaaatgtttcctggaaaaatggtccagtattaccaaaaatgcatcacaactgctttcaaggaaagaatcagaatgctcctggaccccctcaccctgcactgcaggctctgtattggttttgctttgtctgccgtcagggacccttcatctcttcagcgctaacagcagatgcaggccttcctgtggcctgggtgatgctcttcacctatcacagacgcggccagcaaggcctgtctgtcacacagcttcaacatgacagagaggtctccacgtctaggcagccctggtcccaggacaccaccaatgtcatggaccactgcctgatgactcacagagtaggagaagtggtgaccggggccatcaggcccacgggttcaggagccaccagaccagtgtctccaagagtggacagccctctgggcatggggaggttctggcccaggccctaggcgcctccacctctgctgcactgtattgcaaggtagcctttaccacctcccacagagactgtggcttggagactcctgactaggcagagacagaaacagaaactttttgtgggatcctagaaaggggcacatttccattttgagtaatctatttccaagtcccctcgtgggggaaagggaacctcctgtcaccactgccggcctggctctctctctccatcctccccatggagcgccaaggtcctctgcagagctctccctgcctgccaccttctcaccagcacttcctccacctacaggacagtgacatgctataaaatgccacaactttaactaccatatttccctgtgtcttctatgagtaaaaacatgtccttacccttggaaccatgttcctcaaagtggagacaaattttcacagggcctatcttttctctcccactcaggcaactgagtagggtgaagggctggtgtttgtggctaaggaacaaagtacctgggcccaagggtctcaaagccacggcctctagtccatcaacaccatgagctaaattgcactacacaccccagttcccctagaccttagaaaacacacactgaactggtaggttcaacctggacaagcttacagtgtaaagagccgacagggagttgcaagctgatgactagcttcaattattgccaacgtgatctgctggggcaagctggccttcgggacgcattccgttagctccttctcaaaacaattttgttccctgaagtattactttacatcatacagtcaatgttctgctcttatggtgattctagaaccacggctggctgctcttaaatccttgtaagaacttgggcacggtagctcctgcctgtaatcccagcactttgggagggtgaggcaagaggatcacttgagcccaggagttagagaccagctgggcaaaataatgacatgccatctctacaaaaaaaaaaaaaaaaaaaaattagccgggcatggtggggcatgcctgtagttccaggtactcaggaggatcgctggagacaaggagttcaaggctgcagtgaacgtcgtgacggcaccgctgcactccagcctgggccacagagcaagaccctggctctaaataaataaatgaacctttgtaagagaacctgtaaagctcttccctggttctcccatcctgtggaaaacctccgaactccttcaaattctcaagggtgagagacggatttctaaatacccagggcttccattaaggtaaaaaccattaagaagataaaaaagtcaaacccaataaacaacaattctaagactctaattaatgacatgcatgcttatttgggagggaaaggcactgatatctgcaacttactttgacacaaaaaacaagagggactgctggttggacaaatatgtgatgaaatacaataaagtgttaactctacattctaggtggtggtctgtgggtgttcactgtaaaattccttcaacttttgtatgtttcacgtttttcgtaactgaatgtgtagagggggagtcttctgagactggcaagtgactgggcataacctttccgattaagggcagagggcaaggcagagctggcacgcctccctccacccagttctacctagatcggccccaagggaagcagcaaagaacccaggagagcagtaacttgcccgggcaccgccccgcccagcatcaggccccagaatacagaagaaactggcagaaacactatggaacgtccctgcccccgggcccgccaaccccctcactgggacaggttctcagccccagctgcgcccgggaatgatctggggagcctactaaatgcagattcctgggcagcgcgacggaactacagcatcccaacacctggggtgggccccaggaatctgcccgtttcccaagagccccaggtggttctgacgcagaggatcttgagcccacctttggaggaactcacagccactcgccccacctcatctaacacctgttgagaagccccccaaggaactcgctaagccaaggtcctcgaaggcgcgactcctagccccaagctaggccaggccgtcgccatctccgccggggatgcgcggccgagcgccacatcccgactccacacgtcggcgagccgggcgcgggtgcaggacactgctgggctccgggacggccaaggtcacccgcggggctcggcaggggctggctcggccacggggctcctcctcgaccccctttccttgagaaaacaactcccacccctcccctccccgtctcgccctgcaagacggagatggcaatttccacaaccttccctgacggaaaaacgtgcgggcgagcaggctgccattccgggcgcacaaccccgcggcacacagcggggcgcccgcccgggccccgccaccgcagcggcttcgacatccccagggccgcgctaggtctcggcagcgccctgaggggaggacgggccccgccatgccgcgccccaaccgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcaccccccccaccacaacccgctctgagaggctggggactacggtgcccggcatgcaccgcccaggcgccgcgggcgggggcggggagggggcgccacggtccgaggtcacgccccgacctgaggagagctggcgcccagacccttcccccggggaggagggctcccgcgcgaagccgtctccgaatgcgtccagtcgactcaccgtccccgcagccctggggcagcggccgcaacagcaggaccgaacgcctcggcagctggcagtcgcacttctgtcacaaggaggcgggtagactttggaccagggccgaggcccgggacgtcacggtggggggtggggtctcgggaggcacgtgatgcgccgtgatgacgtcagtgggagcggaggcgatttggcctagagctggggctgagcacgtgggatggtcggggcctgtttgcccaatgtacacgaggctggagaatagggaaagaaccgtccctgtgagcgcctcctcttcactcatgccagcaacagggcagggcatcttcctccagggctgcattttttcttttatgcgactaatatttattgagtttgggaggtgcattacataaaaccttgaaccacacggtcactgtccctgcgcttgaaactgcctttgcaaaaattacaacagaaaattatgacagtgaaagagagctgacctaacccactccatcttgcttctaacctccaggttgtccttgttcattcctaggcataggcagaactaactttgggagcaacttagtttatagtttaatattgaaacaaagatagttaacagccctttcccaaaacaaacccccttgttgcctgagaaccaggcttcctttgtaagagtaacacgttagctacaagattagacattatagtttagggcccagctcagtggctaacgcctgtaatcccagcactttggaaggctgacgcaggtggatcacttgaggtcaggagtttgagaccagcctggccaacatggtgaaaccatgtctctatttaaaaatacaaaaattagccgggtatggtggcacgcacctgtaatcccaactactagggaggctgaagcccaaaaattgcttgaacccgagagatggaggttgcagtgagctgagattatgcctctgcactccagcctgagcaagagactgagactccatctcaaaaaaagaaagaaagaaagaaattacggtttaggagtcatgcacccagaggccacaagattctaaacctccccagttgatcctaggtataatatcactattgtaaaacctaagattggtactcttaggtgtttttctgaccctgcagtctgatgcaccagccaaggccacctagagctgtaatctgactcaaccagttcttgcatccttcaacaccctgtgatttcatctcccaccccaccaatcagcactccctactccttggcagcttatctaccaaattaccctttaaaaactctaggctctgaatttccagggagactgatttgagtaatgaaactttggtctcccattcagccagctctgtgtggattaaactctttctctattgcagttcccctgtcttgatacattggctctatctgggcagccaggaagaagaacccactgggtggctacttgctcaggtacttcctttgttacagacagtatacaaggaaaccacaaaatgcccaggactgtgaaggagaggaagggacgccctaacagagttacggggtggtgccactagacaggttggttagaaaaggcctctcagaggaggcgatgctgaggcaggggcatgaaattgaaaagacattctattctggaagggcattccagagggagggattgccttgggtgagagagtcagaaaggtgaggatgtcagtggggcaggctggatccaagtcatgttgagatttgtaggtcattttaagaactctggccaggcgtggtggctcatgcctgtaaccccagcactttgggaggccgaggcaggcagatcacttgaggtcaggagtttgagaccagcctggccaacacagtgaaaccccgtctctactaaaaatacaaaaattagcccggcatacacgcctgtaatcccagctattcgggaggctgaggcaggagaattgcttgaacctaggaggcagaggttgcagtgagccaagatcacaccactgctctccagcctgggagacagagcaaaactctctcaaaataaaataaaactctggattcttctttcttttttttttgagataggatcttgatcaggcacccaggctggagtacagtggcatgatcatagctcactgtgacaactcctaggctcaagcagtcctcctgcctcagcctcccaagtagctgggattacaggcataagccaccatacctgtctgcagtttggatttttttttttttttagatggagtctcgctctgtcaccaggctggagtgcagtggctcgatctcggctcactgcaacctccgtctcccaggttcaagcaattctcctgcctcagcctcctgaggagctaggactataggtacctgctaccacgcctggctaatttttgtatttttagtagagactgagtttcactatgttggtcaggctggtgtcgatctcctcacctcgtgatccgcccgcctctgcctcccaaagtgctgggattacaggcgtgagccaccgcgcccggcctggattttatttcaagtggaatttaaagcccttgaagagttttaagcagtagagttacagtcaatcttcattatttatggattttgtgtttgcaaatttgcctactcactaacatttatttctaatcccaaaatcaatacttgtggtgctttctcattcattcatggacataacgatcctgcacattctccactgaggtcaaataaggcaacactgggctgtcatggtggcactcgccttctatcccagccactcgggaggctgaggtgggaggatcccttcagcccagcaggtcgaggctgctgtgagctgggattgtgccactgcactccagcctgggcaacagagtgagaccctgtctctaaaaataatagggcagcgctgcctacaagtctcctttttggtctatttagtgtcatctttttctcatttatttttacgctttttattggtgattctggtgtttaaaatggcccttagtgttgtgcagaagtgctgtctagcattcctcagtgcaagaaggtggtgatttgccttatagagaaaacagctgtgctcagttagcttggtgcaggcaattgagttcaattgcactgaatcaacagtgtatattaactaagttgcctttaaacagaaacacctataaacaaggttattgattggttgacaaaaatgttgtgtccacaggctcacaggaacctaggttgttcccccagaagcagtggttcagtgtttgcttaattcagtgtttgtggccacttatatgattcgattgacatttcacaggatcatctgactacagtgtggagaatggtttagaccaagagaggcaaatagaaggctgggcgaccagcacatatgtaatccagaaatttccaggctggtccctgtggctcacacctgtaataccaacattttgggagattgagttcaagagtttgagactagcctgagcaacatagtgagtctcccatctctacaaaaaaatttataaaattaaaaaattagccagctgtggtggctcatgcccatagtcccacctactcaggaggctgaggcaggaggatcacttgagcccaggagtttgagactgcagtgagcaagaattgcgccattgcagtccagcttgagcaacagagttagactcagtctctaaaaaaataaataaataaaaatttgaaaataaaaatttcccagtaaccacattaaaagtataaaaagacacaggtgaaattaattttaataatacatttaactcaatatatgcaaaatattgtttcagtaatcaacataaaaaattatcagccaggcgcagtggctcatgcctgtaatcccagcactttgggaggccaaggtgggcagatcacctgaggtcaggagttcaagaccagcctggccaatatagtgaaaccccgtctctactaaaaatacaaaaaattagcttgacatggtggcaggcgcctgtaatcccagctactcgggaggctgaggcaggagaatagcttcaactgggaggcggaggttgcagtgaggcaagatcacaccattgcactccagcctgggcgacaagcaaaactttgtctcaaaaaaaaaaattatcaatgatatattttactcttttttcacactgtttttgaaatgcagtgtgtactttatatttacaggacatctcaatttggagcagtcacatttcaggggctcagtagccacatatggcttgtggctactgtattggacagcacagatctagaatatttattcatttactcatttgaccaagcaaggtcctgttctaggcctggaaatacacaaaatggaataaagccccatctctgtcctcaaagcgcacacagtccagcacgggagactaatataatagcttatgttcaagatgtcaaaacagagtgctttgagagttcaggagagggagtgcccgaacaaggaaggcttcagagaggaggacgtttaagttggggcttgaaggatgtgtaggattccccaggtgaaagaagtggggtagggtactccaagtagttagagctgctaatgcaaagttgcagagaaatgaaacacagagtgtgtggggaaatgcaagcagttctgtatggttgggtggtaggatatgaaagaggagggcagagggtgaggaaacatgagggccttatagaccaatctgtggaatttagactgtatcctattgggtaggtagtgggtgatgtaatgttgagaattttgggctgagtaatatgactagattcttgttttattttaattaattaattaatttatattaaaatagaaacagggtctcactaggttgccaggctggtcttgaactcctaggctcaagtgatcctctcaccttggccacccaaagtgctgcgattacaggcatgagtcaccatacctagccatgatccgtattttatttatttatctttgtttttatttttatttaaattttattttattttgggacagagattgcagtggcgcgatcttggctccctgcagcctctgcctcttggcaagcgattcttctgcctcagccatccaagtagctggaattacaggcacataccatcacaactggctaatttttgtatttttagtagagacagggtttcaccatgttggccaggctggtctcaaactcctgacttcaagtgatcctcccacctaggcctcccaaagtgctgggattacaggtgtgagccaccgcaccccgccaggattcatgttttagacaaatcattctgacagtgtggagggggtgcaaatttgaggcaggaggacccactgggaagggaaggggctctaggatggatccagaggaaggacctgtggaaactaaggaggggtcatagagggggtagggcctagggtaggcaaagggttggtcccaagtgtcccatgcagtaaaagtcaaatagaacagtcaacgtgaacattaccatgctatgtactgggtgaaaacttgctgatctctggagcccactgagtagcggagggtttgagagccagtgagaaccagaaatgtagtgagctggaactgggttcaagtcttaggacacaccacttcacggccctctccaaaatatttcatttttctggctggacgcaatggctcactcatgtaatccaagaactttgggaggccaaggcaggcagttcacttgagcacaggaatttgagaccaacctgggcaacatggcaaaacccggtatctacaaaaaatacaaaaatattagctgggtgtggtgcacgtgcctgtggtcccagctactccagagactgaggtgggaggatcgcttaagaccgggaggctggagttgcagtgagcctggtgatcacgctgctgcactccagcctgggtgacagagcctgaccctgtctgaaaaataggtatatttaatttttctgactaccaaatgagggtaaacctaatagcaatttcacggggctgttgcgaggatgggatggcttaatgcatttaggtcactgctcatagtgcctggcacacagccagccctcagaccaatggcagctggtattatttgttagcctctgagtgctctgggcctcagctccctcacctccaaaaatgaaattgtcatctcccacttgctgttgacgggaactggggactagatgagacgattgaagtgtatatgcaaacgtaaaggcggtattcctcgaaagattgaacgtagagccactatgtgacccagcagtcccactcctaggattgcacccaagataaaacacacagccgcataaaaacctatagtacacgaatatgcatagcaggtattcatatcatagcatggatgtttatattcataatagccaaaaagtcaaaacaactaacaggttctccatgaccagacattagttgggtgctcctctctaatgaccagacgttagttgggtgctcttctgaatcctctcccccgccagacctcaatttttggacttctgtatctgtctttgcgtcactcagttgtttgtttagggacagggtctgttctgtcacccaggctggagtgcagtggcgcgatgatagctcactgcagcctcaagctcctgagctcaagtgatcctcctgtctcagcctcccaagtagctgggactacaggtgcatgcaaccacaaccagctatatatattttttaatttgcttgttgcccaagctggtgtcaacttcctgagctcaagcgatccttgtggcctggcctcccaaagtgctgggattacaggcgtgagccgctgcacctagccaagccgggtttcagcaagaattctgttaaattgatttagccagaatcgcccctgcatatctgtccaaatttcacaacccccatcatcctccaggtgatatttgatcaccctgacctgccttcagcaagactcttgttagactcaatttagcaaagaattaccctcctctcctagtaactttccatccaccaacagcacccacctcccactccttggctatcaatctctattttcccttgttgtattcggagttgagcctatttctgtactgaggtctcttttcccctattgcaatagtcctgaataaaatttgtttttacagctttaattactgtccagctctggttttctttttctctttttctttcatttttttgagacagaatctcgctctgttgcccaggctggagtgcaatggcgcgatctcagctcaccacaacttccgcctcccaggttcaagcgattctcccgcctcagcctcccgagtagctgggactacaggtgcacaccaccatgcccggctaatttttgtattttcagtagagatggggtttcagcatgttggccaggctgatctcgaactcctgacctcatgatccgcccaccctggcctcccaaagtacggggattacaggaatgagccaccatgcctagcctctttccttctttctttttttttttttttgagacggagtctggctctgtcacccaggctggagtgcagtggtgtaatctcggctcactgcaagctccacctcccaggttcacgccattctcctgcctcagcctcccgagtagctgggactacaggcgcccgctaccgcgcccagctaattttttgtgtttttagtagagatggggtttcaccgtgttagccaggatggtcttgatctcctgacctcgtgatctgcctgcctcggcctcccagagtgctgcgattacaggcgggagccaccgcgcccggacttttttttttttttttttttttaagacacagggtctcactgtgttgcacaggctggagtgcagtggcggcaatcatggctcactgcagcctcgaccttccaagctcaagcgatcctcttgcctcagcctcctgaggagctaggactacaggcatgtgccattatgcccagctatttatttgttatttttgtagagacagggtctcaccgcgttgcccaggctggcctcaaactcctgggctcaagcagtcctcccatcttagttagcctcctaaagtgctgagattacaggcataagccaccacacccaacagctctggttttctttgacacaaccaaatgttcatcaactgatgaatggataaacaacgtgtgatctccatataatggaatattattcattccataaaaaggaatgaagcactgatccgtgctacaacgtggatgaaccttgagaacactctgagtgaaagaagccatccatttctctctttttttgtcttttttcctttttgtggagaatagggtctcgatatattgcctggcaggtctgtaactcctgggctcaagctatcctcctgccgctgccttcctaagagctgggattataggcatgagccaccgcccccggtgaaagaagcccttcctaagtgaaagaagccagtcacagaagaccacttattgtttttctcttctgagacagcgtctcgctctgtcgcccaggctggagtgcagtggtatgatcttggctcactggaacctcgacatcccaggttcaagcgattctcctgcctcagcctcccaagtagctggaattacaggtgtgcccaccaccacacccagctaatttttgtatttatggtagagatggggtttcaccttgttggctaggctgatcttgaactcctgacctcaagtaatccacccaccttggcctcccaaagtgctgggattacagatgtgagccactgcgcacggcccacttattgtgtgattcagtttacattaaatgtccagaataggcaaacccatagagacagaaagtcagaaaatagattagtggttacctagggcgtggggagttcaggcgaaatgggaggtgagtgctaatgggtacaggttttctcctctcctctcctctcctctttccttcctttctttctttctttctctttctttctgtctttctttctttccttccttccttccttccttgcttccttccttccttccttctttctttctttctttctttctttctttctttctttctttctttctccttccttgcttccttcctccctccctctctctctctctcattctctctttccctccctccctcccttccttccttccttgagataaggtctcccagtattgcccaggttagtccaaactcctgagctcaagctgtcttcagtcctccttcctcagcttcctgggtagctgagattacaggggtgagccactgcacccggctgagttttctttttagggtaatgaaatgttctaaaattgattgtcatggtgtttgcaactatctgcaaatatactaaaagccattgaattatacatggatggattgtatgttagatgaattatatcttaataaagctgttatcagaaaaggaggggcagggctacacaaaaagccgctccgggagaattcggacatgtgatgaaataacaaagtaaacgcaggcccggagacaggacgatgttcctcatgttcctgcctcactcgctgtcagatcaggagcccacggctgtcctgaatggcattattttcaggcttgcagaggagctgcttgtgtcaccttttcctgggcaacgttcactttctgcagaacgcagctcctcctccctggcacccaaggcgcgcctctgagactcacatcggtactgcaaagccaccacctcttatttttagtccagatttcaccataattggggcagcaggagtgctgtaggcccgggacatcttcagtgacaggtgtctttctacctcgtggcacctgctaccagaagaccattctcccaccagtgggggaacacctgctgaccttcagcagagccagcccatggggctcccaagaacttttgcgcctaaaagtatgaaaagcaggagctcagctgggcgtggtggctcattcctgtaatcccagccctctgggaggccaaggcaggtggatcacctgaggtcaggagtttgagaccagcctggccaacatggtgaaaccccatcactactaaagatacaaaaattagtcaggcgtggtggtgcatgcctataatcccagctactcgggaggctgaggcaggagaatcgcttgaacccgggaggcggaggttgcagtgagccaaggttgcaatgtcacgccattgcactccagcctgggtgacaaagtgagactctcaaaaaaaaaaaaaaagaaaagtgggagctcttccactttctctataaccagtgccatctgctggcaacacagtggcactggggatgtggtggagtcccttccttgcctttcctttcctgtcttgcagtttgcattacagagaccgaggggtgatgtttatctctcttagtttagttcttttaggccagagttaaaataagacccgagtcttatatggagaccctattaaaaaaagtgcatatgagtgttaaggttgaagaattttcacaaacctcactcactattgcaaccagcaccacatcaaaacagaacaccaggccgggcgcggtggctcacgcctgtaatcccagcactttgggaggccaaggtgggtggatcacaaggtcaggagatcaagaccatccaggctaacacgttgaaaccccgtctctactaaaaatagaaaaattagccaggcgtggtggcgggtgcctgtagtcccagctgctcgggaggctgaggcaggagaatggcgtgaacctgggaggcggagctcgcagtgagccaagatcgcgccactgcactccagcctgggcgacagagcaagactctgtctaaaaaaaaaaaaaaaaaaacaaccaaccagaataccagctgggcacagtggctcacacccgtaatcctgtaatctcagcacgttgggaggccgaggcaggtggatcatctgaggttaggaattcaaaaccagcctggccaacatagggaaaccccatctctactacaaatacaaaaattagccgggcagggttgcgggcgcctgcaatcccaactacttgggaggctgaggcaggagaatcgcttgaatctgggaggcagaggttgcagtgagccaagacctgggcaacacagagagaccctgtctcaaaaaaataaaacaaaataaaataaaaaggagcctggcatctccccactctcttgctcttctctcaccatgcaacatgccgactccccttcgccttccacaatttgaagcttcctgaggcctcaccaggagcagatgttggcgctgtgctttgtgtacagcctgcagaaccgtgagccaaaacctcttttctttatcaattacccagtctcaggtattcttttatagcaatgcaaatgaactcatgtactcactttgcctgtttctgtatcttctgttattgagctggttagagcacacagtgggtaatttttttttttttttttgagacagtttcactcttgttgcccccgctggagtgcaatggcatgatctcagctcactgcaacctctgcctctcgggctcaagcgattctcctgcctcagcctcccaagtagctaggattacaggcacccgccaccatgcccagctaatttttataattttagtagagacagggtttcatcatgttggacaggttggtctctaagtagtgacctcacgtgatccgcccatctcagcctcccacagtgctgagattacagtaatttttgtaatacaaaaccccagagcattttgaatgcagttctgcacatcagagcaaacactgactggtccaaggaggtacctctctcctcccatgttctctccttcctccttggccccctctccagcatcaagctaatgcattgttgccttgaaagcctcaaacaaaatcatgtactcattttgggagatgcagctaacgtcagtgagcactttgtgctgggtaccatgccactctcctcacctcccttcatctcaacaaggaacctgcaaatgtttacctccagctcctaaacctacgtggagggtttaaggcacaggctcagggccacacaacgcatgcccagcagaccccaggtcttgtggttctagcctcatggtgctgctcactgcccaagctgctctcctggcatgggtgtgagtcagcacacactgaggtgagagaagaagctgttatattcaggccagatttttttttgcaaaaatctttctttacacgcagcaagaactgggaaggagcccactggagctgagccagcaaaacccaaatggaatccacgttgttggcctcttaatttgtttgaatcattgcagattcccagaactttgatacagaaaagtgctcagggtcgggcgcggtggctcacgcctataatcccaggactttgggaggctgaggccagaggaccgcttgaggccaggagtttgaggccagcctggccaacatggtgagacccatctccgcaataataaaaataatcagccaggagaggtgttgcacacctatggttttagctactcggagggtgaggcagaaggattgctggaacccaggtgtttgaggctgcgtgagctgcgatcgcaccactgcactccagcctgggtgacagtgagaccctatctcaaaaaaaagaagtgcccatattagaagcgaatggcttgatgaattttcccaaactggccacaccagcgtgcccactcccctacagctcagcttcatgcttccttccaagcatgaggtcacccaaggataaccactcgcctcacctccaacacctaagatttgtttactccatttcgggacttttgtttgtttgtttgtttttgagacggagtcttgctctgtcgcccaggctggagtgcagtggcttgatcttggctcactgcacgctccgcctcccaggttcacgccattctcttgcctcagcctccccagtagctgggactacaggcacccgccaccatgcctggctgattttttgtatttttttagtagagatggggtttcaccatgttagccaggatgtctccatctcctgacctcgtgatctgcccacctcggcctcccaaagtgctcagattataggcttgagccaccgcgcctggccatttgtttctttttaaattctgggatacatgtgctgaatgtgcaggtttgttacataggtgtccatgtgccatggtggtttgctgcacctatcaacccatcatctaggttttaagccctgcctgcatttggtatttgtcctgatgctctccctccccttgcttcccccaccccacgacaggccccggtgtgtgacattcccctccctgtgtccatgtgttctcattgttcacctcccacttatgagtgagaatatgcggtgtttggttttcttttcctgtgttagtttgctgaggatgatagtttacagcttcatccacgtccttgcaaaggacatgaactcatccttttttatggctgcagtttggggactttttatagcaatggtttcatacagcatgaacccttttatgtatgtaattccgctcaattttatatcaatgaaagttggccgggcgcggtggctcacgcctgtaatcccagcactttgggaggccaaggcaggcagatcacctgaggtcaggagctcgagaccagcctgggcaacgtggtgaaaccccatctctactaaaaatacaaaaattagcctggcatggtagcatgtgcctgtcatgccagctacttgggaggctgaggcaggagagtcgcttgaacccaggagatggaggttgcggtgagccgagatcgcgccattgcactccagcctgggcgacagtgttagactctgtctcaaaaaaaaaaaaaaaaaaaagaaacgaaaagaaaagaaattcatcccactattacatgtagttgtctttgttcattctcactgctgtgttatagtctactgtttgaatatgcgatagttggatgggaatttttagctactatgagtagtgctgtcacaaacatccttgtgcatggtgtatgtcaattcctggtgggttccggtcgagggctggactggctgggtcacagtgtgtgcaatttttcagcattgcagaccctgccaaacagttttccaaagtctgctaatttctgctctgtcagagcagatgagagatctgttgttcatatgcttgccaatgcttggtgttgccagaacttcacatttaaatgctaaattattctaaaagaaacatgaatggttacagtgttaacatttattttataatatttctatcattaatatggccccatgagagttgacagctccttcggagctatcatccatttagcaaacacttactgagcacctactgtgtgcagggatctgtgttctgatactagaaagacagagaagaaagagaaggtctctattctgaaagagcttcaggaatgccctctcttcaggtctcagctcagatgtcacctccccagaggagcctccttgggttacctttgcccagctgttatctcattgtctgcctccacgcctggctgaagagccaggttttgtggatggactggtaatgacctctgcagaagcatctgttgtgaagtaggaacatgggattgattcacaagcagcatccctgaaaatatcccactgttcaattcagaaggcgttttcctggactcttgctcccacagttctaaccattggcaagagtggctgccagatcagttctggtcaaggagcgatttgtattttgttttatttgagatggggtctcactctcttgcccaggctggagtgcaggggtgtgattctggctcactgcagcctcgagtagctgggattacaggcacacaccaccatgcccagctaattttggtatattttttagagatggggtttcaccgtgttgtgcaggctggtctcacgctctactcctgggctcaagcgatctgcctgcctcagcctcttgagtagctgggattacaggtgtgagccactacgctcagctaattttttattttgtagagatggtgtcttgctatgttgctcaggctgctctccaactcctggattcaagcaacccgcccactttggcctcccaaagtgctgggattacaggcatgagccacagcgcctgactgcaagaaacgttttccatcagcactggcctggcatgttacatatgttatttctagccgccatgttttatttccccatttagcagagagggaagctgaggctcagagaggttaagtcacttgctcaagattccacagctggtgcaaggatttgcctccccacctgcatgaactcaatgtggaatccctcagcagggctcctgctgtgtggcgcgggaccaggaatgtgggatcacagtgctggctgggttgggagtcagggctcccggtgttaagccgagagtgtccctgcagactttcccaggagacaagcaggctgggattctcttgtcccagaactgaccaagcagagcctgaccatacctcatatctccacgcagcctcctggtcctgtggcagctggctcttggccatgtccttatgatgtcagagcagggctgagaccctgtttgagagcacaggggttgtgaagagcccagctcaagcggggagcagagcagggtctggtgagggcaccgtcacttgggtgggcagggacatgcagggcctagaaaggacaacgccctttttttctttttctttttctttttttttttgagacagagtcttgctctgtcgcccaggctggagtgcagtggtgcggtctcggttcactgcaagctccgcctcccagattcaaacgattcttctgcctcagcctcccgagtagttgggattacaggcacccgccaccatgcctggctaattttttgtatattttttgaagtagagacggggtttcacactgttagccaagatggtctcaatcttctgacctcgtgatctgcccgcctcggcctcccaaagtgtggaattacaggcgtgagccaccgcacccagcctatcgcccttctttgtttgagacggagtcttgctctgtcaccaggctggagtgcaatggcacaatcttggctcactgcaacctctgcctcccgggttcaagtgattctcctgcctcagcctcccgagtagctgactacaggcacgcaccaccatgcccagctaatttttgtttcatcatgttggccaggatggtctccatctcttaacctcatgatctgcccacctcagcctcccaaagtgctgggattacaggcgtgagccaccgcgcccagccgacaatgcccttcttaccacctgggctctccttcccagaaaatggaacacttggccaggtgtggtggctcacacctgtaatcccagcgctttgggaggctgaggcaagcagatcacctgaggtcgggagtttgagaccagcctggccaacatggtgaaaccccatctccactaaaaatataaaaattagctgggcgtggtggcaggcgcctgtgatcccagctactcaggaggctgaggcaggagaatcgcttgaacccaggaggcggaggttgcagtgagcggagatcgcgccactgcactcctgcctgggtaacagagaaagactttgtcacacacactacacacacacacacacacacacacacacacacacacacacacgagaaaatggaacactgtggggggcctttggatgcgtccagaaatgaatgtagttcttcagattcttttttttttcttttgagacggagtctcgctctgtcgcccaggctggagtgcagtggcacgatcttggctcactgaaacctccacctcccggatttaagcaattctctgcctcagcctccagagtagctgggattacaggcacgtgccaccacgcctggctgatttttgtatttttagtagaggcggagtttcaccgtcttggccaggctagtcttgaattcctgaccccgtggtccacccgccttggcctcccagagtgctgggattacatatgtcagccactgtgcccggccttttctcttttctttttcttttcttttctttttttttttttttttgaggcaaggtctcactctgttgcccaggctaagtgcagtggcacaatcatagctcactgtagcctcaaactcctggcttcaagcaatcctcccaccccatcctcctgagtagctgggactacagatgtgcgccagcacatccagctaattacaaatttttttttgtagaaacagggtctcactatgttgcccaggctgctctcgaactcctggcttcaagcagtcctcccgcctttgcctccccaaagtgctgggattacaggcctgaacccccacacccacccagccagtacttcagattcttatctctttgtaaaacctgggtcttcctaactccaagaaacctgtcttctgcccggattcgagaaaattccaaggagggagctgcctctccatcccttccatatgtgcttctaggaaaaagttaccagtctcacatcaccagagggcttgaatgaagaggctgccatcagctattcaaacattcatccaatattaactgagcacctactctgggtgaggcttaccagggagcacctgccccactccagactttgaattgcgcccgtttcatcacattctttggtgtcctggcaaccagagactctgatctgagctccagccagaacagaggccattcctccctgactgctgtgactcaccaccaccccaggcctctgaggaccagtccatgtagctctcggaaccactgaaagctaccccttgtccttgaggacacctggaaccccagccccactgacccaccctggcaggatgagcttctcactcacgttcaccgagctggccaacatcgccatcccacagtgcggggtgctgaacttcaaggccctgcacctcctgctgcacggcatcttggagcacatccacatggccgagctcaagaaagtcctctcaggcgatgaggacttcctgcagacctcgcaggtggtcatcatgcccagggaaggagacgcccagcctatcctcaaccccatgaagaggctcagcaatgtcttcgaccacgtggtgagccgcctcgacaagttggagaaccagctggccctgctgcaggacctgccctccactgcccagctgctggaagccagccagggcactgcccggcccgtccaggacctgtggcatctgatcaagctccggaagatggtggagggtcatgatgaagtcatggccaaggtacgcccccagcctccagacacttcttttcctcccttcaccactggctctctcctgggacgtcttttttttgtttttgagactccgtctcgctctgtcacccaggctggagtgcagtggtgtgatcttggctcactgcaacctccgcctcccgggttcaagtgattctcctgcctcagcctccctagtagctaggatttcaggcacatgccaccacacccggctaatttttgtatttttagtagagatggggtttcactatgttggccaggctggtctcaaacccctgatctcaactgatccacctgcctcggcttcctaaagtgctgggatgacaagcgtgagccactgcgcccagccttctcctgggacatcttgttgcttactcacctacgatgggccatctccttatgcagagtgggaagaagggtgctttagagtcaggcacaaccaaaacgccaagcttgcagcctccatcaagtattgcaaagaagccagacacaaaaggctacccagtgtatgattccatttatacgaaatgtccagaataggtaaatccatggagacagaaagcagtggttgccaggggcttggaggaggagagaatggggagtaattgctttgtggatatagggtttccttttggggtgatgaaaatgttttggaactagatggaggtggtagttatacaacctcactgatgtactaaatgacactgaattgttcacttaaaaatggctaattgtacattatgtgaatttcaccccaatttttttttgagacagggtgtcactctgtcatccaggctggagtgcagtgactcagtcatggctcactgtagcctcgacctcccagactcaagcaatcctcccacctcaacctcccgagtaactgggaccacaggtgtgcaccactgcacctggctaatttttgtattgtttgtagagatagggtctccttatgttgcccaggctggactcaaactcctaggctcaagtgatcctcctgctttggcctcccaaagtgctgggattagaagcgtgagctactgtgctcagccttaccccaatttctaaaaaatgcctggaggagctaccatgggagaagtaccagagtagtcacggtgaacaggcacgcccggcctagcaggggagatagacacaagtgagtgagaatctccaagaaccagccctgtgaggagcagcaaagaggcattccttctgccttacagaagaggaaactgacgctcagaggagctcagtgattggctgaaggcccagcagctggtgggcaagggagctgcgcgctgaggcgtggcctctgaccctggctcacctttgactgctgacccctgctaaccccgaccagcacgtggacagtgttcagttactggcagcccaagaagaaataagaaagggaaaataagccgagcacagtggctcacacctataatcccaacactgggaggccaaggcgggatgatcacttgagcccaggagttcaagaccagccttggcagcgtagtgagacctcatctctataaaaaaatgaataaattagccgggtgtggtggcgtccacctgtagtcttacctcaggaggctgaggtgggagaatcacttaaccccaggagttggaagctgcagtgagttgtagtcactctcctgaactccagcctgggggacagagcaagcccctgtgtctaaaaatagtaataataatttggccaggcacagtggcgcacacctgtaatcccagcatttcgggaggccaaggtgggtggatcacctgaggtgaggagttcgagacaatcctggccaacatggtgaaaccctgtctctactaaaaatacaaaaattagctgggcatgcttgcgtgcgcctgtagtcccagctactcgggaggctgaggcaggagaatcgcttgaacccaggaggcggaacttgcagtgagccgagatcgcaccactgcattccagcctggtgacagagcgagactctgtctcaaaaaaaaaaaaaaaaaaaaaattagccaggtgtggtagcaggcacctgtaatcccagctactcgggaggctgaggcaggagaatcacttgagcctggaaggcaggtgttgcagtgagttgagatcgcaccactgcccttcagcctgggtgacggagaaagtcttgtctccaaaaaggagaccatccagcgatgactgccttcctatccctggaggcagcatgtcctagtcctctctgagccagaactgtgcccgttggtgtgtccagctggatctccctgggagtcagggccattttcagagcgttcccaagttaccactcttctctttcaaattgaggggaaactggctggatgtggtggctcacacctgtaatcccagcactttgggaggccgaggcaggtgggtcacttgaggtcaggagttcgtgaccagcctggccaacatcatgaaaacccgtctctactaaaaataaaaataaaaaaaaattagccaggcatggtggcgcatgcctggaatcccagctactcaggaggctgaggcacgagaatcgcttgaaccctggaggtggaggttctagtgggcggagattgcgccactgcactccagcctgggcaacagagcaagactccatctcaaaaaaaaaaaattaaaaataaataaataaattgaggggaaattgacctaacataaaatcaaccatttaaaagtggacattaaacactgaattaatgaaaattcggtggcacacgatatattgacattgttgtgcagccagccacctctatctagttctaagccatttccatcaccctgaaaggaaaaaaccctatttcccctttacttctcctccctgcaacccctgacaaccactaatctgctttctgtcttacggatttgcctattctggacatttcatctaaaggcataatctgtgtatttcatagagacagaaagtagattagtggtttccagaggctcaggaaggggggaacagagagagactgtaacagggacgggatttccttttaggagaatgaagtgtcttggaagtagatagtggtgtacataccaaatgccctcaaattgcacacttcatttttattttatttttatttttttgagacagagtctcactctgtcatccaggctggagtggactggtgcaatctctgctcactgcaacctctgcctccaaggttcaagtgactctcgtgcttcagcctcctgagtagctggaaatacaggtgcgcgccaccatgcctggctaatttttctttgcatttttatatatatgtttgtttttgagatggagtctcactctgttgcccaggctggagtgcagtggtgtggtctcagctcactgcaacctctgcctcccaggttcaagcagttcttctgcctcagcctcccaagtagctgggactgtaggtgcccgccaccacacccagctaatttttgtatttttagtagagacgcggtttcaccatgttggccaggatgatcttgatctcctgacctcgtgatccacccgccttggcctcccaaagtgctgagattacaggcatgagccactaagcccggccaatactaaaatatttttatactttaatattatgggtattttaccacaaaaaaaagcagagattggcagaatagataaaaaacaaacaaacacacaaaaaaaaaacatgacctaactactatatgaggtttgcaagagacacatttaagattcaaagacacaaatagggccaggcacagtggcatgcacctgtaatctcagctctttgggaggctgaggcaagaggatcacttgagcccaggagttggtgattgcagtgagctctgatggccccactgcactccagcctgggtgacagagtgagatcctgtctctacgaaaaaaagacaagacacaaatacgttaaaagtaaaatgatataaaaagatattccagcggggcacagtggctcacccctataatcccaacactttgggaggctgaggtgggtggatcacctgaggtcaggaattcaagaccagcctgaccaacatggagaaacccgtctctactaaaaatacaaaattagtcggatgtgatggcacatgcctgtaatcccagctacttgggaggctgagaacggcttgaacctgggaggtggaggttgtggtgagccgagattgcgccattgcactccagcctgggcaacaagagctgaaactccgtcaaaaaaaaaaaattagcctggcgtggtggcgggagcctgttaatcccagctactggggaggctgaggcaggagagtcacttgaacccaggaggcagaatttgcagtgagccaagatcgcgccaccacactccagcctgggtgacaaaagcgaaactccatctcaaaaaaattaaaaaataacaaaagatattccttgcaagcagtgaccagaggagagtgggatcttctcagacaagatagacttcaagacaaaaattgttactagagacagggctgcctggggtggctgagggcaagttatgagggccttgcaggcaggatgggcagataccaggatccaaggtgccggcactccagaggcagcttgccccctggcctgccttgatggatgaaggcttctaaaaagcagctcaacagggcaacccacccagctcacaaaaggggctcgtggacaggttcagacctagctgtacagccttcaggactgtttgtgcagctaaggaatgtccccatcattagagaatcttgccttgtcccagcctgattgaagttgcccgaggttcccacaatgacccattgaagggggttgccatggcagctggttctagaatgatgcaaactgcacagctaactgtctgcacccaccaactagtgaggctgccggggggtcgcctggcaaacaaacgtgttttacaatgttcctttcgcgagtcccagtctgcctccttcaggcctcggtttttctcccctgtaataataacctcttgcagctggcctcacaggcgaaaacaagggatgatgtcagctgtttgttgttgaaactgtttcgtctaaccctgtttccataacattgtgggtccaaggcttagggtatttttttaaattgtagaaaacctttaacttattggtctttttgagggaatgagatgcatcgccactgcattacaactaagccattaatcctgtagcttcatcaacattaactggttcactttcatgatgccaatggggaatcagttctttctacagatgttcaagagaaaagattgccaggtgtggtggctcatgcctgtaatccccgcactttgagaggctgaggtgggaggatcgcttgagcccaggagttcaagaccagcctgagcaacatggcgagactccctttctaccaaaaaattttgaaattggctgggcatggtggtgcacctgtagtcccaggtactcaggaggctgaggcaggattgcttgagcctgggaggtcgaggctgcagtgagctattattaatattacagcctggacaatggagcaagactgtgtcaaaaaaaaaaaaaagagaaaagccttttgagaagagtgcaagttcttttatatatttacaaaacctttattcactcaatttttttgtttgtctttattttttaagattgtattacttgattttattttacactaggtggtgggcacacaaagcaatccttaataaagttgacaattagcttcattcaacatttttaataatgcacatataaaaaaagtattcatcttacaaattcttctgcaatccaaacatataatagcttggagaacatttagaaaacaaaagccaatgtaaaaagacagattaaaacaactagaacagtacaggttttatttatatggctcgaattttacaggtttcttactgtatcatcagtgtcagaaatctgttctgtcagctggctccattgttctggatttaaagaaataccttttcttcctggtttcatttcaccttcaggatccatccaatattctccaatatcaattagcactttgcctttaaaatcttgaacgccaacgtacctcattttcccaatctgaaacatgttaccatctctgctgctgctcctctgtcagaagatgacagagctctccaagtttcgcctgtcttttgcttctttacaggtttttctggagcaacttgctttttcctctttaagtttttgtcaacctcactgtcagaatcactgccagaagagtttgaagaaacaagttcctttgctttaggcatcgcttcgctcggctctagcagtggaacaccctcttgctcgttcgctcatgactgactcgtttgtttttatttttaaggcagggtctcactctgtcgcccaggctggggtgcagtggctcgatctcagctcactgcagcctcaacctcccgggctcaaccctggaggcaatcctcccacctcaacctcctgagtaggtaggactacaggcctgtgccaccacactggctaatttgtattttttgtagagacagggtgttgccatgttccccaggctggtctcgaactcttgagctcaagtaatcctcccacttcagcccaaagtgctgggattacaggcttgagccactgcgcccaccctctgttaaccttttttttgtttgtttgtttgttttgagacggagtctcgctctgttgcccaggctggtgggcagcagcatgatcttggcttactgcagcctctgcctcctgggttcaagcgattctcctgcttcagcttcctgagtaactgggattacaagcgtgcaccaccatgcccagctaattttcgtatttttagtagagacggggtttcaccatgttggccaggctggtcttgaactcccgagctcaggtgatccacccgcctgggcctcccaatgtgctgggattacaggcatgagccactgtgcccggcctctgttgacttttaaatcataacatttgtcttaagactagtggtaactgccaggtgtggtggctcccacctgtaatcccagcactttcggaggccgaagtgggcggatcacctgagctcaggagttcaagaccagcctggccaacatggtgaaatcccgtctctactaaaaatacaaaaattagctgctagtcgggaggctgagacaagagaattgcttgaacctgggaggcagaggttgcagtgagccgagattgcgccactgcactccagcctgggagacaaaatgaaactccatcttaaaaaaaagaagaagaaaagattagtggtaactggttttgctttgtttttagccttaaagtgtttttggctggctttgtgaagtccattcgtggacttctgccctcctaatttgttcttggccattgtcagacttggttggatatgtgcacgcagcttctgcagctcaggtgatgccatctgcatgcactgggtccaggaagtccccgggagagggatccagtctaaggggatgctaacaacctattgttgctttctttatttctaaacaccctccccattttactccctcagaaactacaaagcacctgctgtatattgtacaggttaaaatgatgtcacatttaaattggatttttaaggctgggcgtggtggtttacgcctatgatcccagcactttgggaggctgaggcagaaggatcacctgagctcaggagttccaggccagcctggccgatgtggcaaaaccttgtctttactaaaaatacaaaaattagctgggcatggtggtgcgtgcctgtagtcccagccactcgagaggctgaggcacgagaatcgcttgaacccgagaggtggagatttcagtgaaccgagatcgcgccgctgcactccagcctgagcgacagagcaaaactccatctcaaaaacaataaataaaatacaaataaaaattgggtttttaactattttgtaacattgcttaaaggtgtggaagacactttggggtgttagaggaccaaggttgccatgattgcagtaatggtaacgaacactcagatgtcattggtgtcaccttcacagtgtcgtgaagtgctcttacattcctcgtttccgtggagggaaatgttagcattcctgttttccaaagtcccacatgtgaccgtgtggacaagtctagctgcttgtctgagggggtgtttgccttagcccctttttcaggcctcttaaggcctttgtaagtactgggccctagctgaaccccagcatccttaaagccctcttgagagagagagagagcaggtttggacaagccctgcctcgaggactatggcatgggtcagcttctggaagggcaactgtcggggacgcactttcccttgaactcagcaccatccaagccctgaatgtggcccagtcaccctgggcagaaaaaagacctcagccactttccccacagctctctctcctgccccttcttccccaggacaggagtccagagcatgtcccctacatgtgagacagcaggtgggtcttgggtgagaaacctctcactgcatatcacacagagggggaggttgtagtaagctgagatggcaccactgcaatctccacgcaagatgcagggagtctggctctggcgcccaggctggagtgcagtggcacagtctcagctcactgcaacctccacctcctgggttcaagtgattcttgtgcctcagcctcccgagtagctgggattacagctgcccaccaccacacccggctaatttttgtatttttcgtagagacggggttttaccatgttggccaggctgatctcgaactcctgacctcaggtgatctgcccactttgtcctcccgaggtgctgggattacagacatcagccaccacacccagcctcgtttctaccttttgactgttatgaatatgctgctataagcattcatgtacaaacttctgttttgtttttagggacaaggtcttgctctgttgccctggctgaagttcagtggtgccaccatagctcactgcagcctcaaactcctggtctcaagcgatcctcccatctctgcctcccaagtttctgggactacaggcgcttgccaccatgcctggctaatttttaagttttatgtagagatgtggtcttgctgtgttaacagcccacgctggtcttgaactcctgacctcaagcactcttccaccttggcctccgaaagcagtcggattacagacgtgagctaccatgcctggcccatgtgtgcaagtttttatatggacctatgttttcatttcttttgggaatatacctaggattagaatcagagatcatctggtatctctataatcttgtgaggaactgccacactgacttctaaaatggctgcacaatttacattcccagcagcagtgtatgagaattacgatttctccttatggttaacagcacttagtatctgactttcgcttctgaccatcctacagagtttgaagtggtatctcattgtagttttgattttcatttccctgatgacgaatgatgttgagcatcttttctttttatgtgcttattggccatttacacatcatctttggagaaatgtctattcagatctttgcccatttttaattgggttatttgtatcattgagttgtaagagttctgtatatattctgcatatactgggtcagatatatgatttgcaaaatgaggttttctcccattttgtgggttgtattttcattttcttgctggtgtcttttgaagcacaaaaggtactttttattatgactttaatctcttcacttgttttaggtttactcggattgtctatttctgcttgagtcagttttaatgattttctaggaatttgtccatttcacctaaattatataatttgtccacaggcaattattcatagtatttctttataatcctttttatttctgtagagttgatagaatgccctctctttcatttctgattctaataatttgagtctgattcttggccaatctagctaaaagtttgtcaattttgttgaccttttcaattaaccagtgtttagtttcattgatttttctgtactatttttttatcctctatttcattaatttcaccatattctttgttattttcttatttctatttgttttaggttcagtttgcttttctttgttccagtgtcttaaggtggaaggttaagttattgattcaagatctttctttgttaatatagtcacttacaacaataagtgttctaagtgtctaatcaccactttagctgcatcccgtaagttctggtgtgttgtgctttcattttaactcatttcaaattagtttctaatttctatttctattgtgatttcttctttgacatatttcttttctttttttttttttttttttttgagatggagtctcgctctgtcacccaggctggagtgcaatggcgcgatcttggctcactgcaagctcagactcctgggttcacgccattctcctgcctcagcctcccaagtagctgggactacacgtgcccgccaccacgcccggctaatttttttttgtatgtttagtagagacggggtttcaccgtgttagccaggatggttttgatctgacctcatcatccgcccacctcggcctcccaaagtgctgggattacaggtgtgagccaccgcgcccggccttctttgacatattccttttgtgatttcttctttgacatatttgtcatttagtagaatgttttttaaatttttacatgtttgtgaattttcaatagtttcttctgttgcctttttttttttttttttttttttttgagatgaagtcttcctctgtcaccaggatggagtgcaatggcatgaccttggctcactacaacctctgctcctgggttcaagcagttctcctgcctcagcctcccgagtagctgggactacaggcacgcaccaccacacccagctaatttttgtatttttagtagagatggggtttcaccatgttggccaggatggtctcgatctcctgacttcatgatctgcctgctgtagcctctcaaagtgctgggattacagatgtgagccaccacgtccggcctgtttttgttttttgtttgtttgtttgttttaagccctgtctatgggagccattggcaatccaagaacttttttattttatttttgaattatagagacgggagctcactatgttgcccaggctggtctggaactcctgagctcaaatgatactcctgcctcaagctcccaaagtgctgaattacaggcatgagccaccatacctggcctcttctgttgctttctaatttaattccattgtggtcagagtatgtattttgcataatttcagtccttttgaaatttgttaaggcttgttttatggctttaccatatggtctaccctggagagtattctatgtgcatttgagaataatatgtattctaccattgttgagtggggtattccgtagatatctgttatgtctagttggtttatactattgttcaaatcttctcttttcttgctggccttttgttttgttaattttatttattttatagtgacagggtctcccttggttgcccaggctgctctggaacccctgggctcaagccatccttccactgcagctacccaaaatgctgggattacaggtgtaagccactgaacccagcctcttgctcttctttttttctttttcttttctttttaatttttttttttttttttgagacagagtctcactctgtcacccaagctggagggcagtagtgcaatcacagctcacttcagcctcaacctcctgggctaggaagatcctcccatctcatcctcccagggacctgggactacaggcatgcaccaccacgcctgtctaattttggtatttttttgtagagatgggagaccgctatgttgcccaggctggtttcgaactcctgggctcaagtgatccacctgcttcagccccccaaaatgctgggattacagatgtgagccactgcacccaggatactgttctttttatctcgggttttgttttttcgagatggagtcttactccatcttgtgtgacttactcagatggagtcacacaggctggagagcagtggcataatcttggcttgctgcaacctctgcctccggggttcaagtgatcctctcacctctgcctcccaagtagctgggattacaggcaaacactaccacgcctggctaatttttatatttttggtagagatggggtttcaccatgttggccaggctggtctcaaactcctgaacttcagatccactggcctcagcctcccaaagtgctgggattacaggtgtgagccaccatgctggaccttccttatcttagttattctattcattactgaaaataggaaattgaagtctcaaactattcttgttaattaactatttctccttttgtaactgagtacccccatttttctaaaagatagtttattttaaaaattattttctcttcctttctccttccccactgctccccacttcctacttagccctttagaaatgcaaagagaggcctggtgagttggctcatgcctgtaatcccagcactctgggaggccgaggtgggtggatcacttgaggtcaggagtttgagatcagcctggccaacatggtgaaaccccattagcagggcgtggtggtgtgcccctgtagtctcagctacttgggaggctgaggtgggagaatcacttgaacccgggaggtgaaggttgcctaggtgacagagtgagactctgtctcaaaaaaaaaaaaaaagaaggcaaagatagtctttgacccctccttcaccagtcactccctacagggcaagttcatgtaactcctggagagttaagaaacagacttagagaccaaagcacgccccttataggactttcacctgggaacttccactctccagggattgcctgagagctcagtctcaccaggaggacatgttgaaagcgtgcccatggccacttttacaacttacttcttcccaggaaggtgccaactcagctgcccagtagataagacatcacgctcaaaaggagacccctgcccttgctggctgtatcccctacgtcttaaaagtgcccactttttctccagaagtgaagcggcacgtttaaagccagggcgctttgtgccccttccccaagctagaacttttttattttatttttgaattacggagacgggatctcactatgttgcccaggctggtctggaactcctgagctcaaatgatactcctgcctcaagctcccaaagtgctgataattcggaataaattcactttctttttggtaccagaccttgctcatggtaactgaaccctgcaatgcagcgagcaaccaacgtgcttttcagttacactttcagttctgtcagtgtttccttcatgtattttataaagggctctgttaagtgcatgtatgtttataattattatatcttccagatagtttggccctctgagtggaaaaaaactcagtttctttcacactgttctcacaacacgcttttttttttttttttttttagatagagactcacttcgttgtccagtctggagtgcagtggtgcgatcttggctcactgcagcctctgcctcccaggttcaagtgattctcctgccccatcctcctgagtagctgggattacaggcacgcaacatcaggaactgctaagtttttttgtatttttagtagaaacagggtttcaccgtgttggccagactgttatcgaactcctggcctcatgttctgcctgacttggtctcccaaagtgctgggattataggcatgagccaccgcgccaagctcgcaacacacttctgacaccagatgtgtgaggatttctccctacagcaagcaataatttctgcaggcagcctgcttccccttttgccctccagagccaggctccacaggagcccgagagatcctttaaaatgtaaatacagaccgggtgctgtggcactttgggaggatgacgcgggcagattgcttgagctcaggaattcgagaccagcctgagcaacgtggtgaaaccccatctctaccaaacaaaaacaaaaacaaaaacaaaaaaaattagctgggcgtggtgatgcacacctgcggtctcagctacttgggaggttgaggcaggagaatcacttgagcccaggaggtggaggttacagtgagttgagatcgcgccactgcactccagcctgagccacagagtgagactccatcttagaaacaaaaagtaaatgcaaccctgtctctcctgctcctgatcctccagtggctcctacccagggatgggctgtgcttcctccctggctgacatctatcatagaagaaagggcgtgagatgcttcatgacgagtaactcctggtttctggatatattcaaatacagagttgcctccttctcatccaggccacttggagatgagagcactgttgactttagtagcatctcctggtccccttgtaggttccagtctaggccttgggagagccaagaggacctcttgaacaacggctatcatcagaaagcttctgcacttcacttaccttctcccccagccatacccggcttcacattttctcctcctcttttgcagtcaatgcagaccctgcaggacttgctcactgatcttcatgcactccaggtcaccatcacagccctcagaaaagaagtggacatgctgaagaacatgcttgacaaggtaggccctcccccagcatcctccatgccagctgcgttgctcaggcctctgggggttggagcaatgaggaaaatctaggaagcttactgttaggccaagagtgcagctgtgagggtgtggtcatgtggaccctccaattggccagtgccaccgacttctctgtgacccctccatgctttcttttcttttcttttttttttttaagacagagtctcactctgttgcccaggatggagtgcaatggcatgatcttggctcacggcaacctctgcctcccgggttcaagtgattctcctgcctgagcttcccgagtagctgggattacaggcacgcaccaccacatctgggtaatttttgtatttttagtagagacaggggttcatcttgttggccaggctggtctcgaacttctgacctcgtgatccacccacctcagcctcccaaagtgctgggattacaggtgtaagccaccatacctggccgacccctccatgctttctaccccagtgtgttaaaacgttagttgtaagtgacagaaatcacgttcatcctggattaggcaaaataagggatttattgtctcatttactaaaaggtccagggacggccagatctaggtactcatgcaatacttatatttctttttttttttgagatggagtctcgctctgttgcccaggctggagtgtagtggctcgatcttgactcactgcaacctccacctcccgggttcacgccattctcctgtctcagcctcccgagtagctgggactacaggcgcccgcccccatgcccggctaattttttttgtatttttagtagagatggggtttcaccatgttagccaggatggtctcaatctcctgacctcttgatccgcccgcctcagcctcccaaagtgccaggattacaggcgtgagccaccacatccggcaatactgacgtttctcagtgaaactttcctcccagttggcttcattctcaggcaggtgctcctcaagtcttggcaacagcagacttatattccaccaacctagcaaaaagaaaacctcttccccttctggaaagctctgtccacatggaaagtggaataatcataatagtgcaggcatacatacaagctccttctgtacttctgtagccaaaaaccatcagccaagtattttctaacaccctaccatgcatggaaggacatggagtccccgagacatgaggcagctgtccccgtcacaactgatgagtcacagctggggtctgaagccagctctccacacccccaggtttaacaacttcccccaaatagtgtaattttctgtatcatcccggcttcacagatcagggcctgtatttgatcatcatggcaactgtgggagctttaggcatgggctggatggctcccatctaagcagaaagaacgctgttaaaagctgcatcatgagctactcaaaagggccccttagacaaagctgttggagaaaccatgccttctcggcggggcctggtgtctcacgcctgtaatcccagcactttgggaagccaaagcaggcggatcacctgaggtcaggagttcgagaccagcctggccaacatggtaaaacccccgtctccactaaaaatacaaaaattagctgggtgtggttgcaggcacccgtaaccccagctactcaggaggctgaggcacgagaatcacttgaacccaggaggtggagattgtagtgagccaagattgcgccactgcactccagcctgggtgacagagcaagactccgtctcaaaaaaaaaaaaaaaaaaaaggtggggtcggtggggcggcatggtggttcacgcctgtaatctcagcattttgggaggctgaggtgggcagatcacaaggtcaggagatcgagaccatcctcgctaacacggtgaaaccccatctctactaaaaatacaaaaaattagctggatgtggtggcaggtacctgtagtcccagttactcaggaggctgaggcaggagaatggtgtgaacctgggaagtggagcttgcagtgagccgagatcacaccactgcactccagcctgggcaacagagtgagactctgtctcaaaaaaaaaaaaaaaagaaaaaagaaaagaaaaacaatgccttattggcctgtctcttggaggtgtttttgttgttgttgttttgttttgtattctttttgagacggagtctctctctgtcacccaggctggagtgcagtggcacgatctcagctcactgcaacctctgcctcccgggttcaagtgattttcctgcctcagcctcctgagtagctgggattacaggtgcaagccaccacgcctagctaatttttgtgtttttagtggaggtgggggcttcaccacattggtcaggctggtcccgaactcctgaactcatgatccacccgcctcagcatcccaaagtgctgggattacaggcatgagccactgtgcccggccctcttggagattcttaatgtgcttttgctcattcaaggctctgggaagtcctgccgtacagaaacctgttgaaatgttttttatttatttatttatttacttatttttgagacaaagtctcactctgttgcccaggctggagtgcagtggcgccatctcagctcactgcaacctctgcctcctggattcaagtgattctcctgcctcagcttcctgatagctgggattacaggcgcatgccatcaggcccagctaatttttgtatttttagtagagacggtgtttcaccatgttggccaggctgctgtcgaactcctgacctcaagttatccacccaccttgacctctcaaagtgctggggttacaggcatgagacactgtgcccggcctgacatgctttcaagcccagcatttcccaaacttgtttgcccatggaaccctttcccactccttgggaaacactggatttggaacccgttcttccttctcaagctcttagtcacctagagccacgggaaaaggcaggggtgggacagaacctggacccccagtccacagactcagttcctttgacaggtacacccagaaagaatggacatctttgctgaagacttcaaaatacagaactggaagatggttgcactgcagcgggaagtggtgagggccaccatccctgtcttcccccactccccctgggaccccccaacctcccgggtcctgggtgctgagggtagggaggtgcaaggaggagaacacagcctggaaaggtttctttgcaggtgtgggggacactgccccctccaggctcacagccctcattttctacccccaccttgcaggcttctctccagaataagtttaaaaccatccccaaaaccgaggacatggtgctctggagtggccttcatgatgccatgttcacctcagtgagtgaggaaggaaggggaggttagcaggaagctggggagcaggcgggtggctgactgagagtgggaggcggggctggaagccagcagagcccctctgccccctcttctgcaggaaattggttcatcaccactggacctgtggcagtctgtagagcagctcccagaggctgccctggcccagaccaccaagtaccttgaagctactcgtgccatccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtgtgacacctgggtccttgccagcaccttggcctgtgcttggacctgtgcctgccccaggtgcccagcctccaccactgggagactggcctgcactcccaagacgctggcctcttccccaaggctggcccagggtgggctcttggcctctgtgggacttaggtgtcctgcggccaactcagccccaaccctccagggccccaccaccagccactgagtttggctcattgtggcctcgaccactccagccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagttggcaaggatggggcccccaaggaagcacagcctaaggctccccagtctgcccttcaccggctgaaaaccaccgctgccatcgccgccgctgccgccgcagcctacgccgctgccacatcctccgctgcccaggcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctaggtaggcctggtctggccctgggaagggcacaagggagtggggctctccctgcagcctttgagaagtgtgtcctgtccttcactgggctccaccaacaaaatctgcattccaccattagccattctttcctttggcttaagcatttggctcttaacgagtctattcttttctgttgaatgtacaatgaggtcttatcttagggcagggaggctgttagggtctaaagttggcacgaggaaaatggcatgccaaaattactctcaaaaactcttgtggccaggcgtggtggctcccacctgtaatcccagcactttgggaggctgaggtgggcggatcacctgagaccgcaagttcaagatgagcctgaccaacatggagaaaccccgtctctactaaaaatacaaaatttgctgggcgtggtggtgtatgcctgtaatcccagctactcgggaggctgtggcaggagaatcgcttgaacccaggaggcagaggttgcggtgagccaagatcatgccattgcgctccagcctgggcaacaagaacgaaactctgtctcaaaaacaacaacaacaaaaaaaactcctttgtgatagcccataaaacagtattgtattggctaagcatggtgactcatgcctgtaatcttagcactttgggaggccaaggcaggaagactgcttgaactggaagttcgagaccaccctgggtaacatcaagacctcatctctaaaaaaatttttaaacactagctgtgtgcggtggctcacgcctataatcctagcactttgggaggccaaggcaggcagatacggagaccatcctggctgacacggtgaaaccccgtctctactaaaaatacaaaaaaattagctgggcatggtggcgggcgcctgtagtcccagctactcaggaggctgaggcaggagaatggcgtgaacccaggaggcgaagcttgcagtgagccgagatcgtgccactgcattccagcctgggcgacagagctagactccgtctcaaaaaaaaaaaattttaaacattggccgtgtgcggtggctcacgcctgtaatcccagtcccttgggaggatgaggcaggtggatcacttgaagtcaggagttcgagaccagcctggccaacatagcgaaactccgtctcgactaaaaatacaaaagttagccaggcttgatagtgcgcgcctgtaatcccagctacctcggaggctgagacaggagaaacactttgaacccgggaggcagaggttgcagtgagcagagattgtgccactcccgcctgggcgatagcgagactcctcctcaaaacaaaaaaaaaagcctgagtggtggcgcaggcctgtagtcccaactactcaggaggctgaggtgggaagattgcttgagcctagcagttcaagactgcactgggttatgatcgtgccactgcactccagcctgggcaacagagtgagaccttgtctccatacaaacaaaatttaaaaaaaaatttttttaattattgttattattttttgagatggagtttcacttttgtcgccggttggagtgcaatggcgtgatcacagctcactgcagcctccgcctcctgggttcgagagattctcctgcctcagccttccaagtagctgggactagaggcatgtgccaccaagcctggctgattttcgtatttttagtagagatggggtttttccattttggccaggctggtctcaaactcctgatcccaggtgatccacctgcctcggcctcccacagtgttgggagtacaggcgtgagccactgcacctgataaaaaaaattttttttaattaatttaaaaactaataggccgggtgcggtagctcatgcctgtactcccagcactttgggaggctgaggaaggcggatcacgaggtcaagagatcgagaccaacctggccaacatggtgaaaccctgtctctactaaaaatacaaaaattagctgggcgtggtggcgtgtgcctgtaatcccaggtactcgggaggctgaggcaggagaattgcttaaacccaggaggcggaagttgtagtgagccgagatcgcgccactgcactccagcctggtgacagagcgagattccatctcaaaaaataaattaattaaaaaataatgaagaaataaataaaaaggtaccacaagctgcgaggcccagtgcatttccactgggcagtgctgcctgagatgctccataagagaagcagctagagcccaacagaaacatcttcctccatccgagccctcagcagccaccctgtcctctgctttcagccaatatgggaggtccttccagcctcgggacaacagtggacatattgcagaaaaagattggcagcctccagaaatctaggctcaaggttagtgtctccggcgaagggcttttgaggcagtgatggcttgaggtgagctggctgaagactccttgactctgcccccctcccaggtgcagctgtgttctgcagcaaaacaggctgggggaaagcgagctggctgcgaaggcagctgctgcctctcaaagctgattcactggtgcggtgggggggcccagcaggtgtggggctacacggttctgtgtctcaggtggctgttcagagggcaggtgaagccggtgcggtggctcatacctgtaatcccaacgctttacaaggctgaggcaggcagatcacttgagctcaggagttcaagaccagcctgggcaacatagtgagatcccttctctgcaaaaaaatacaaaaattatccaggtgtggtggtttgtccctacagtcccaactactcgggaggctgaggtgggaggatcacttgagcctgggaggtggaggctgcaatgagccaagatcacgccgctgcactctagcctgggtgacagagcaaggccctgtctcaaaaaaaaaaaaaaaaaaaaaaaaaaatggcaggtggaaggcaccctggtctgataccttatttttttttttttttgagacggaatcttgctctgtcatccaggctggagtgcagtggcgtgacctcagctcgctgcaacctctgcctcctgggttcaagcaattctcctgcctcagcctccctagtagctgggattacaggggcccgccaccacacctggctaatttttgtattttttgtagagactggtttcgccgtgttgggcaggctggtctcgagctcctgacctcagttgatctacccatcttggcctcccaaagtgctgggattacaggcatgagccaccacgcccagcctggtctggtacattcttcttggcctcaaccctccctcaggccccttcccggccatggtaacttcagaagcagaggcctggggtgtctgtgtctcccccttttaggaggaagaacttgagagaatttggggcaaccaaatagagatgatgaaggatcgctacatcactttggacaaggcggtggagaacctgcagattcgcatggatgagttcaaggttaggaggactgggtaggctggagaagggctggcaaagggagaattcctcacctagaccttctggcccttcccgaaggttctgcatgaggtggggatgcacttgaggctgggaaccagtggggctttactggcattttactgtgtgtaaattacacttcaatgaaaagcaaacgaatcccaccacccccccccacccatataaacagaagggccgggacaatgttcgtctttttgaccactgcgtcacctgcccctggaagggcaggggtagtgaaggctccatcacatttgctgaatgactcagtgaatgattaagagaacttcttgtgccaactgttacattcttaacatttccctgagccaagaggtagaaatatttactgacattttgggctgggtgataaaaataaaaaaataataataaaaagaaatatttaggctgggtgcggtggctcacatatgtaatcccagcgctttgggaatctgaggtgggaggatcacttaagacaaagagtttgagacaagccagggtaacacagggagaccccatctctacacaaataaaaaatttagctgggactgggcgcggtggttcacgcctataatcccagcactttgggaggccgaggtgtggtggatcacttgaggtcaggagtttgagaccagcctggccaacatggtgaaaccccgtctcttctagaaaaatacaaaattaggctgggtgcagaggctcacgcctgtaatcccagcactttaggaggctgaggtgggcggatcatctgagatcgggagttcgagaccagcctgaccaacatggagaaaccctgtctctactaaaaatacaaaattagctgggcgtggtggcgcatgcctgtaatcccagctactcaggaggctgaggcaggagaatcccttgaaccggggaggcagtggttgcggtgagccccgatcgtgccattgcactccagcttgggtaacaagagcaaaactctgtctaaaaatatatatgtatacatatatatatatatatatatatatatatatatatatatatataattagccaggcgtagtggcacacacctgtaatcccagctacctgggaggatgaggcaggagaatcgcttgaacccgggaggtggaggttgcactgagctgagattgcgccattgcattccagcctgggcaacaagagcgaaactctgtctcaaaaaaaaataaaaagggccaggcgcggtggctcacgcctgtaatcccagcactttgggaggctgaggcgagtggatcacgagttcaggagattgagaccatcctagctaacgtggtgaaaccccatctctactaaaaatacaaaaaattagccgggcgtggtggctggcgcctgtagtcccagctactcaggaggctgaggcaggagaatggcatgaacctgggaggcagagcttgcagtaagccgagatcccaccactgcactccagcctgggcgacagagcaagactccgtctcaaaaaacaaaaacaaaaacaaaaaaacctagctggatgtggtggctcatacctgtgatcctagtactttgggtgcagaggcttaaacctgtaatgagggaggattgcttgaggccaggagttcaagacttggccaacagaagaaaactgtctctacaaaaaaaaaattataaaattagccaagcgtggtagcacatgcctgtagtcccagctacctgggaggctgaggtgggaggattgcttcagcatgggaggttgaggctgcagtgagctgtgactgcatcactgactccagcctgggtgacacagaaagaccatctcaaaaaaagaaagcaaagaaacaagcaaaaagcaaaaaactcactaacggccaggcgcggtggttcacacctgtaatcccagcactttgggaggctgaggcaggcggatcacctgaggtcaggagttcgagaccagcctggccaacatagtgaaaccccgtctctactaaaaatacaaaaattagccgggcatggtggcggatgcctgtaatcccagctactcgggtggctgaggcaggagaatcacttaaacccgggaggcggaggttgcagtgagcgaagattgcgccattgcactccagcctgggcgacaagagcaagactcagtctcaaaaaataaataaataaataaataaataaataaataaataaataataacccaccaaggttgtttccgtgaaggcttccaagtcggggggctgttgctgggatgcactggggtgtgttgggggaaaagggaccaaggaaacccatggcgtatggctgaccccaaggctggcacactgtaatcaggctgggacccatttgaggcaactttgaatggaaaataactcattaaaggggaaccaattcacagcctatgaagtgggggtggacaggagggttggctgtctctggagatgctgggccgagtgtgggtggactgcatgcaggggtacgtgctcagactgtgcaccactggccaggaaccaggtctcctgccaacactcctcttcagagagacccaggccaccatgtcctggggtcatcttggtgccctttctccatggagctggagccagttccattcagcatgtccatcgtgcacccagcactacgccagaccctgcatgggggtgagcaggggctgcagtgtctgcctgcgtgtccgtagttgtcacttattagaaagactctgaagctgatgaagccctgccacgtgtgccaaaacagagcacatcccttgtcccaggaccgttgtcccagcttcctggctcttgtgctatgaagatttcattgctggccaggctcggtggctcacgcctgtaatcccagcactttgggaggctgaggcaggcggatcacctgaggtcaggagttcaagaccaacctgaccaacatgatgaaagccgatcgctactaaaaacacaaaaaaatcagctgggcgtggttgcgggtgcctgtaatcccagctactcgggaggctgaggcaggagaatcgcttgaacccgggaggcagaggttgcagtgagccgagattgtgtcattgcactccagcctgggcaacaagagcaaaactccatcttgggaaaaatctcagcactttgggaggccaaggcaggaggatcccttgaggccaggacttcaggacgagcctggacaatacggcaaggccccatcgctaaaaaaataaaaataaaaatattagccagatgtggcagcgtacgcctatagtcccagctaccagggaggctgaggcaggagaatcacttgaacccaggaggtggaggttgcagtgagctgaggtcatgccactgcactccagcctgggtgacagagtgagactctgtctcaaaaactaaagtaaactaaaatacagtcttaggattttgaaccacacaaatggtttgtattaccaatagttaaagaagaaaaataaaaaataatgtagaacaagtgtgggaataggcaaatcaataggccaagaagactgggcatggtggctcacacttgtaattccagcactttgggaggccgacatgggcggatcacttgaggtcaggagtttgaaaccagtctggccaacatggtgaaaccgtgtctctactaaaaatacaaaaaaattagccaggcgtggtggcgcatgcctgtaatcctagttacttgggaggctgaggcaggagaattgcttcagctcaggaggcggaggctgcagtgagccaagatcgcaccactgcactccagcctgggcgagagagcaagactgtatctcaaaaaaaaaaaaaaaaaaaaaaaataggccaagaagaccagatctaagatttacaagaatttagcatatgaccactacaggaaggatggattactccacaaccagtgttaggaaaaccatttcaaggaataacagtaagtcttaagtccgatagcaatcctctagatgacacaaggcagtagcacggtgacaaatgcaggatgggagcaagatctcatgactgtgtctctgtcttgctctccaccatgtgacttacatgtaagacttaggtttcccagtgtcgttttgggtcttgctctgtcccccaggctggagtgtagtggcctaatcatggctcagtgcagccttgaactcccaggctcaagtgatcctcccacctcggcctcctgagtagctgggactacaggcgtgtgccaccatgcctggctaatttttttttttgagatacagtctcgctctgtcgcccagcctggagtgcagtggcgcaatcttggctcattgtaacctccgcctcccgggttcaagcaattcttctgcctcagcctcctgagcagttgggactacaggcgtgtgccaccatgcctagttaatttttgtggtttttttggtttgttttttgtttttgttcgaggcagaatttcactctgttgcccaggctggagtgcaatggcgcaatcttggcttactgcaacatctgcctcccgggttcaagtgattctccttcctcagcctcccgagtagctggggtaacaggcgtttgccaccacactcggctaattttttattttgagtagagacagggtttcaccacattggccaggctggtcttgaactcctgacctcaggtgatttgcctgcctcggcctcccaaagtgctgggattacaggcgtgagccaccgtgcccagccaatttttttgtatttttagtagagatggggtttcaccatgttggctaggctggtctcgaactcctgaccccaagtgatccacccacctcagcctcccaaagtgctgggattacaggcattagccactgcgcccagccaaaataataagattataaaacatgaatatagcctggcatggtggcttgcacctatagtcccagctactggggaagcagaggtgggaggatcactggagtctgggaggtggaggttgcagtgagctgagctcgcaccactgcattccagcctgggtgacagactgagaccctgtctcaaaaaataaaaataaaaagcataaataaggccaggtttgatggctcttgtaatcccagcactttgggaggctgatgggggaggatcctttgagcctaggagttccagatcagcctgaggcaacatagtgagacccctgtctctacaaaaaaaaaaaaaaaaaaaaatccaggtaggtggtgtcacctgcagtcccagctcctctggaagctgaggcaggaggcttgcttgagcctggaaggctgagactgcagtgagctgtgatcaagccactttactccagcctgagtgacagagcaagagcctgcctcaaaaaattaaaataaaaaaattaaaattaaaataaagaggaggtaacagagactcagcaaagaaacgagcccaagcctgctgggctgggagggggcctggagtggctgtggttcagagcccaggctttggaacagacgtgcctaggtttgaatcctgattctgccacctgctggttggatcagttccctgcggttgctgcggcaaatcactcttggggttctggaggcgggaattctgaaatcaaggtgtcataggctgtgttccacctgaaagctcagaggggcctcctcgcctctcccagcttctggtggttcaaggtgtcccttggctttggagcaacttggatggaggccggggtcattattctaagtgaagcaactcaggagtggaaagcaaagactgcatgttctcacttgtaaatgagctaagccataggtgtgaaaagacagaccgagcaggataatggacacaggagactcaggataatagagagagggaaggatagaaaactacatattggagccaggcgcggtggctcacacctgtaatcccagcactttgggaggctgaggcaggcgaatcatttgaggtcaggagttcgagaccatcgtaaccaacatggtgaaaccccatatctactaaaaatacaaaacttagccaggcgtggtgttgggtgtcagtgaccccaactactcgggaggctgaggtgggagaatctcttgaacccgggaggcggaggttgcagtgagccgaaatggcgccactgcactccagcctgggcgacagagcagattctgtaaaaaacaaaacaaaacaaaacatgttaaagatacccattcacttctgttgacaccccagtggccacactaagctataagagaggctgtgaaatggagtcttgattctgggcagctgggttccagctaaaagtccagagttctgttcgtaagcgtgagcgggacacccgacaggaagagagaagtagaagcctgtttgcagctttgcaggaactatggcccgaccctctggggaaatggaggctcttcccaagctgaccagctgctgctcctattacaatggggatgtagtaattggagagagggtggaattcatgggggcagttggttctttgtggagttgtggggataggacgtgaggtttttccctaacgcttgagcacagtgtgtgtggctgtgataagtgctcagttcatagtagactggagttcctgctgggaccccaggacagatcagaagtagtaaacatgccttaaacatccagggagcgaaatcgtccacattggtttgtgctttccttccttgggtctaactccccgtggaggaaagttcctatgataccatctctgaggggacagcttgtcccaagtcgcacgttccttcccttttcatctgggcacctggagcccttgagcctgagtcttgtaacgcccatgcccacctgcctgctgtccacacggcctgctatccctccccagcatatggtaatggtagaggtgggaggttgacattttatcctcaaggctctccaggatggcagacatgcctgtgcttctgttcttagactctccaggctcaaatcaaaagactggaaatgaacaaggtgaataagagcacgatggaggaggagctgagagaggtgagtgagcagaggttcctctgccttccctgctcccctacccagggaaacggcaccatccaggcaaagcccaccaaagagtcttccagaatttccctccccctttgttcatattgaaaccaggagttggctgggcgcagtggctcatgcctgtaatcccagcactttgggaggccaaggcgggtggatcacctgaggtcaggaattcgagaccagcctgcctggcctacatgatgaaactccgtctctagtcaaaatacaaaaagtagccaggcgtggtggcaggtaactgtaatctcagctatttgagaggctgaggcaggagaatcacttgaacctgggaggcagaggttgcagtgaaccaagatcatgccattgcactccagcctgggcaacaagagcaaaaactctgtctcaaaaaaaaaaaaaaaaaaagaaagaaagaaaaagaaagaaaagaaaggaaaacaggaggcacatcaactcccattttcagcaattgaggattattaacactctacttgaaaatcacacatcagctgtgcacagggtggctcatacctgtaatcccagcactttgggaggccgagaagataggatcacttgaggccaagagtttgagaacagcctgggaaacataggaagatcacatctctacaaaaaaataaaaaaatgaactgggcatgatggaacatgcctgtagtcccagccactcaggaggctgaggtggaaggatcccttgagcccaagaggtggaggctgcagtgagctatgattgtgccactgcaatccagcctgggcaaccttgaacaagatcctgtctcaaaaaaacacataataataaaatacatcaacttccctgttataggaaaaccttggctttgatctcgagatcgtgtttgaatccacgtagaccccagggttgcatttaagccaaggctaaaagtccagagtcccaaactagaagcatcagacccaaggggtgtgatgtctcccagctttgccttcctccatcccagcagccatgcctccctgaactccctgtctccctagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaaggtgaatgcccccatgttgattttcactttattcctaacaaattaacccagaacttagcaactgcaaacaacaaacgttttcagtttaggaggagcaagaatttgggagtgacccagcaacttagctgggtggctcagggtttcctgtgaaattgcagtcaagatgtcatccagggctggtctcatctgaaggctcgaatgaggctggatgagccaattcaaagagattccctcacatggctgttggtaacactcttcagttcctcatcccatggactctgcctttgggccacttgagagtcctcatgacattgcagctgacatctcccagatcaaatgatccaagaggggaaggaagaagcagcaatgtcttttttttttttttttttttttttcatacagggcctcactctgggcacctgccccatacatagtcaataaatgaattgatccccatttcacagaggagaacactgagcctcagagaggttattatacttccctcaggaaacgctgctgctcatggtggagcttgagactcaaacccagagctgcctgattctaaacctaatttaacctctttgggccagtccagccacctcagttgcaagaaccatgtagcactgttgttggaccaactgttccagtctactatgaggaaggggctgtgactcctctagacacttccccggggtctgacacatcactggcagtcagtaaacgatgaatgaataaatgaatgactgtcacagtccctcagagactctcctcctccaccccacatccctgcacttacgcagccaggagagtggcatagttagcctccagggcggtcgccaaccatacctcttggtattcacacagttgtttagccccctcccacattgaatgggaccagcttgtgtaacctacaggatattagagagatgatggagggtgaccaccttccatcataaaagacattgcagccagttgtggtggctcacgcctgttatcccagtactttgggaggccaaagcaggcagatcacttgagcccaggagttcaagaccagcctgggcaacatggtgaaactctgtccccctaccaaaaaaaaaaaaaagccaggtgtggtggcacatacctgcatttccaactactcaggaggctgaggtgagagaatacctgagcctgggaggttgagactgcagtgaaccaaaatcgtgccactgcactccagcctgggcagcaggagcaccctggcaggcactcagagtgaaaccctatctcacaaaaaaaaaaaaaaatgggcgcagaacaaccaaaagcaacacatgaagagattttacttgtttcctggtttaattgaaccacatctacaaatgggctggagatgacatccaattcaggaatagttgctaattgtattaaacatgataatagtgttgtggttatataataaaatgttatcacactcaaatatttattagtgaaatgtcaccatttctgtaacttaaaaaaaatactccatcggctaggcacggtggctcacgcctgtaatcccagcacttcgggaggctgaggcgggcagatcacgaggtcagaagattgagaccatcctgaccaacacggtgaaaccccatctctactaaaaaatacaacaaaaattagccaggcctggtggcgggcgcctgtagtcccagctacttgggaggctgaggcaggagaatggcctgaacccgggaggcagagcttgtagtaagccgagatagcgccactgcactccagcctgggcgacagagcaagactccgtctcaaaaaaatactccctcgggtggcacagtggctcacacctataatcccagcactttgggaggttgagatgggaggatcacttgagcccaggggtttgagaccaatcctggcaacatagagagactccatctctactttaaaaaactatttttggccaggcgcggtggctcacacctgtaatcccagcactttgagaggcagagatgggtggatcacttgagatgaggagttcgagaccagcctgaccaacatggtgaaacactgtctctactaaaaatacaaaactagccggatgtggtagtgggggcctgtaatcccagctactcgggagactgaggcaaggagaatcgcttgaacccgggaggtggaggttgcagtgagccaagatcgcaccattgcactccagcctgggcaacagaagtgaaactctgtctcaaaaataaataaataaataaataaaataaaagtaaataaataaggccaggtgcggtggctcacacctgtaatcccagcactttgggaggctgaggcgggcagatcatgaagtcaggagtttgagaccagcctggccaatatggtgaaaccccgtctgtactaaaaatacaaagattaggctgggcgtggtggctcacgtctgtaatcccagcactttgggaggctgaggtgggcggatcacctgaggtcaggagtttgagaccagcctggctaacatggtgaaaccccatgtctactaaaagtaaaaaaaaaaaaaaaaaaaattagtcgggtttgggggcacacgcctgtaatcccagctacttgggaggctgaggcaggagaattgcttgaacctgggaggcggaggttgcagtgagctgagatcacaccactgtactccagccagggcaacaagagcgaaactccctctcaaaaaaaagccaggtgtggtaacacgcacctgtagtcccagctacttgggaggctgaggcagaagaattgcttgaacccgggaggcggaggttgcagtgagcagagattgcaccactgcgctccagcctgggcaacagagcgagactctgtctcaaaaataaataaataaaattaaaaataaataaataaatacgattgattatgatggtcacacaactctgtaaatatactaaacgccataaacctgcccactttacatacagaccgtcaataaacatgtgttgagtgtgtgaatgtcaggtgcagtgggaccattgccagaaaggtgtctcagaccgcccagcctgcagctgagcttggtttgatttggtcttttgcagacagtagctgatggtgttttttgcttctgctgctaggaagctcaccttgcagctcccctctaccaatagcatctagtaggggttgagcctcatcgaagctgtgtcattttccctttcctggactccctcactattttagttgaattttgttacaccgtgtaacttcccaggttgctgcaaccctcttctggaaggaggcagggtgtgaattcatagagtattctttcttatcttccccttggctgttggcagttagtccacagtgatctggatcccttgaagaaagaaatggaagaggtctggaaaatcgtccggaagctgctgattgagggcttaagactggatcctgacagtgctgctggctttaggaggtgagtgcccgcccgagcccctcctggtaggggtcctgctgcccaggctgtggggaacacaccctggaagctctgggaggaaagattccagacctttggatgaggggatgggggcttggctgtggctgaaagcactgaggaggagggaagctctggcctgagctggcagaggtgatccagccctattcctgccaatggggaaaccaaggctcagagagggaaggggactgggcagatccaggacccctgacccccacccagacagtgccccaggcagagggacccaatatttatggggctcctgtcctcagaccacccctcacacagctttaaaaaccatccgttgtgtttggggcggcagagaaaccacaagagtggttggagactgcagggcctgtggggctgagctgggccgggcactggcaggagggatgcagccctggggctctggctggctgcagcctcccacacatggcctgggcccagcaggggcagcggctgatgatcatgtgcctttcaggaagctgttcaagcgcgtgaagtgcatctcctgtgaccggcctgtggagatgatgactggcccgtgagtaccaccgcccagggtgccccggccctaagggcttgtggggcccatggaggtcatctccgtgcacctccatgtgcaccgttccatgcacgctgtgtgtctacacatccatatacagcattctctccagccatcaagtccatacacgcccacatgcaccattctctatgcaccaggtatctacacatccacatccactgttctgtaccgtcaagtccatacacatccatgtacactgttctgtatgtgccatgtgtatccacattcatatacagggttccccagccttcaagatacacatgtccacatacactgttctacagccatcaaaaatatacaaatatgcggccttgtatgatagcgcctgcctatagtcccagctactcaggaggctgagatgggaggatggcttgagcccaggagttcgaggctgtagtgagctaggattgtgccactgctctccagcctgggtgacagtgagacctcatatcaaaaaaaaaggccatgttggcaaggctggtctcaaactcctgacctcaggtgatccgcccacctcagcctcccaaagtgctgggatcataggtgtatgccaccgcgcctagcctggtttttacttttggaaatagaacaattgttttttgtgtcttactgtgatgatcagaggtcctgagatgcctttcgggggggccccttctacttctatgctgtggacgcttctggcattcgagggtggtgacctgagtctgcacctccttcctcctgctgggaaggcttcctggaggggtgggagacgagccctctgctggcctagcacgcctcccacagcccctgctgtgcccttgtcctccaacagacagctgatcaccatccgcaaagcccacctgctgtcccggctgcggccagccagcgccaacagctgcgagtacttgcagcggcaacagatgaggtgagcaggatgggcgccccgcagggaggccgccccgcatggaggccactctggagcctgggaaccctgttcctgcagagacacatcctccaggcccagggacctaagattgtcctggacatggccagcccttcgcaagacaggcactccgagaggtggctggggcggcagacaggcccacgagatgatggcggagggaggaactgacatatttactgcacatctattgtgggccaggaactgttagacggtttcttatttaaatctcacaaccccctgtgagctagggttcctatgcccatgtccctgtttcttggcggagggaatcggtgatgatggggaaccctcagggagccgctgctgtgcccggcaggcactgtgccaagcgctggggctcacctggccttgttgagtcctcacagctgccctctaagatgtatcctggtaccatcccatgtcacagttgaagaaactgaggctcagagaactgcagtgacctgcccaaggtcactgctagcaagtccagggctgatgtccaaaccctcaggtttccaccgcacccagctggctccctgggtgccagccccacccctcaacctcctgacatcccacagctctatggatctccccagcctccaaccctgctgtggggacgtctggccaggtgggggaagaaccggtgaatcgtcaccacagccgtgggaaggggagggacgtgggggcctgtgctgactctgccaccctccctccctggctccttgagatcaagagattagaaggacacgctcttcaggccaggggtccaaagggaaatggctgggtctggggaaatgcaggtctcaatttgattcctctgccccactgtgtgtgtctgtatccatccgccaggccccaggcctgcctggctgtgccagctaaacacaagctgaaagaaatgctggtcttccctcgatgctggccaggcccttggggcccgtcctgggctctggggtacagggtctccaggtcgctgctgacccactgccctgctgcagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgtgagtctggccggggcctccttctcagagggtggacgtcagcgcaccccagccccaggtgtgggaccaggcactgagcagtgggcaaccccagcagaggctgcactctgtctcctgggcttctgcgtgtaccaaagttcgggggcagatcgggtcgggggctccctaacccgggacctgggccatccaacaggccgaggtggacatcctgggcgtggatgggatcctgtacaaaggccgcgtgaacagccagcgtggggctcagcccttggccgtcgcaaaggagctggcaggtgaggggcgtagggctccctggggcacccttgcctggggccctggttctgctgggcagggtgagagggtgcaggtggggcccagagccagcactatccctgaccggggagtcctcacacagtcagtcacaaaaattgggtcacagcaggcccccaggagactcagtctttgcaatgggggagggagaccgcgggagcgaggatctgctgttcccgagatcaacagctgaccagagagagggccgtggccacaggaccatggcctgtgacgaaggacgatgagctaggaaaggtgctgggctggtgccaagggacgccagtccacggaggacggactggacagctgccctgaagcccttgaagagggactaggacttagctggatgaaggggtcgggtgagaggagagtggtcgtgtggcaggaacggtgggtgcaaaggccctgtggtgggtggaagccactcacaggcaggagctcaggacgccgagtctccctgaagggtggagactggggtggggcagtggggtgacaaggaggagacttgggccagaccccagaagctgtgtgttaatatcacaggcaagggttgggccagcgggagacccagaattgtgcacatctggaatcagtcaatgtggttgctgcagtgctgaggcccggctctggccggctcctgctgggaccccaagactctggagtccatcactgggttcgaaggacaaaaagaggagccttctctgcacaccccttgaaggctcttcccccttggggatggggagttctaaattttgcccctgggtgggagctacacgccgccccataaggagcagtcccggagccacaagatggccggggcctgaactccacctgcagaaattctggttttttgttgttgttgttgttgttgtttgtttgtttttgaggcggagtcttgctctgtcgcccaggctggagtgcagtggtgcgatctcggttcactgcaacctccaactcccgggttcaagcgattctcctgcctcagcctcccgagtagctgggataacaggcacgcaccaccacgcccggctaaatttttgtattttttagtagagacggggtttcaccatgtttggcctcaagtgatccacctgcctcagcctcccaaagtgcaaggattacaggcatgagcctctgcgcctggcccaccggcagaaattctttcttgccaacgctgtgcctccattgactcgaagaccagacatggaagaagggaagggggactgtttcatcaatgtgctgggcaaaggaggaggcaccctgattcgtctcctggggttgccgagacaaattaccacaagcagggtggcttaaagcagctgaagttccttcattccccggcccatgtagcacgccgtcccattggccgggcacggtggctcacgcctgtaatcccagcactttgggagaccgaggcgggcggatcacaaggtcaggagttcaagactagcctgaacaacatggtgaaacctcgtctgtactgaaaatacaaaaattagccagccatggtgacacacgccgttaatcccagctactcaggaggctggggcgggagaatcacttgaacccaggaggcagaggttgcagtgaaacaagatcacgccactgcactctagcctggacaacagagcgagacttcgtctcaaaaaaaaaaaaaaaaaacagctgaagttccagctgggcaacaacaaattagctgggcatggtggcgtgcgcctgtagtcccagcttctcaggaggctgaggcaggaggatcgcttgagcccgggaatttgaggctgtagtgagccatgatctcaccactgcactccagcctgggcgacagagccaggccctgtctcaaaaacaaacaaacaaacaaacaaaaacagaacagaacaaaaccaaacaacaacaacaacaaaaacaaaatacagccagagttgatcctcccgctgtcctggaggctggaaatcctaaatcaaggagtcagcagggctgcactccctccaaaggcttgaggagggtccctccctgtctcttcagcttctggggccgatggcactccctggcacttctctgtccccatgtgagcttctcttctgtgtgtcctctcctctgtcccccataaggacatttgtctttggatttgtgcccgacctaacccaggatgatctcatctcaagatccttaagctaattatacctgcaaagaccctttctccaaataaggtcacattcacagcttctaggagatgtatctttttggggagcacattcaacacaccctgtttccaggcgggccagacaccgtctcaaaccctgcattctcctgggcgggatgtggcttctcctcgagaggactggccgttccagcccctgccccctgcctggtatctgctgggagggctcaggctgggcgtcagggatcaccaggcaggatcacaacggtggctaatatttaatgaaccccgacttcgtgccaggccctgccccacctccttcaccctccaacaacctgccaaggagtttcacaaatgaccagctgagtgagggctgcttgccgggcggccagggcagatggagtccacatctgatgcacccagtcctgtccccactcattcactggcctccccaagggctgtcatctagagggaggggctttcccccttggctcattcattcccaagacccacacagcaagccaggacttgaatcatgatggcgtcaactgcttcatcttttttttttttttgagacggagtttcgctcttgttgccaaggctggagtgcagtggggcgatctcagctcactgccatctcaacctcctgggctcaagaaatcctccctcttcagccttccaagtgactggaactacaggcgtgcgccaccacgcctggataatttttgtatttttagtacagatggggttttgccatgttggccaggctggtctcaaacatctggcctcaagtgacccacctgtctcagcctcccaaagtgctgggattacaggtgtgagccactgcgcccggcctcatgtaacttattgactactatatattacattgaaattgtgacggatttatagcatcttaaagctgaaaagtggtaagtcaaaccatcataaatcagggaccttctgtattagaaatcaattggaaacctgtctgtggccagatcttgatcagtttgctgttgtcactcatttatttccccaaaagaactttctaactcaaaacagactcaaagccaggtatagtggcttacacctgtaatcccagcactttgggaagctgaagcctgaggatcacttgagcccagaagttcgagaccaacctgggcaacatcgtgaaaccccgcctttataaaaaatacaaaaattagcagggcatagtgaggctccctgcagtcccagctacttggggggctgaggcgggaggatcacttgagcccaggaggttccagctgcagtgagccatgattgcgccactgcactgcagcctgggcaaaagaatgagacttggtctcaaacaaaaaagaaagaaaaaagaaaagaaatgtccagaatagaaaaatctatagacagaaggaaaattggtgatttccaggggctggggtttggggcggggaaagggagagtgactgcttaatggggacagggccccttttggggtaatgggaaagtttcagaacaagatagtggtggtggtgtgcaacgctgtgtgcgtcctaaatgcctctgaattgtgcactttaaactggttaattttacgttatgtggattttacttcgaataatgaaaaaaaaacaaaggtgaaggacaggaagatgggggcatttaggtgctctggcccccagcgggacagctaaaccataaatagccctgccagcatttcacctgtgtcttactgtgctgaaatcacgtcacactcctctctggcctagagttactttcaaagagccttcttttctttcttagccttgagacactctccactcaagaaggcaaggaaggctgggcgtaatggttcacgcctgtaatttcaccactttgggaggtcaaggtgggaggatagcttgagcccaggagttcaagactagcctgagcaacatagcgagacctcctccctaggaaacatttaaacaattaaccgggagtagtggggcacacctgtagtcccagctactcgggaggctgagttaggaggattgcttgagcccaggagttcaaggctgcgtgcgctccagcctaggtgacagagcggagaccctgcctcaagaaaaaaaaaaaaaaagaagccaaggagggaagaacattgattatcccataaaggaatggaccggggagcctgggaaatggggttggtcccaccagagggagactgcccagtgctgggatcggcctgacacaggcccaggggtggatgccacccacacctgtctcttttcttttctgctaagctgtgaaggctccatctcccccgtcacaaagcctgtatgaccgtgtgcactccagtgccctatttggcgccatctgcccccgtgagtacctggttcccagccccagcccagctgtgattctggaagggtctccagtccctcctcgtctcatcccatcccccacaccccgcctgggctctcctgtccacctcctccacctcctgcctgctttgcctgcctatggcacttcagagatgattcctggccccggtgccatccccggtgcccaggccaagcatctgtccccagcgtccacccagctgcaggggcggcaacaagggaactgaggttggaaggaactgagcttctctggttcggatcaccacgtagcaggcacctgagggtactttacagtttacaaggcagtttctcccttatctcatcagaacctcatcccgactcctgtgaggcaggcactgtttgcccatttcacagaggagggagcagaggctcggtcactttgagctgtggcccaagatcacagagctagtgagctgggagctgagcccagatccgtggactccaagcttcatgttctctcccgggggctctgctccatttaagcaaacattcctggtgtcatttatcttgggtcacccacccaggacatttagggtgcccagggcccaggtgaggtatggtgcccagccggccatggcctgtacagcacttctagtcctgggcttctcttctctttagtggggatggccccatcaggctagtgtctcccaagaaggttcttggcacacatctagggtttctcctgcccctccccagccctgtgcccccgctccagtgcctgctcagctgcctcgggccctcacctgacgatgccagctcgaccaccttccctgccacctctgctgctgctgccaccgctgattccatccctaagggacccccagcaggccccagggtccaccaggctctcaagagctccacacattgagtcccgagtcggcaggaagccccccgaggagcccgccaacccgtgagccccaccccgctgcgccccccatcgccaagtcccctccacgtccgaggctgaggcccatgtggccctcccactcccaccaagtcccctccacatcggaggctgaggcctatgtggccccccacccccacccccaccaagtcccctccatgtccgaggctgaggctcatgcgcccccccccatccctaccaagtcccctccacgtccgaggctgagacccatatgccccccccacccccaccaagtcccgtccccggctgagacccagggccctgagcctggcccagaaagggtgctggggccctggatagaggggaggggtctgtgtaggggacccccatgctgacccagtggctgttttatcctgtgcatataaatacaaacagcacagtgcacattctcattctacattgtcatataaacacagctttctagagtgaattttccaacaagccaatttaattccttgatccattttcaatacaacaccaagtggtttgaaaaacacttttccagccgggcacagtggctcacgcctataatctcaacactctgggaggccgaggtgggcggatcacctgaggtcaggagtttgagaccagcctggccaacatggtgaaaccccatctctattaaaaatacaaaaattagccgggcgtggtggtgggcacctgtaatttcagccactttggaggctgagacaggagaatcacttgaatccaggaggtggaggtttcagtgagccgagatggcaccactgcattccagcctgggcaacaaagagcgaaactcactctcaaaaacaaaaaacaaaacaaaacaaaaaacacttttcctttttatttgctgaaatgatttcattagaatcacttccaattacagttcctggcactgtgcctttcatttgggggccattatttccaagaccagttccccacgggaaccagactgggctgtgtgcatcctttttatttcatgttctttctaccagtaactagttattaatttttttaaacaaaatctgattgtttatatttgcctcttggctgatccatgaggaggctggtgcggcgcccgtgggatattctgggatggccatcccttccagggccaggtgccacttgcctgtttcaagcctttctggttcctgtgctcaccaccgatgcgtttggtggaaaaagagccaactgtgaggtcacacggtcttgctgcggcaattcagggattggccttggcacgcagagcagagggctcccccaggcccccctcccaacaatgctcctggcctcatttcttccccttctgacagtttgcctgtctctcccttcaatttcctccctttcaatcctcctccctctttcctttctcgcccctaacgctgtctcgttttgctctctccttctgtactattgacggttctatcccatctcggagactaaaacaatgtccctgtgcaggggtgaagcctgacccgccgccatagtccccagtgtccactggatccctggggtggtgctggggagttgaggggctggtggggagctgccaggagggagctggaggggggctcccctttcacttccctttggctgcctagggggggactttgggctccagtctctcccccggccccggtggccatcggagtctggggacactgcatgcctactctgttcctattgtcctcaaggtccctggcccagctcactgcgacccacgccccccaccctggctgctcttttctttctccaaagactgtgtccaaatgaggccaagcccctcttgacctgggtgacacctatccaagctgccttgggggtgctgtctggtgtagccctggcccccaccccgacccctataccacagatgagtattttgggcaatttctgcccagaacaaaatcttccacatttctgaccgtggatgaggggactggcggagtgccttctgtgtggggaggtgggacttgctggtccctcctccagccaccacccgaggctcagcccgtgggcaggagagaaggcacccagggtcacagagagagaggccccaacttgccggcccccaccaggaggctgaacctgctgggtcctgtgacttccaccccctcccactgcagtgaggcgtggcccccgctctgctgagctgggaggggagggctcctgggggacaccaggccaggccatcttgacacgtgacacccagggcatcccccggtcccgcacagctgggcccccctctccctagtgcccctcactgcctgtccccactgggcccctccagagcaccatcccagcccctttcttgggtgtacaagccagggctggagtgagtttctgcagcccagcaggtgaggagcgaggcctgggggcatctcctctgcatcctcacgggccacctgggggcttgggaaggtggggactccggccccacagcaggcccgtgaggagcagtcccggaagaaggcagtgcccaagggagggtgtggggaggctggccttggcctgggtcccaggtgggagctgcaggcagaatctcccctaacccacactagtgcagaggggtggcgcctgcaggccttggaagctgggagggggagctgcgctactccctaggcagcagctgtggcttggttgggcatagcggctcatacctgtaagcccagcacttttggagggagaggctagaggactgcttgaatccaggatttccagaccagccagggcaacagtgagacccgtctctacaaaaaaataaatagctatgcgtggtagtgcatgtgtgtggtcccagctagttgggaggctgaggcgggaggatcaatttagcccaggacatcaaggctgcagtgagctatgattgcaccactgcactccagcctgggtgacagaaaacaacaacatggccgggcgtggtggctcacgcctgtaatcccagcactttgggaggccgaggtgggcaaatcacctgaggtcaggagttcgagaccagcctggccagtatgatgaaaccccgtctctattaaaaatacaaaacattagctgggcatggtggcacgcgcctgtaatcccagctactcaggaggctgaggcaggagaatcgcctgaacccagaaagcagaggttgcagtgagccaagatcgcgccattgcactccagccccggggacaagagtgaaactccgtctcaaacaaaaaaaaagaagacagatgaattggtcatgtggggagaggagggaggggcgcggggctctgtgaatggggtgggcaggaagggaaaggaaggtcccaccttgaggtgctgctggaatagaggagatgctgtgtggtgaccacctcacactgccaggcccatcccagcccacccctgcaagtgaaaggtcattcaacgtgttctccctttcaaggaccatgaactcattaacactaagggataaacaacagacgccagcacgtgtgttggaaaagggcactgtgagtacccgaaagtggactgcccagggtggaagttcaggcaccagacagaagggcgtggcatgcagcgacttcttagggacgcaggaaccaacacatgctccctccaaccccccacacccactgtcctggctggcttgacttctgactctccatggatgtgcgagctctaagcagagaccttccacacacacaaccggcagacaagggtttctctcctctgcctccctcaccttgctcgtggctccactgggatgaggacaaaatgactccatcaagatcgtggctttgcaattccccaggagatgagagatgaccccgggaagcagagcagaatttcaccagcaggctcctcggtgcctagtgctgtgccactgacaagtccttggtcatcctggaaggggcccccaatttctgccctccctaaaaggactcggtagcccctcacctccaaaacagccgtgttcttttaaggctctgttgaaatacatccgttgtccaaatatgagcagtgctcaaaaacccagagaactttccaaacgcaggaattagaagtagccttgtgtcaaaagaactccattccggccaacctaggaggtctcccgtattcggggaagaagaccggagtcaaaggactcatctgtcctgtgccagggactgctgtgaaagcccctcagagacctccagggccacagcagccccacccagccccgcagtcagcctcggagacagcctggttccctgtggctgaccgcagggtgttctcagagaaccctggctggaccgctgcaaagaccctggggacactcagcagcccctggtgagtccctctcgaccgagagcatcttgcagaacaagccgtctgttttcacggccgtttccagggggagccctgcccaccgccgttcatcctaccccactggacagggcatttacttctgaagctccccgtggtgaaaagacagaccccctccagggattccagccgattcccacgcaggagttggactcgtgcatggctgtggtggcgtagagcaggctggcaggggcaggccacgccgtgtccccagtgccatggtcagtttcagccagttatggccttaagggaatttgcaccaaatcttccagtttccaagataagtcggaagtgaggcttttcccataaactctcctgattttttttcttgagacggagtttcgctcgttgcccaggctggagtgtagtggtgccatctcggttcaccgcaacctctgcctcctgggttcaagcgattctcctgcctcagcctcctgagtagctgggattacaggcatgcaccaccacacccagctaagtttttgtatttagcagagatggagtttcaccatgttggtagggctgctcttgatcccctgacctcaggtgatccacccacctcggcctcccaaagggctgggattacaggtgtgagccaccgtgtctggcctccggttggttttgctttcgattttccaggcttagagaagtcatgggaggctccaggttctttgtgtcacattcaaggtctggggcatgtggtgatttcgtaggcccacctctggctcccctagagttagtcctagcccacgtgcacagcccccttctttttgtaagatgcccctgcgaccaagggctccaagcacacctggtagggcctctgcatctgccggaaaacacctgcactgccagccccagccccagccctgccctccccaaggctcccagactgctcccactgggagtggttcccacctggcctggggcacttattaaaaatcagatctggggctgggtgaggtggttcacgcctgtaatcccagcacttttggaggccaagccaagaggatcacttgaggccaggagttcaagggcagcctgggcaacatagcaagacctcatctctacaagaaaatttaaaaaaaattagccaggtgtggtggcgtgcacctgtagtcccagctacttgggagcctgaggtgggaggatcacctgagcccaggatttcaaggctgtagtgagctatgattgcatcactgcactctagtctggggaacagagcaagaccctatctctaaaacacaaatcagattctttgaccctcctccagaacaactgcctcaagggagaggccgggaacgtgggtgttcagcaagcacccaggggacgcttgtgctctggaagtccggggatcgagtctgcaggctcccactcacgatgtggggggcatgactagatggcacgtaaaaatatatgtgaaaggagctattttcatttttttctgtttttttttttttttcttttgaggtggagtcttgctttgtctccaggctggagtgcagtggagcgatctctgctcactgcaacgtccacctcctgggttcaagcgattctcctgcctcagcctcccgagtagctgggactacaggcgcccgccaccacgcctagctaattttttgtattttagtagagacggctgtttcaccatgttggccaggatggtctcgatctcttgacctcatgatccccccgctgcaccctcccaaagtgctaggattacaggcgtgagccacctgcccagcctgttttattttcaataacagccttgaggtataattgacacaccagaacgtccacatttctaaagcatgccattgagtggcttttggtacagtcacagatcaatcaccatcatctacccagggagcttccacgattgtacgtcagggcctcggcctcggcctcggcccagagagtctgatggcatgaggccaacgaacctgtggtttgccagttttattttacctgctgtgcagccaggtatgagagccacagaactagcacagaggcactccactgggaccatggtggcctgtaggagacatgagcactggctgcaaacacttccgattgtcctaataagggggctgcccttggattcagtggggagggctcagggatactgctcagcaccactgcaggacaataacacagccctcaatgtcaacagtgaccacgctgaaaaagccagccctgcaggaacctcaagtctctcccgtccttaatgtgaccacttgagacccccaggcccagcccacagtggcccccagaaacagaaatgagggtggtgggacagtttccccggtattagtgacgatgtagggatgaagtgtagggacaattcctaaactttgatgtctatctggaaccaggggctcctgttcaatcagtttctgattcggggagtctgggctgcagcctcactctaacaagctcctggctgatgctggggtccgaaccatgccttgaatagtgagggtgtggttcactacaggccaccccagggctcatggtgtttaataaatggaactccccgcggggcgcggtggctcactcctgtaatctcagcactttgggaggccaaggcaggtggatcacttgaggtcagcagttcaagaccagcctggccaacatggtgaaaccccgtgtctactaaaaatacaaaaactagccaggcgtggtggagggtgcctgcagtcccacctaccagggaggctgagccaagagaatcacttgaacctggggggcagaggttgcagtgagctgagatggcaccacttcactccagcctgggtgactgagtaagactccgtctcaaaaaacaaaaacaaaaacacagcactcacgagcctcacactgtgcagagtcctggacagcgctgcctcatgcatggcgggcacgtgcagctacctcagcatgtgaggtgggagagtccaggggcactcaccccactttgcagattaccccaaaacacttctctctgcaaagcatttttcccaccactggaaggcggctatggcagtttcctgagaattttttttccatatcaaagaatcgaggagctgcaaagtaaagactcaggaggccagatatgtccccccgtctcctcctgccacgttctctccctcccctgctacccaggcaccccaggcggatgcagggggctagctggctggccaggatcacccgtcctgtgggctccgaaaggctattacaaaggcagattcctgggagggcccattcctgggaagcaagtgcggcttgagcggaggtcacagcagccagtcgccagtgccaagcagccagtgagcagctgtcccaggtgggctctgtcaacacagcctctgcaggttccaaccaggagatgaagccaggcactggtgtggcaagagcaccgaggcacgcttcctgagaggcacagtcacatccctgggagccaggaagggtcagtggggagtgtcggacgccaggggagcacgggactttcagaaagagaagatgctcttccacccagccggcagggcctccgccaggggctggtgctatcttagacagagtgggtgttgcccttgaggagctgtgagctgagtcccgtgggggtgttgcagaggccccagtctcccttctgccccaagtccaagcccactcttggggagctgtgaggctgagggtgcattctcccaaagctgctccagctcatcccaggcagcctcgggttgccagtctcctaagtgacccaacatctgtgccccctttgctggcagcactccgccccatccttgtcccctgcctcgtcctctgccccttgcaagcttccctggctctgtctgccctctgcccagaggccctgccctacccagtgtgtgctggaggccgggctcagagggtccagcctgtgcccagccactggagccgagaccgagaaaagtcctgagatgaaacccaggacaacagaaggcaggtgtgagccctgcgaactcctaactgggcgccgggatctgtccagccaagcaggggcaggggtgggccgacaggatggggacccaggccaggaactaacttcacaggaaaagccctgggtgggcaggaagattccagagcacgctgtggctgacaagggctacaggcagcagtgtggagccggggaggctcggggtggccctgtcttctgggcggcggcccccagaaccagctggcagcaagcctcgtatacaaggtaagaccacagagcctggcagtggtttggaattcgttcttctcttttgttaaaagggggaaaggaagtggatgcgggtacccccaggtgcaggggaggcatgcaggcagccccagcaggcaggcgctgggaggcggtgggaagagtcctggagtttcccacaatccttttctctgcaaggaacagcaacgctggctgacgagggggtggggaggaggcagggccctggggagggggcggcgggcagggggctgggggctcacactaacatgcaaagtccagctgccccaggaactaggttgcttctgaagagcgacacacgtagaaatacacagacacggccacgcgcacacatgcggagaggctctgcattccctagggtgggggtcgaggcctgccggcccccaaggagctccaagccagggatcagcaatgtctctgccagggtggtcctccacggcacccctgggctgggctgggcaggtgcgtcttcgaaggaaggctgcgtggtctctgaagttctgtccgccaggcacccaggccgcgctgaaccactccatgtgccggggccgctggggccatgaccttgcgtgtgggcagctgcgtgttctggcaccagacgtgtccctgcctggctagagtccgcgctctcccctccagggctccggggaacaaggggtgcagacagaaaaggggtgaagggggcccgcagagacgtcctctcccccgccccacggggtcctggcctccgggaggggggaggggcctcccttatctctctgcctccatggcagggtgggccctgggttctgaggtggcctgttggggggccaggggtggccagtctgaagccggagaagggggtgttggagtccacaggggcggctgtggctggtggtgctgtgggccccccgggggcgaggccgccgtgggccagctggaggccgcagagctgctggtggcggcatgggggaagtgtggcgggggtgacgtggctgtcgcggccatcgggctgccgctgccaccgctgtggaagctctcggaggccttgagacgggagaacatggtgagagcgtcagggaagttggggggtgtagcaggggtattggcgggggtgcacatctgtgaggggaagagaggagagatggggtgagcaccccttcctggaggggcccccactgcctcccaaggggagatgcgtggctggcccattctcggaaggctctgtgttccttccccagatccccaagcctgtccgccgcccaggggttcccagaggagaagccttgagatgaaccgacccagcctcactctcaggagcccacggtgcctggggccacgaggctttcccagcccacccctttccatcagccacagcatccccgggggctgtagggtaaggagcttcattgccccagaggccagcgccccccaggtctcagggggagctggcacaggcaagattaagtgcaggacccacggagccgggactcctgctgacccatctccaaagaggtcgagccccgcctgcaccagcgccctcgtacaccggggccaggggctgcttatacacagaactagctcggcctccttccgcccaatccagaactggggactccggggacacttaccatctggtggtgatggtggctgtaggggatgttggtctcctggaaaaaggcgctgagggctgtctgcaggaagaaaggcccctgctcaccctccaggcccccgccggccctgccgctgcccttgttcccaggctcctctgaggctggggatgaccctggctggactgctgagtgggaggggtgagtcgcggtgctgaggctcagtggcttgcctgtcacccccaaccctcactgctgtctaaggaggagccacggaaccttgggcagttggggtgggtggagaagacccttcccctgctgctcgccacctgcctcagtgcctaaggcctgcagagccctccccctgcaccagctggcaccagcaccatgactgggggagggcgggcagtacaccccatcctgggggaaaggcgcccggccccaggtagcccaaccagacctccccaccctgccccgtttcaggagattctagcctggctgttaccacctcaacgggtagcaagtctctactcttctctaagcctcggtctcctcatctgcgaagcaaaagcatcctgaaggagtctgagcctggtggtggggatcccctgctgccccacccagctctgcttctggctgatcaagggggccactgtttgggccttggtttctccatctgtaccacaaagaggttcgactaggtggctcctgggtcccctcccttgcaacagtgacctcctaagatcaccagattccagcaagcagggcctggcaccaaggagacaagcctgggctttaggctcactcgcttccccacctgagcctccctcggaacagtgcccgggaagtggagcagaaagacggccctaggatcaaagccaccacgggtttacgacagctcccagcacagctccccagccacccgcccttggctggcaccacgctaggcacgggatgctccaccgtctccctccacacccgggccgcatgccacactgagcacggtgcgggcacccagcagggctccatcccagcggggccgtggactgtcatcattaaccccacaggcagggactgctgtcttacaggcagggaaatgaaggtaggaagtgacttgctcagggtcagctggtcggcagaagacagagatgggggcgctcagaaaggccaggacaggtgggggagacagagcgagcctggagccctttcctgtgtgtgtcagctcagcaggctccagaggtccttggtgactgggaactgaggagccccagagggaggcgctgggatttgctatgtcctggctgaggccctgcaggggtggggaggcctgtcccaggaaacggaggctgctcttgcgcaagggccagtgagggagccccacaagtatttgaggggttctcggggccctgccaagtcccaggcccagacttggagcttcaagccgccgaggtgcccctaccgccacccctcaggcccactcccctaatgccagcttgacttcctggccctcccaggcccagcacacccagaaatccagcctggctcctggggcctgccctcgatcagggggtatgggtgggaggctatttagattttttttttttttttttttgagacggagtctcgctctgtcaccaggctggagtgcagtggcgttatctgggctcactgcaacctttgccttctagttcaagtgattctcctgcctcagcctcccgagtagctgggactacaggcacgtgccaccacacctggctaacttttgtatttttagtagagatggggtttcaccatgttggccaggatggtcttgatctcttgacctcatgatccgcccaccttggcctcccaaagtgctgggattacaggcatgaaccaccgtgcccggcaaaaaatattttttaaataaatgaattatgtggggaatttcctgcaggagacaccctatctgggtgtccctaaacaggggtgtgggagctcaggcatgggggccgggctttaagcaccttcccagaccccaagaccctctgtcagcagcagctgtgccccaaagcccaggctcactgtgtaaatcccaaccccaggagccccaggccacaccagaccccctctgcaggccgctgtgagcattctccattgagaaacatctgccccactagacaccggcccctccccctgcagcctcctgcccccattagcacctgaattgcagcaaatgtgacccagaaacaccgcctggtggatgcagccagcgggtggagcgtggagagggatggggtggccatgtgaacccctcactcagccccattccaaggcctgaagtcccgtcaccttcctccagcctccctggcggcccccactttacagatggcacaactgagacttgggagtggagggcacagggctcctcccatggggaccctgggagccaccagaggccccagatgctcctgcccctctgggaacagtctttccccagacattgcactcctcaaagctgcattttcaattaactgtgccgctgagggatgtggcctgggtgccagctgggtgccaggttttgagggctgggctgagtcctgcaggcagggcccgcttcccaccggacacctacctgcccagccccaggcagcgagggaaccctgcgtgcagatgtgtaactgccatgaatgcggttttgcaagttttgccacatccagcccctgacacaaacagggctgatgagggctgtggagaccaggagggaagcagggagcttcctccgggtggggctgccttggggcacagggggcagtaagctggccaacagaagctgactcatgccccccaaccccaccatacagatgtggaaactaaggccagagggacagagcagcctcccacgtcctggggtgaacaccacacaggatcagtggcctccgcgacggctggtaggagggaagtaggcaaggagagagggatgtactcatctggatgggatggccactgccttcccagactgtcccaagcttgggacattctgatccccctgcagtccccaggaagcggagcctcagagtcctctggcttctagtccctcctgcaggccctgggatggctcctcatggagaaaccaggttcccagtccccggctgggcacagatggtaccgggatggctgaggccatgaccctacccctgtgaggggcacagctcaaagggctctggcctcatcccctgataccaaccaccatggggttaatcctggggtcggtgaattagggaaagccaggtagcctctgggcagcacaagccaggagcactactgtcctatgggttaggagaggcccgggggagtgggtgccagaccggggcagcatcacctcctacccagctagcccgaaagctggtgaaccgtgtgcaccctccccattgcaccggtaaagggacagatgcccctgccagccccaggagagcacctagtcgcgcacacggagtccccaggcacacctctgaaggggatacacgctcatccctgtggtgtagtgtggggctccgacacgccacccctacactccaggccgtgtacacacatcacaccgtgccgggcacgggcggcatctgcacacccgccacatgtgtacgcgttgatcacacaccaaacgcaccagggggctgcgcgttcacacgcgcgccaacgtgcccgcaggtccgccacctccccggtgcccggccgacgccgtggcgcggtgcgtgcgtaaacacaaatgcacatggacgtgtgcgcacgccgccgaccgcccaccaggcacgcggaccctcggaccactcgcccggagcggctccgccctccggcccagctctgccgaggcctggggcgtcctccttccggccgcccgcccgactgtccgtctgcaccgcggggccgcccggccctcggccgttacccggacaaaaggggtggggggggtccccgtctcgatcccgggggactcgcggccccgcgggggcggcgtatccccgaccggtggcccggttcccacctccgcccgccgcgagcccttgggatccggacgccgggcaccgccgtcgggaaagcgggtcgggtctgcggcccggagggggcgcacagccggcacgcgtccacgccgtccgcccccgcccggcggccacgcgggacacactccgcccgtggccccggccctcgcccggctccggcgccgcgcacctcgaactgccagtgggccgcctgcagcagttgcttcgcctggtcggccgcgcagcccgccgtcagcacgaactggttgatcatgacctggtgcttgagctcgtccatgttcacggacatggcgccgccgcgctgcccgctccggcctccctcctccgcccgcgcctccgcctcacgcgtccaccattagcgagccggctccggctaatacaaatatttactgtgcggctctgactcaccgcgcctcgcctcgctccgccggcgccgcggcatgctgggatatgtagtccccacggtgcgccgggcgccccgggggagcggggccggcaccctaggggacgcgaagcccgggaaggggcgtgtctgagcaccgagcgcccgctgtgcggatgtccgggccgtaacccgagccgggcgcgtccacgtcgtcctcgttgctctcggtggcacccgtgcccctgctctggcacggatgggggtccgctggcgggggccacgtctgtgcatgggcgcaaatgcctgaccacaggatcttggccaaggcctggggaccgtgtctgaactgtgagcgcctactgtgtgtggatgcccgggccgtgaccagggttgggggagtccacgtcgccctcgttgctctgggtggcacccggcccctgctctggcacggatggaggtccgcaggcgggggcctcaggttcgtgcataggcgtttttgccaaggcccaggaacggtgtctgaaaactgagtgcctaatgtgtgcaggcgcctgagctgggaccagagccagtcacgtccacgtcgccctcgttgctctcggtggcacccacgcccctgctctggcgggaattaggagcccagaggccggggccacagatctgtgcatgggcgcaaacgccaggccacagacgtctttgccatgccccggggactgtgactgaacgctaagtgcctactgtgcgcagctgtccagaccgtgaccagagccaggcacgtccatgtcgccctcattgctctcggtggcacccgtgcccctgctctggcacgaattggggtcccaaggtggggcatacagatctgtgcatgggcgcaaacgccgggccacaggcgtctttgctaagacctagggaccctgaacccctctgtgattggcatcgctctgtgttaaatagtaggcacgcccttaagagaggggtctctaggaattttggcccaaatcggctggtctaggctgaaaggcccggcacactgtaggcgccgacaaatactcgttcagtgaatgaatgaatgagccacttaaaagctccgccgcacgtcaccgcctatagctagcctcctagctctcctcactcaatctctcatcgcccactcgtggcatgggtccttcctagcctggctctgggcctgccccactgtagccccatgaccctctggacggcgcctgggacaggctggcggggccagcagcctctggtgcttcggggtccccctcccagcagttctcccgctttcccacgcaaaatctcgtgctctttgccggaaatctcggcccttagcgggcgggcgccaaggcccggcagagccagttccggagcggccccaaactccctttcccagaatgcctcggtttatttgcatcgtttggtcccggtgacgtcagctgagtgaggtcgtgcctcgaccaatggacagcctcggggtgttaggacctggccatataaggtaaacaaagctggtcgcccaatgaagaggcggcgggggcgggcgctgggccggggaggccgggggcggagccgggggcggggcgaccgggcggtgtttacagaccggcacatggcgcttccggttgacgttgctgacagctagtgaggctttagcccgcttcgagcgcccgggggcggtaaggcgcgatcatagcagctctaggtgaccttggtccggctccttgcgccccctggccccagcctccttcgttgagacactatttgttgagtctttcctcttttcctggccctgacctagcgtggggcgacagaagagcaatagccgggtgggggctgtgagaacggctggggttgggagcgaatttcggaaacccggaggacgagtatagccttgcaagatggaaaatgccctcccgggctggcgcggtggcctgtaatcccacctactcggggtccgaggagggaggattgcctaggcccaggactttgagaacacgcctctacagagatttacattttaagaaaattagctgagttcgggtcgggcgcagtggctcacgcctgtaatcccagcactttgggaggccgaggctggcggatcacctgaggtcaggaattcgagaccagcctgaccaaaacggcgaaacccgttctctactaaaaatacaaacactagccgggcgtggtggcagtcgcctgtaatcccagctactccagaagctgaggcaggagaatcgcttgaacccaggaggcggaggttgcagtgagccgcgatcgcgccactgccctgcagcctgggccacagagcaagactctgtctcaaaaaaaaaaaccaaaaaacaaagcaacaacaaaaaaacagagaattagctgggttccatggctcacacctgtaagtaatctcaacactttaggaggccgagatgggcgcggatcactagagtccaggagtttgcgaccagtctgggcaacatagtgagaccctcgtctctacaaaaaataaaaaataaaaaaaattggccgggcgccgtggctcacgcttgtaatcctagcgctttgggaggccgaggcgggcagatcccttgaggttaggagttccagaccagcctggtcaaaccgtctctactaaaaatacaaaaattagccggacatggtggcacacgcctgtagtgccagctactggggaagctgaggcaggagaattgcttgaactcaggaggcggaggctgcagtgagctgagatcgcgccattgcattccagcctagacgacagagcaagactgtctcaagaaaaaaaaaaaaattctggagtcccagctacagattgaggtaggaggattgcttgagcctgggaagtcagaggctgcagtgagccgtgattgtgcctggggaacagcgcaagatcctgtctccaaaaaataaaaaatgccctagggaggccggcactggccctgggggtgagttaggggatactgaaatgtgtaaacagatctgatcccttggacacgttgggatcactgtggctgtggctgtgctgggatcagatggtggtggagagctccggtctgaactaggcgacgttcttgatgtgtctggttccaggggagtctgccctgccttcggaattggatggaatggagggaattgcctcaagctgcggctcctacccgggcccctcaagcctgaccaaggactctcccattgggtggtgggaggaggacagtaggggaactagtggactggacctgaaatgtcctggggtgggagggtagggtggtggggaaggcttggggcactgagatagcggagagggctggggagggaagggagtcagggtgcagtggagttggtctctgagggctggggctgggagcctggcctataggcaaggggcggacactgagtcttggcttttcccaggcaggcacttagcctcggcagaagccatctgaccacgggaaatacagtttaaaattctttcctgctgtttgcggatcacttaggggccacagtattttgtaaaccctgatggttccaagagatgtttgctcttgctaagagttgctccttaacctttgcaaagctcatatgcatgaattaatatgggcaaagtgctccacagggtaggcccacagtaaaaaccagctctgaatatgattcccgctataataattaccactaggacgacaacacagtgtggtagaaggtgggcaggttcgggagctagacagacctgggtgtcaggcttgactccgctgcttaatgacttaatgcttaatgttgagcgagttaccagagctctgggcttcactttctcactggcggggctgagttctggcctcactgctgtggaagattaatgcctgtaaaatgcagagtgcagggcctggtgctatttgcacggttctagtgctctcacctgtttgcctccatctggaccactctgggaagccctagccctattttacagataaaactgaggctggaatccagccttaccctctgacattcagaacctgtggagaagagcgggcacccatggtgcatttctggcaagggaggagggacactgtcccggcagggcccactaagggcttgccttgcatagggaggcaggaagtgccttcacccctccttccaccatcgtccaggtaccactcagctgcctgcccaggcttgcccagctcaggaggatctctctcaggccagcaggctggcaagagttgggcaggtggggctggcagagtcaaaggtcaccctactggtctccatgcaaccccctcacccccatcccctaagccagcttgtttttccacgggcaacagggaattaaaaaacaaccttgtttttagccaggattagcctggttggagaatgaactttggattccttagcaggctgggatggaacctgacagctggggccagcacctagtgggagggagaggagaaggcatttccagcagtgcccttatgtcacctgagggcccaagaggttcaaggctttgccagacttcacatggccagtccatggggggcccagggccctggccgcctcctcctcaccccattctttgatttattccacagatgtgcttatcagacacccaccgggtgcctggctctgggagcaccagaatacgccaggatcctgcccactcagggggttgagaagtctagacttgagactcaggcactcagaccaggaagccaccagtcgtctccagcgtctgtctttatgtttctttttttttttttttcattttattttatttttgagacagggtctcactctgtcacccaggctgcagtgcagtggcacaatcatggctcgctacagtctcgacctcccagcctcaaaggatccttccacctcagcctcccaagtagctgggactacacatgtgcaccaccacgcctggttaatgtttatattttctgtagagacagggctttgccatggtgcccaggctggcctcgaactcctaggctcaagcgatccacctgccttggcctcccaaaatgctgagattacaggcgtgagacaccgcacctggccctgtctttacgtttcagagagcccaatgctggctgaatgtgaggcaagatctggcccttgccttgccatctccctcacttgattctagtcctgtgccgtactcagttctttcccactatagaggttttgtatatgccattacccctacctagaacctggagcagcctaatccctcacactttgcctggctggctattaattgtatttcaagtcctggtttagcaaccggccgcggtggctcacgcctataatcccagcactttgggaggccgaggtgggtagattacctgaggtcaggagttcaagaccagcctggccaacatggtgaaaccccatctctactaaaaatacaaaaattcgctgggtgtgctggcacgcgcctgtagtcccagctactcgggaggctgaggcaggagaattgcttgaacccagggggcggaggttgcagtgagctgagatcgctccactgcactccacctcgggcaacagagtgaggctgcgtctcaaacaacagcaacaacaacagcaacaaaaaataaatcaagtcctggcttagctgtcacctcctcaaaaaaaccccttccctgactcccctgccaatagtgtcaattaattgcatctcaacgttttctgcagagcacccaccacattctggaattatatacttgttaacctttctagcgtctatttcctcacctgcctgcagcctccatgtctagcttgtcctaccatttgatgcctgttgcctggttcatcacctgtcacatagtagctgcaggataaatatttgttgaataaatcaatgaattggccaggcatgacggcacacgcctgtaatcccagcactttgggaggccaaggtggggggattgcctgaggtcaggagttaaagaccagcctggccaacgtggtgaaaccctgtctctactgaaaatacaaaaattagttgtgggtgcctgtaatcccagctactcgggaggctgaggaaggagaaccgcttgaacctgggaggcggaagttaaagcgagccgagatcccacatgatcatgccactgcactccaggctgggtgacagagtgagactgtgtctccaaacgtaaataaataaatgaatccaggccgggcacggtggctcacgcctgtaatcccagcactttgggaggccgaggcggacagatcacctgaggtcaggagttcgagaccagcctgaccaacatggagaaaccccgtctctactaaaaatacaaaattagccgggcgtggtagcacatgcctgtaatcccagctactacggaggctgaggcaggagaatcgcttgaacccgggaggcggaggttgcagtgagccgagattgcaccattgtcctccagcctgggcgacagagcgaaactccatctcaaaaaaaataaaataaataaataaataaataaaaataaatgaatccactcagatgttgataatggaacttggaccaaatcgggaagggcctgtcttccatctgggtgtgggtaagcacagaaaaatactgctgaaagggctttgaggacaccttgagtccaaagctctgttgagaagaagagttaatgaaacatccacctggtggaaatgactgctctggcacaggctccatagggaggatatgctcttagtgttgtttttcagtgggaacagctgatgctcaggactctcccttcctccccgcaaatgaggagggcagtcagttgaatgcagcgttgatacacaaatacatgtacatgtacgtgagttacgtgattcaatggaaagaaatataaaatgaagagagatcacaatgggtggggggcttcaggcccatccatctgggggcaagagcctggcaatctggcactctggagcatgcctctgtggaggcagggacgtgcccaggtaagagcagtggcctggctcaattccagctgtgccacccacctactgtgcaacctcattagggtacttcatttttctgagcctcactttactgttttgtaaattggtaatagaaatagaatctacatcagattgtttttctgtgacagagtcttgctctgtcgcctaggctggagtgcagtggcgcgatctccgctcactgcaacctccgcctcccaggttcgagcaattctcccatctcagcctcccgagtagctgggattacaggcacgtgccaccacacccagctaatttttgtttttagtagagacgggtttttgccatgttggccaggctagtctccaactcctgaccttgaatgatccgcccacctcggcctcccaaagtgctgggattccaggtgtgaaccattgcacccggccagataattgttttttaattattattatttttggaaacagagtctcgctctgtcacccacactggagtgcagtggggcaatcttggctcactgtaacctccacctcccaggttcaagcgattctcctgcctcagcttcccgagtagctgggattacaggcacatgccaccacacccagctaatttttatgtttttagtagagatgggggttttgccatgttggccaggctggtcttgaactgaccttgggtgatccgcccacctcggcctcacaaagtcctgggattccaggcgtgaaccattgtgcctggccagataattgttttttaattattattatttttggaaacagagtctcgctctctcactcccactggagtgcagtggcgcaatctgggctcactgtaacctccacctcccaggttcaagcgattctcctgcctcagcctccccagtagctgggattacaggcgcgcaccaccacgctcaactaattttttgtatttttggtagagacagggtttcaccatattggcaaggctagtcttaaacccttgacctcaagtgatatgcctgcctcggcctcccaaagtgctgggattacaggcgtgagccacagtgcctggcctgtttttttaatattttattttttaaaatttttatcctttttagagatagggtctcactctatcacccaggctggagtgcagtggcatgatcatggctcactgcaacctcgacctcccaggctcaagctatgctcctgcctccacctccagagtagctgtgactacaggggcgtgccatcacacctggctaatttttacatttttggtagagacagggtcatgacatgttgcccagtctgttctggaactcctgggtgcaggctatctgcctgcctcggcctcccaaagtgttaggattacaggtgtgagccactgcgcccggccaacatcaaagaattatatgagaggatatgtgcagagccctcagcatgatgcctggcacataatgctcagtaagtgtggatcttggttgtggggcagggagatttaatcaggctcctccaagacctggacctgcatcataatcacacaagtctcttggctgccgtactcatttggcttcccaagttcccctgacaagaggaagtctgaggccaggtgcagtggctcatctctaatcccaacactttgggaggccaaggcaggcggatcacttgaggacgggagttcaagaccagcctggctaacatggtgaaaccctgtctctactaaaaatgcaaaaattggctgggtgtgatggtgcatgcctgtaatcccagctactggggaggctgaggcacgagaatcgcttgaacacgggaggcaaaggctgtagtgagctgagattgtgccacttctctccagactgcgcgacagaacaatttaaaaaaaaagaggaagactggatcctggactgtggtctctggaagggtataagaagcatttccacatggactgtggtgaattgaccattggagactcagtctgccttgccctccctagctgctttcttggtacagcaggcttgacttgggaaatcactctgctcagaatccaagttcctcaactgaaaagtaggtaaaaagcgatctatttgcagagctgtgtgtgactcaaaagccagggaacaccttgcacactgcgaggttttcattctgaaagcgattcttgcaatcttgcccgcagcgccatttcatgcggctctctctcctctgtgcctcagtttccctgtgtgtaaaatgtgggagagtctactgccttccgtggaggctgtgaaattatgtctttaaactaattggtccagacgtggggccaaagtatcgggattacaggtgagccactgcaccgggcctcagccttgtcagggggccggaggttgcttaaccccctggatcccagcttcctcatctgtaaaacgggctgatgcctatacagctctcagaaccacacctggttcagaagtccccaaatggtagtcctcaaattctggccaaggccaaagcaggtgcttcacttcttccgtgcacaccctgcaagtgggctccgggtggcaggtgcagctacgccctctgccggtcggggcgggagacaaactcaggggagtggggagaaccacagcgactcagggagctatttcagagggggcaagtggaaggcgctggggctccaggagagtctgtaagcgaacagatgaggaaatgaccaaagagttaatatgttagtgcagcgcttggaacgcagagggaaggaccatttgccctgtggttggttggttccttccctctgaatttaggtccatttggtttgtcccggagtgcttgtcaacccgtcagagggcctgggaacggagcatcctgggaaagatagttcccagacgggcttcccgcgctgcttcccggcgccttcggcggcgagaggactccatttcccgacgtgccccgggaccgggaggcggagggccgccgtggcgtcggtccccgggccgagccgggggtgggggctcgaggcgcctccgcggccgtggacgagcgtccgtgcggcctggtccgggccatgtccgcgtgaggaccccgccgctgtcgccgctcccgttccggccctggcccctctgcccggcagcgccgcgcaccatgggctccattctcagccgccgcatcgcgggggtggaggacatcgacatccaggcgaactcggcctatcgctaccctccgaagtccggtgagcgcccggccccaggcgcggactgctaggcacgcgctggaacgcggacccggcgggcgcgggggcggggactcggggcggggcgccctgctcggccccctccgggcctcgttgctaccccgagccttcgcgcggccccacggccccgatccctaggcgtggctgggggccccggaggaacctgcccgagccgtacctggcgctgctactgcccggcttgggtgaccttggggcagtcccttcgccccgggcacctcagctccgtccttgcaacaggggggagctcctgggggaaaccccgagggcggggcggggtgctgagcgcgggtcccggcgcatcgcttctgcctagaaaactctcattgtcatcagattgacctcaccgcgggggccggctttcgctttctttagtggcttggtgtgaaggccgagccagtggtttgggcaatttccctcccatcaggacggaggctcttggtgtgtgggttggaggagtggggctgggcccaaggagacgattatagttgatcgggaggggccagggtccttgctgagaggacccagccgatactcgggcctctgtgttatggctgagggacgtaagacaccaaggaggaagtgactgccaagatctcagctggatggaagcatagttgggaccgggaccagctgtggggctcccacgtagctttgttcccagctctctttctgcctctattgatgagttatgtgttgactgggagcatctagctccaagtctcaccctccatctcctcgtggggttctttgtggtggaaaggagagaaggaagaggagagagaacttgggcatcatggggacatctagattgggtcctcagatcctggcgtctcatctgatctgatgtctcagtctcctgggtgtctccggacacccacaggccagatttctctgagtgtgggccaggtccacaagtgggggaggactgctagacatgccagggcctgcctgggaccccttggggcctgggaacctgcattttcaacccattccccatgtgagttttacgtccactcaggtttgaaaaactgctctgcccaggttttgtaaggtgtgactaggtgagggcctggggccactgggatgaagtgaggggaaccagcacagtttgggggcactctgaaggggatggactcagagctaggcagaacgcactgttgcctgcctgctggggagagcacagctgtatcccaggcccagcagcgggtcagcctggcctttgggtggttccaccctggggtttccctagaggttccgagggctgatggccctacatcagatggagcagtttgctgttgtcctctttcatctctgatattcttccagcctgcctctggctgagtgaccttggtcgaggttgcttaaccccctgggtcccagtttcctcatctgtaaaacgggctgatgcttatacagccctcagaaccacacctggctcagaagtccccaaatggtagctgctacaattgctcataaaggaagataagtgactagctaatgaccataatcatagtaagcagtggcatgacacagatatcaaaaagttgagtggcacttcctgtcacctgggacctgagctcacttgatgtccgttcttcacttgggctgaacagaataacatacatgtcatttacagcccgcttcgggatcccactgtggctgaaatgtcattgctaatcactcgtggccctccctcccactgagcatccatcgcagaacactcgcgtcagccactattggttggcactggcacccaggtgcaacccatcagctagctgcctgggtcatgttgccagtgccagcagtgttctgcgcccatccagtccacaggtcctctccagctgtgctttttccctttctcttctccatccttccctggggccttgcagatacttgttcttctctttgttcatctcttctggtccttgcctttgtgccgcactggtttcctagactccccgcctctcctgtctccttaatgagaactccgtcaggtcaagggtgggaggcaggccgggcctcagcagcattttggtgtgtttccccaagggcagaccggggaccgtggagacatttgagatgattttaggggttgcccccatggaccattcaatcacccgatgagaaagctttcttttcacatctctgtcaattttgttgattatgtcaaggagaaagagtcactgggtggtaatatatgcatttttaacacctaacactgtccatttttcttaagggaactttcagcatgttctgcagcagcgctcagcttgaatttaatatttgctttgttttcactatatctgttttactcttcatagctttattgagatgtagttcatgtaccacacaactcatccattgtaaacatgatttgatgatttttagttaaattatagaattgtgcagtcgtctggccaggcgcggtggctcacgcctataatcccatcactttgggaggccaaggcgggcggatcacaaggtcaggagatggagaccatcctggctaacacggggaaaccccgtctctactaaaaatacaaaaaaatttagccgggcgtgatggcaggcgtctatagtcccagctacgcgggaggctgaggcaggctgaattgcttgaagctgagaggtggaggctgcagtgagccgagattgcgccactgcactccagcctgggtgacagagcgagactccgtctcaaaaaaaaaggctgggcgcggtggttcacgcctgtaatcccagcactttgggaggctgaggcaggtggatcacaaggtcaggagatcaagaccatcctggctaacaccgtgaaaccccatctctaccaaaaatacaaaaaattagctgggtgtggtggcgggcacctgtagtcccagctactcaggaagctgaggcaggagaatggtgtgaacccaggaggcggaggttgcagtgagccgagactgcgccactgcactccagcctaggtgtcagagtgagactccgtctcaaaaaaaaaaaaaaaaaagaattgtgggtgggtgcggtggctcacgcctgtaatcccagcactttgggaggccgaggcaggcggatcacgaggtcaggagatcgagaccatcctggctaacacggtgaaaccccatgtctactaaaaatacaaaaaattagccaggtgtggtggcaggcgcttgtagtcccagccactcgggaggctgaggcaggagaatggcatgaacccgggaggtgaagcttgcagtgagccgagatcacgccattgcactccagctgggcgatagagtgtgactctgtctccaaaaaaaaaaaaaaaaaaggaggggacattgaagcaacaacaacaaaaaaaagaattgtgcagtcatcaccacaattgcagacatttcccttgtaaaagtttccttccatctgtttgcagagtccctaccccaacccccaccctcagcccatcagcgatctgctttcttttttctttgagatggagtgttgctctgtcgcccaggttgcaatgcagtggcatgatctcggctcagtgcaacgtccgcctcctgggttcaagcaattctcctgtttcagcctcctgagtagcttggattacaggtgcgcaccaccacgcccggctaatttttaaatttttggtacagatgaggtttcaccatattggccagtctggtctcgagctcctgacctcaggtgatctgcctgccttggcctcccaaagtgctaggattacaggtgtgagccactatgcccagccttttctgtttttttttgagacagtctcgctctgttgccctggagtgcagtggtgcaatcttggcttactgcaacctctgcctcctggtttcaagtgattctcctgcctcagcctcccaagtagctgggattataggcactggccactatgccaggctaatttttgtatttttagtagacacggggtttcactatgttgggaaggctggtttcgaactcccgacctcaggtgatctgcccacctcagcctccaaagtgctgggattacaggggtgagccactgcacctggcctgctttctgttcgtatgtgtgtgtgtgtgtgtgtgtgtgtgtgtgtgtgtgtgtgtgaaaagtgtctatttgagtcttttgtccaattttcaaaaactggattgtttatcttacggagttgtaacaaagagttctttatgtgttctggataggattctcctgtcagccatgtgatttgcaaatattttctcccagtctggcttgtcttttaattttcttaatggtgtttcttttgaagagcaaaagttttgaattttgacgaagtctcatttactgctttttaagtggatactgcttttggagttatgtttaagaaatcttgggcccaggcatggtggctcacgcctgtaatcccagcactttgggaggccaaggtgggcggatcatgaggtaaagagattgagaccatcctggccaacatggtgaaaccccatctctactaaaaatacaaaaattagctgggcgtggtggcacacacctgtagtcccagctgctcaggaggctgaggcaggagaattgtttgaacccgggaggcgggggttgcagtgagcctagatcgcgccactgcactccagcctggtgaaagagcgagacaccgtctcaaaaaaaaaaaaaaaatcatacaggcggctgggtgtggtggttcatgcctgtcatctcagcattttgggaggctgaggtgggcggatcacctgaggtcaggagttcgagaccagcctggccaacaaggtgaaacctcgtctctactaaaaatacaaaaatgagctggacgcaatggcgcacgcccgtaatcccagctactcaggaggctgagtcaggagaattgcttgaacctgggaggtggagttgggttgcagtgagccaagatcatgccactgcactgcagcctgggcaaacagtgagacaccatctcaaaaaaaaaaaaaaaaaaaaagcgcaggtgcagtggctcgcgcctgtaatcctagcactttgggagactgagatgggtggattgcctgagctcaggagtttgagaccagcctgggcaacatggtgaaactccatgtctcctaaaatacaaaaaattagttgggtgtggcagcatgtgcctgtagtcccagctaattgggaggccgaggcagaagaatcgctggaacccggagcgcggcagaggttgcagtgagccgagattatgccactgcactccagcctgagcgacagagtgagacgccgtctcaaaaaaaaaaaaacaaatagaaagaaaagaaatctttgcctaggtcaaggtcacaaagattttctcctatttttttctagcattttgttgttgttgttgttgttggttttttttgagatggagtctccctctgtcacccaggctggagtgtagtggcatgatcttagctcactgcagcctctgcccgggttccagcgattcttctacctcagcctactgagtagctgagattacaggtgcgagccaccacgcccggctaatttttggattttttagtagagacggggttttcaccatattggccaggctgatctcaaactgaccttgtgatctgcctgccttggcctcccagattgctgggattacaggcgtgagccgctgtgcccggccttttctagaagttttatagttttagctcttacatttaggtctttgatccatttagagttaattcttttttttttttttttttttaattttgagatagggtcttactctgtcattcaggctagagtatagcggcatgatgtcactctagccttgacttcctggctcaggtgattctcccacctcagcctcccaagtagctgggttttcccagctatgtatgtgtaccactatgcccagcaaagtttttgtattttttttgtagagacagggtttcaccgtgttgtccaggctggcctcaaagtcctggactcaagcaatctgcccaccttggccttccagagtgctgggattacaggtgtgagccgctgtagctgaccaaattaatttgtttcacttatggcttgagataaagatctaaaccccccttttttgtggatggaattcaattattttagtatcatttgttgtagagactatcatcttcccatcaaattgcctttgcacctttgtcaaaaattagttgacctaagccaggcattgtggctggataacaaagcaagaccatgtctcttaaaaatcaaaacaacagcgacaagaaccccaccagttaaccatgaatgtgagggtttattttgggactctccattctgttccattgatttatgtgtgtcccagaagttctcaactggggcatttttgccctctcaagggacatttggccatgtctggagacatttgtgattgtcacagctgggggcatctgttgggtagaggccacaggacagtcccccacaattaagaataaatcggcccagaatatccatagtgcttagactgagaaatcctggtctgttcttagaccagcagcacactggcttgtttacagtagtttgatagtaagttgtgaaatcaggtagcataagttctccaactttgttctctttcaaaattgttttggttatgctaagttctttgcatttccatatacattttataattagcctgtcaattatttctacaaaagcagcctgcaattttgataagtattacattggatatataaatctatgtggtgagaattgctgtctttacagtgctgactctgggaatccatgaacatggtatatctctacattaattttgatatttagcttctcagttgtttttttttttcagataactttacctatttaaggcaagtgatatttgccaatctattactgatatattgccttcccaatctagtagtgataaaaaatttccttttttttttttttttttttttttgagatggagtcttgctcttgtcacccaggctggagggcaatggcgcaatcttgactcactccaacctctgcctcgcaggttcaagtgattctctcctgcctcagcctcctgtgttgctgggactacaggtgcatgccaccacgcccagctaatttttgtatttttagtagagatgggtttcaccatgttggcagggatggtcttgatctattgaccttttgacccgcctacctcagcctccggaagagctggtattacaggcatgagccactgcgcccggctattcttaataacagttttgttgagatctaattcacagcatacgagtcacactgagaacatctagtccagtggttttttttgtttgtttgtttgtttttgagacggagtcttgctctgtcgcccaggctggagtgcagtggcgcaatctctgctcactgcaagctctgcctcccgggttcacgccattctcctgtctcagcctcctgagtagctgggactacaggcacccgccactacgtctggctaatttttttgtatttttagtggagatgtggtttcaccgtgttagccaggatggtctcgatctcctgacctcttgatccgcccgtctcggcctcccaaaatgcggggattacaggcatgagccaccgtgccgggaccagtggtttttggtatacttgtgttgtgcagccatcaccactgtctaattccagaacatcttcatcacaccaaaaagaaacccagtggccatgaaacagtcactcacggccaggcgtggtggctcacatttgtaatcccagcactttgggaggccagggcaggcagattacttgagctcagaagtttgagaccaccctgggcaacacggcaaaaccttgtctctacaaaaaataaaaaaattatctgggtgtggtggcgtccacctttagtcctagctacctggtgggctgaggtgggaggattgcttgagctcaggaggtcgaggctgcagtgagctatgattgccccactgtactccagcctgggcagcagagtgagactctgtctctaaagaataaattaataaaatttggccgggtgcagtggctcacacctgtaatcctagtactttgggaggctgaggcgggtggaccatttgaggttaggagtttgagagcagcctggccagcatggtaaaaccccacctctattaaaaatccaaaaaattagctggacgtggtggtgggtgcccataatcccagctactcaggaggctgaggcaggagaactgctttaaaccaggaagcagagcttgcagtgagctgagatcacgccactgcattccagcctgggcaacagtgcccaggctttatttattgaaaaattaataaaaattggctgggtgccgtggctcacacctgtaatctcagcactttgggaggccaaggcgggtggatcacctgaggtcggaggtttgagaccagactgaccaagatggagaagccccatctctactaaaaatacaaaatgagctgggcgtggtggtacgtgcctgtaatcccagctactcgggaggctgaggcaggagaatcacttgaacccaggaggcagaggttgcagtgagccgaggtcgtgccattgcactccagcctgggcaactagagcaaaactctgtctcaaaaaatatatctatcaataaaaaaaattattattattattattgagacggagtctcactctttctcccaggccggactgcagtggtgctatctcggctcactgcaagctctgcctcccgggttcacgccattctcctgcctcagcctcccgagtagctgggactgcaggcgcccgccaccgcgcccggccaattttttgtattattagtagagacggggtttcaccgtgttagccaggatggtctccatctcctgacctcgtgataaaaatttttttaaaaagggcttgggtttcatagtaggatgcatttgaaggtaaaagcaatcctaacaggctgtgaaaattgcagctgccattgggggcaaccctgtaggcgtgtggtgggaggagcactagcttcagagtcctgggctgatggtagcccctcctgtgccagtgacttcctcagtggccttggccagtgttttgctcaatggggccccaggtttccctggctgagccctgggggtcacctctgattccctgggcccctttcaggtctggctgccagtccatgtgagccagcagggagggacaggccctggccctcgcccagcccagcccagcttttgtttttcatgatgcccagaagttttctggaaaatgttctgtatttcctggatgaccctgaagtggtgaccactcctgcctgcccacctcccagacccggtgccgcctgggtccgacattgcctggctttccccgcgcccttccgctgtgtcccgtgaggctctctagctttgcgctttggggtcatcttgtccagtggacgacggcgtggtgtcgtctgcaccatccctgcagtgcctgacttgtgctcgctgaacagctgtagaattacccggagctcagccctttgctgcgccctaggaggggctggaagaggagcggcctgtgtccctctgcttgtttgtggagaagctgacctggagcagtgttggaggggtccctggatcctgagcgagtgttcggtcatttgcctttccatagacctgggcgaagaagcgagaggtttgaggagtgactgaaatcaagacctgaggccgttagaagaaacaccgtttgctcagtcctttcatccagctcgcgggggacttgggtcctctcacgtggtcttgggtatgtggcctcagcggggcctggcatccctgaggtgggcagaaggttgcattggctccccagggctcagcactggcgccactgctcacataactgaagctttcttctaacagggctctcgccccgcggaacagatgctctctgtgatgtctctgagagcccagactcccagggagccttctggggaatcgaaagaaagaaaagattgcttcagtgctttggggaaaaagtgtgtgtgtacatatactgcacatagacattaaaaatcagaggctgggggctggctgcaggggctcacgcctgtaatcccagcactttgggaggctgaggcaggcggatcacttgaggtcaggagtttgaggccagcctggccaacatggcaaaaccctatctctactaaaaatccaaaaaaaaaaatagccaagtgtggtggtgcacacctgtaatcccagctgctcaggtggctgaggtgggagaatctcttgaaaccaggaggtggagttcacagtgagccaagattgcgccactgcactccaccctgggtgacagagtgagaccctgtctctaaataaattaataagtcaaataaaaaataataaattgaggctaacatattcttttttttttctttttttcgagacagagtcttgctctgtcgcccaggctggagtgtagtggcatgatcttagctcactgcaacctctgcctcctgggttcgagcaatcctccttcagcctctggagtagctgggattacaggtgtgggccaccacacccagctaacttttttttctttttttttgagacagagtctcgcactgtcatccaggctggtgtgcagtggcgcaatattggctcactgcaacctccacctcccaggtttaagcgactctcccgccaaagcctcccgagtagctgggattacaggtgcccactaccacgcccagctaatttttttttttttttttttgtatatttagtggagatgtggtttcaccatgttggccaggctggtcttgaactcctgaccttgtgatctgcctgcctcagcctccagaagtgctgggattacagatgtgactaccgtgcccggcctcagctaacttttgtattttctgttttttttttttaagtagagacagggtttcaccatgttggtcaggctggtcttgaactcttgacctcaggtgatccacctgcctcggcctctgcaagtgctgggattacaggcatgagccactgggcctggccaaggctagcatacatttaggaaatgtacagctcattaatgtgcagtttgataaatgatcacaaaatgaacatgttgagaaaaatagagcagtaccggcccccagaggccccctattgtccccttctgaacaacctgcctcccccttcttccctgggaaccacccccctgacttcctccctgggtgacttctgcttgggtttgagcttgaaagaactggaaggaggcgctcttcttgctccacctcaggatgagatgggatgcaatggccgggcggggtttgtgagcagtgagtgatctggcgtctgctgtgggaccttccagcgtcccagtgctgcccgtggacgggctccgggggagctggggacatccttgtgtctggcggtggtgcccttgagcctgatctctttgggtgcgtttttatgcctggagtggacttgttggggctgttgggtgcattcagccttcgtagattttaaacttttaggagtgaacgaatttgcatgtctgcaggcaagaacaagggtgttggtcgctctgcattcatactggcactaggtagggtgaggggtgtgtgctatttttaattttttttcaattccaccttgaatttctcattgtacttttccctgatgaccagtgaggttgagcgcctttctctatgcgaattggccatctgtttcttgtcctgctgttgaagtgccttgtgaagtcttttacacattaaaacaattgagtggccaggctcagtggctcacacctgtaatcccagcactttgggaggccgagacgggcagatcacaaggtcaggagatcgagaccatcctggctaacatggtaaaaccccgtctctactaaaaatacaaacaattagcagggcacggtggcgtgcgcctgtagtcccagctacttgggaggctgaggcaggagaatggcgtgaacctgggaggtggagcttgcagtgagtcaagattgcgccactgcacgccagcccgggcgacagagcaagactccatctcaaaaaaaaaaaaaaaaaaaaaaattgagtggccaggttcagtggctcacacctgtaattctagcactttgggaggctgaggcgggcagatcacctcaggtcaggagttgaagaccagcccggccaacatggtgaaaccccgtctctactaaaaattcaaaaattagctgggcatggtgttgggtgcctgtaatcctagctcctggggaggctgaggcaggagaatcgcttgaacctgggagatggaggttacagtgagccaagatcgcgccattgcactccagcctgagcgacagagtgagactgtctcaaagaaaaaaacaaaaaaaaaattgagttatctttttttcttactggtttataggagctctttcctaagtgctttttattatggttttaattctttggaaattggccgccttagtgccgtttatggaagctagcccaggcaagaaatggagtgtattgaaggctccgagggaagtcccagtaacctcaggggaaacggacaagtggaagctgcgggaacccagagcctctgttcggctccagcctcagcgccatcctgcagtcctgcagagcgccccagctgctccggcgtgtgtgaggccatcgccacccaccaggctggtcaagggccaagtgctgccgtcgtccctggtcccattccacaggagggagaattcggatggcccagtgtgccagtgtccaccttagggccaaccagccctgtctagggggtgggggccaccctgagggtggtggaggctgtttccagaaaaggggaggacacacccccaacaaaaaaggtgactacagcttatgccccctccgtgccccagcgtctttgcttagtcagagttgttctcagctttgtgttccgcactggaagccagagccctgtatttaatatggtatcacgtttacatatgggaggtccgaaagggacttctagccagtgtgttcacacctgccggaggctcctttgtgttaattggcattttttatcctcaggacgtcctgagtttagggtggccctctcatctcaagtttgcagttaaagaaatcaaggttgggtgtggtggctccctgtaatcccagcactttgggaggccgaggcgggtggattacgaggtcaggagtttgagaccagcctgaccaacatggtgaaactccgtctctactaaaaatacagaaaattgctgggcgtggtggcgggtgcctgtaatctcagctatttggaaggctgaggcaggagaatcacctgaacccgggaggcagaggttgcagtgagccgtgatcgtaccactgcactccagcctgggtgacagagcgagagtccgtctcaaaaaaaaaaataaataaatatctcagcccatgttgacttccccagctgggtgggggactggtagtaggcagggaagcatggtaggcccagggggatcaatgcgtgggtgatacagctgggtgggacccccagagcactcgaaggctgtggggctgccaccccctctggcctcccacctggtgggggcatcctgggacctgatcttgtgcaggtctggcccacctggggtttattggcaatgcagcagctgattttgtgagactggtaagcaggaacacctgtcctgttagaacacgaggagaattttcagcaggtggaatcagtgagctgttcggagcccctgcagacacctcgtggccttcccactcccccttcctcgggtgggaacgatggctgaggcagcccagtgaagtccacccctggtgtcccgggtccctgggccgctgtgtttcttaggaggcagacatgctgggtgtcttcattcacatcctggcttacttcccatggctgacagtgcaggctctggagtctgcccaggggtcccagtgagaatgtctctcactggttgtgtgacctgagcaggtcactcagcctcaccgggccagtttccctgactgtcaaacaccagtaacaacagcatctgctttcattcattaggtgagtgttcatccagctcttaggcatggagcggggaggtcatgaggatgcggggccgtggacagttgaggatgatgcctacttttgggctggggaggacagagggaaccaacaggtacacgagataaagcagcagtgacactatgaggagaatggcggcgggagcgttgaccacgagctggcagttggcctgcgtggtggtccaggctggcctcaccgcggcatcccaaggagggaatagcccaggccgggaaggtggggcggggtgggcagggcatgtggaatcactggtctgcagagcggggagcttggccatggccttcaggtcagggtgcagcaaccttcaccattgggcatcattaggctgggggcatctggaaggtcaggaggaagcctgggctacctaggatggaacaggcaggacagttgtctccaaggcctgcctatgacttgggcatcctgtccccagatgcacagcgtctgccccctcggtgcgggaggatgaggaacgcctgcctgtggatccacacatggtccccgtattgggggtgtggaggaaaggcctttctgacatgatctgagcccggcctctttctcttaggggtgtaccagggttggtgggtttggaggcaaatgcatttcaagggtccagatcacgaacctctgacccggtgggccctgaactctggtctgataaacatgggtcagacttctccctgaaaactgtgagcgtggagttcaggcacaggcaggcggggcaggtgctttcaggcttgatagcaagaccctactttactcatctgccctccacgctccgcggctccgacggtgtttgctgcggctcctctgctgcgttgagtccgtctgtgcactcagatggcctgtgcttcgcctttcgcccgcgttcttgggaggccttgccgcgtcccgggcctcccgcccttccaaggttggcttgtttcagtgattcggaatgtccctgttttcctctcgcagatgtctggtggcgttcattgcacactgtgtaccacaagatattgacaaggtgcaagagacacaagacgggcccagaaggcttcttggctcactctgtggcctgtatggaagggacagggctgtccccctcccctggccatccccaagacagcctctgacctgtggccttgtggttttggtttttctcagctgtagagatgacaaacgtatgtatcctcctgcctggaggcatgtgtggagagcattgaggctgttcggggaatgcctcgaggcctcccacggaagggattttgcagttttcatttctgtggctgttgtctccctgtgcaggttgcccggacacctgcaagccacccagagtccgaatccctcgggcagggaggcagtgaactgctgggctccagtccccctgggggtgacagtaaaccaggggagaaggatgcctttgttttagtggtgttcgaggactgccctgaggccctgggtccttgagtgtgttggttccacatagccgggatttccaggacaaccttgggaccctgtggcgtctgtcgggctctgtgagcccacaggaggattttcagccattctgctggggaagccccttgggtgtggttttttgtgtgtgaacagtgcccattgtcactggcgatgacaccactgactcctgtccccgtggtcccccggctgcaggaggggaggtgcccagcacagagactgagaaacaagtgggctctggagtcggggtgtgcgccccagctccaccgctgatgagcttgggggccttagccaagcttcgtttcctgtatgtttgaaagtgtgggccttgtctgcccctctttccttggggccagcgggaaagggggtgaaggcgctgacctcagcaggtgtggagggagagcctggtgggtgtggttccacctgcgttctttcacctccacagctgccttcccacttcccactcacagtctccttttctttttcctccacccccttggcagcgctgcctgctcctcttggtcctgagctggtgcacatacaaatgtacacagctcatgcacgcacacaccacatgtgtgtcattcttcttgaggcaaaggaaagggcggccccgcccctaacacttccccaggcctggtcccttcctcctgccccatcagggacctagggtctccttcccgtgtttcttctccatgtgtggatacccatgtgtgagcaataggattttttttttgttttttggagacagagtcacgctgttgcttgggctggagtgcagtggcccaggggcccaatcatagctcactgcaacctcaaattgctgggctcgcatggtccttctgcctcagcctcttgagtggctggtactacaggcacataccactgtgcctggctactttttttttttttttttttaagacagcgttttgctcttgttgccccaggctggagtgcagtggtgcagtctcggctgaccgcaacctctgcctcccaggttcaagtgattctcctgccttagcctcctgagtagatgggattacaggcacccaccaccatgcccagctaattttgcatttttagtagagacgggagtttctccatgttggtcaggctggtctcgaactcccaacctcaggtgattcgcctgcctcggcctcccaaagtgctgggattacagatgtgagccactgcgcctggccactttttgtattttttgtagagacagggtctcgccatgtcgcccaggctggtctgaaattcgtggcttcaagccatcttgcccaccttggcctcctaaagtgctgggattataggcgtgagccccctcggctggcctggattctctgtgaggtgtttccagttcttcccagttggtctcgtctcctgcaggtgtgagttgttgattgtctgcgccgtgttgatcacgtagaccctgttcttgagtgctgagggtccatccggtaaccctgcactgtcatgcatttccctgtcagcatatgacttggttccttttttttttttttttttaaaaaagaccgtcttgctctttcgcccaggctggagtgcagtggcgcgatttcagctcgctgcaacctctgcctcttgggttcgagagattctcctgtctcagcctcccgagtagtggggattacaggcatgagctaatttttgtatttttatttatttatttatttttgaaacggagtcgtcttctgtcacccaggctggagttcaatggtgtgatctccgctcacggtaaccttcgtctcctgagttcaagcgattctcctgcctcagccttctgagtagctgggattacaggcatgcaccaccacggccagctaatttgtgtgtgtgtgtgtgtgtgtgtgtgtgtgtgtgtttttagtagagatgggggtttcaccttgttgccagactggtcttaaactcctgaccttgtgatccgcccgcctcggcctcccaaagtgctgggattacaggcgtgagccaccgcacccggccctaatttttgtatttttagtagaaacagactttcccatgttggccaggctggtcttcaactcctgacggcagacctcaagtgatttgcctgccctggcctcccaaagtgctgggattacaggggtgagcaccgtgcctggtgggttataatttttaacgcttgaattttttttttttttttgttaaagggtctggctctgttgcctaggctataatgcagtggcttgatcagggttcactgcagccttgacctcccaggctcaagtgatccttccacctcagcctcccgagtaccttggactgcaagtacgcatcaccgtgctagctaattttttttgttttgttttgttttgagacagtcccactctgtcacccaggctagagtgaagtggcacaatctcagctcactgcagcctctgcctcccaagttcaagcgattctcgtgcctcagcctcctaagtagctgggactataggcacacaccaccatgcctggctaatttttgtatttttagtagagatgggatttcgccatgttggccaggctggtctcaatctcgatctcctgaccttgtgatccactcctctcggcctcccagagcactgggattataggcacgagccactgagcctggactaatttttgtatttttggcagagatggggttttgccatgttgtccaggcaggtctcgaactgctgggctcaagtgaacctcccaccttggcctcccaaagtggtaggattacaggcgtgagctactgtacccggccttgcttgatttttttttttttttttttttctgagacagagtctccctcactgcaacctccgcttcctgggttcaaggaattctcctgcctcagcccctcccaagtacctgggactacaggcgcgtgccaccacacctggctaattttttgtattttttagtagagacggggtttcaccgtgttagccaggatggtctccatctcctgacctcgtgatccacctgccttggcctcccaaagtgctgggattacacgcgtgagtcaccgcgcctggcaaaaatcttgtattgatcatattgtgtgtctgcaaccaaaatatgcgcaccaattgaaattagaattttaaataattttacatcataagctgtgagtttttcgtgttttgaatggccattactaatacccaattgatcaaacaaatattccagtttttatcaataacaagaagaaatacgaaaaaacattggaaatatgtctcttgagtagatgggttcctttttctcctggttaattcatgcattcacagttggatacaagctgttgctaaaatgatttcagcctcaatgctagttttttttgtttgtttgttttttttgagatggagtctcgctctgttgcccaggctggagtggagtgaggtggtgcaatctcggctccctgcaacctctgcctcccagatgcaagcaattctgctgtcttggcctcctgagtagttgggattacaggcatgtactaccactcccggctaatttttttttgttttgttttgtatttttagtagagatggggttttaccatgttggccaggctggtctagaactccttacctcaagtgatccacccccctcagcctcccaaagtgctgggtttacaggtgttagccaccgtgcttggacccctcaattaccagtttttttttttttttttttttgatggagtttcactcttgttgtccaggctggagtggacagctggcccaatctcagctcacggcaacctctgcctcccaggttcaagcgattttcctgcctcagcctcccaagtagctgggattacaggcacacaccaccacgcctgggtaattttgtatttttagtagagacagggtttctccattatggtcaggctggtctccaactcctgacctcaggtgatccacccaccttggcctcccaaagtgctggaattacaggtgtgagccactgcacctgggttctgttttttaagttgagaaaccttgataacatcaattagataggaattagcaagatttttatgtaacaatagcatctatttccaagttacttcacaaaaattgacataaaaacctagtacaaaaattaatgattcatcacctcacaacttacgtccttccagttaagtttttttgaggtaaaattcacttaccatggggacacctttttaaagtgtacaagtcagtgatttttggtatattcagtcatgcaaccattaccttgatctaattctagaacatggtcccagttttgtgatattacaaccattgctttaacaaacactcttcttccttgtctctaatcttttaaaaataatttttcttgttttacaaatgatatatgttaattgtagaaaacttaattttaaaaagataaaggaaaaaattaataatcacttattacctatgcaggtgttttagtttgtagcatttgtttctctgaagttatttatatgtatatatgcgtgtgcatatatatatagagtgagagttggcgggggtgggggtggtggtggggggacgggaagagagacagggtcttgctctgttgcccaggctggagtgcagtgtggtgtgatcatggcttactgcagcctcgaactcttggactcaagcgatcttcctgcctcagtgagtgtcctgagtagctaggactacaggcatgcgctgccatgcccagctaatttttaagaattttttgtagagacagcgtctccctatgttgcccaggctggtcttgaactctggggctcgagcgatcctcctgccttgatcttccaaagcgcccaggcatgaaccactggcccagcttaattactttctctgaagttattgaagcttaaaactacatacagtaagatcttagagcctccagcctagaacaccaggctgaaaagtgctgtggagaagaataaggctggaaaggggagtggaaagattggttggcaagctggggtgtgggaggcttggcaagttgtaaaaggggtgtcagaagaggcctcgtggagagagcagcctgaggtagagctggagctccagggaagagctggatgagctgaggactccagggccccgaggtgtgagtgggccggggctggcagagtggccttgtctggggcctcggaggctactgggacctgccccagtgtggctgggacgccagcagagttttgagggcagtgggtccagaaacaacagacctggggacccaggggatgtggggaggctggtgaatgggcacagtcacagggcagatggtgccagaggctctaaccagtgctgtggttgtagaaatgaaatcgaattgggagtcaggagaggagaaatgacagtcacgtagaccacgtctcagaaagactcgacgtctctttctgggtgactccttcagagtgtagtggcttagcacagtgagcacttcctaccttacggtgagggtcgggattgggagcggctccgtcggggggctctggctcaccatcactcgtgagtcctcactcaggctgtgtcacggtggctcacgcctgtaatcccagcactttgggaggcaaaggtgggaggattgcttgtgcccagcagtttgagaccagcctgggtagcatagtgagaccccatgtctacaaaaaataaacaaaaatgagccagacattgtgcacactgtgatcccagctacttgggaggctgaggcaggaggattgtttgagctcaggaggtccaaggctgcagtgatcgtgcccctgcactccaacctcggcgacagagcaagaccctgtctcaaaaaaaaaaaaagctgtgggtgggctgtggtcctctgagggcttgcctgggcatggaggggctgcctccctggctcacaggcccggcatgccggtgctgggtttagcgggaggcctcaggtcctcccctcgggacctctccatggggctgcttgggtgtcctcacagcatggtggcagcttcccccagagccttagaagccacacaccatcattttcatgcagtctctgtggtcatcatttcatgcggtcacctggtcagccctgttcagtgtgggtgcagtctgcccagagacatgtcggccgggaggtgagatgcgctgggggccctcgtggaggctggccacctcgctcatcttctgcctacagcgggggcttcttggacacaaagtggttgtgccttgaaggtgccctgggaggaggttggagcaggaggcttctggaccagggacctgtctcctgcctggggccatggagtgcccagtgcctcggcctggaaggcctggcagggacaagcccgctcctgagtgtccctccagaccaaggctgcccggccttctggaccccacctcagtacgtcagcgctggggagagcctggaagggtgggggctgatcactgctaagggtgcccccgacgatgggtcctgggctggtcagcagggtcactgggcttcccacaccctcttgccgtgctgctgtggcccttgtctgccagcagctagtgcgggggttcccagcagccgagtccttcatgtggttttcatgaacatggtgcacatcttggaggagcaggcaggtggctctgggccgggccctgtctcagccctgctccatgactggggcttgaggttggtctgaggccagcatccggagaccaccgtgccctgaggcacggggtgccttgtggcccctggccccgccccgtaggctgtgtggaaaattcacctttaaagactttgtgtatttcaatgtggtggggctatgttcaaggcccaggtaatcagggaaggcatcctgggctcactgtactgcaggtgttctttctttcttttgatttaaaaccaccacataggctttgctccacccctcgtctgctctgcaccaatttccctggcagccttgtgggcgtgtccttccagaacattctctgtgtattcacaatttgtgttgcgcacatctcagtgcgtgcggtgacccctcagaaaatgatcttgcagtgtgttaacttgttttctttaacctgcaaatactctgtgactcgctccacatcggtatgtctggatcagcttggttccagcagctgtgtggtgggccataaaatcagggcgtcccacttgctgaagcagttgccgctttcttctttgtttttggtcgtcatcagctctcagtggtccctgttctgcatgctgggttaggtggggctgcggctcccaaccactgttcctggcagtcagcagccatgctgggcacctggctctgggccacctccctcaggaggagcaccctggaatcactgttggggcccggctggtcttggtggccgtggctgtgccaactgtaactggggccgtggttctcgggaaggacacagaccatgcagcgcctgaaggtctcagaattcccgctgaaggccccgggaagggcccacctggcctcaggtgggaattctgagaaggaatagggattctggggcccccagtgggaattctgagaattcccagaagtccctgcaatacgtgaggttgaggaccatgtattctgagcatccttgaaatccacaggtccctgcagctacccgggtcctcccctcggagactcttcccgtggtcacccggctcctcctcccggggactcttcccgtggtcacccggctcctcctcccgcgggctcttcccgtggtcacccggctcctcctctcggggactcttcccgtggtcacccggctcctcctcccggggactcttcccgtggtcacccgggtcctcctcccgggggctcttcccgtggtcacccggctcctcctctcggggactcttcccgtggtcacctggctcctcctcccgggggctcttcccgtggtcacccgggggctcctcccggggctcttcccgtggtcacccgggtcctcctcccgggggctcttcccgtggtcacccgggtcctcctcccggggctcttcccgtggtcacccgggtcctcctcccgggactcttcccgtggtcacccggctcctcctcccggggactcttcccgtggtcacccgggtcctcctcccgggggctcttcccgtggtcacccggctcctcctctcggggactcttcccgtggtcacccggctcctcctcccggggctcttcccgtggtcacccgggtcctcctcccggggctcttcccgtggtcacccgggtcctcctcccggggctcttcccgtggtcacccggctcctcctctcggggactcttcccgtggtcacccggctcctcctctcggggactcttcccgtggtcacccgggtcctcctctccggggctgtgtgccaggagaaatggggctggatctgggcgtcaggtcaggaatccaggggagaggccatgctctcagtgttccttggcagggctgtgagcgcaggtctctgaggatgcccagctgtccatcccctcctcataggagaagcgcagatctcatgcctaagtgtgccagggtcctgatgggcgccacctacagcctcccgccctcacgcgggagtcagactgaacgaactagcccagatccacagagacttctaaacccggctgggtgctgccatggaaagtacacagggctcagatttgggggtaaggtgacttagcctggggtcacgaaatgtgtaaggatttcttggggtggctgtgacaaatgacctctaaccgtggcttgaaacagcagaaatgtattctctcaccatcacagaggcacacgtcagaaaccgaggtgccagcagggccacggtccccgaaggcgctgggggaggactcttccttacctctccccactcctggggccccaggcactcattgtcatccctgggcttgtggccgcatcactgcaatctcttgcctccatctcttcccttggccttcccttcaagtctgcgtccaaacctccctctcctttcttctgttaagaaccagtcactggatttagagcccctcaatccagtatgacctcctcttaacttgattacatctgcaaagaccctagatccaaataaggtcacatgcacaggtaggggctgggtgtggagtaggacccgaacttcatcggaaacacagctcaggccactacagaagaaagtggtgttggagctggatgctggctgatgggctgggagcagcgaggagccgtccagggaagggtgttgaggctggcagtgtggagaggccaggaggccaccttggaaggcccgaggccaggtggccgaggcagagggtatgaggggcacccgctggcctgtctgcatcagctcccctcaggtggagcctttctcagggccgagcttcttggccgtcagatgttcccaccaggctgtgttcagcctcagagtcgataactgtttccaggctgggcgccgtggctcatacctgtaatcccagaaccttgggaggctgaggcgggcggattacctgaggccgggcattggagaccatcctggccaatatggtgaaaccccgtctccactaagaatacaaaaatcagctgggcgtggtggtgggtgccggtaatcccagctactcgggaggctgaggcagaagaatcgcttgaacccggtgggcggagcttgcagtgagctgagatagcgccactgcactccagcctgggtggagcgccactgcactctagcctgagactctgtctcaaaaaaaaaaaaaaaaaatctataatcgtgtttccttttttaaacaggaaactactttgcttcgcactttttcatgggaggagagaaattcgacaccccccaccctgaaggttacctctttggagagaacatggatctgaacttcctgggcagccgcccggtccaggtgggtctggacagggctgtctcatggggctgtgggggtgggaggcccctgtccccagcagtccgcatcccagccatgagggcaagcaggcaccaaatcacccctaaagggggcagagctcctggcaggattccagttgagcttgggtgtgggcacgtgccctggaatgggttgtgtcctggtgctgccccctagaggccagatggccaggggcaggtcactgagaaacagagcagccatactgaatgggtgcgtctgggctgcaacggctgcggaacatggtggatttgattccagccttcttggatgactttctttacaaggcaaaaatagtatttacagactgggcattgtggctcacgcctgtaatcccagcacttggggaggctgaggcgggcagatcacctgaggtcaggagtttgagacaagcctggccaaaatggtgaaaccccgtctctactgaaaaaaaagaaaaattagccgggtgtggtggcacgtgcctgtaatcccaactactcgggaggctgaggcaggagaatcacttgaatctgagaggcggaggtggcagtgagccgagattgcaccactacactccagactgggcaacaaagggagactgtctcaaagaaaaaaaaaaaaaagaatatttactttccctagaacagtgggcaagagacatggtccaaaggagagatgcagacagctggctaacatcttcccctcgttgccagagaagggcacattcgagtactgtcatagtactcgagtactgtgagctgtctgttcagcacacatgtggcacctgctgcgtgcctagtgctcttccagggcttggggtgaaagcagaccctgcctctgctacctggtgggggcgtagacaattaatacgggacaaatgggtagaagagagaaggggcagaaagggaggctctactggagaggccatggctgaaccaagccatgataggtgggaagggggcccctccagaagaagctagaaggcagggggcctgggaacagaggaagaggtgagagggtgcaggcctcaggggacaggaggccggaagagccagtaaactttgggggccctggggcgggttgctgagctgtgctcgtaggaagctttggggatggaaagggtggggactgaggaaggggctgagggtgctcggggcagtgatggatatgggaagcctgggagagcaggttggggatgggcagccccagcgtgcaggggtctggcgttgaggctgcctggctggatttgctcagggtgatttggtcctggccgttgcgtgtgctggctgcgtggcctgcagcttctacctgtaaatgagaacagtgcacccagtatagcccctcccatgggactagatcccagggataccctctggggctgtggctgctgcaccctgacccgttttctgttgttggctgctcctgagggagtcacctggggccctgtggtttttctcctagtttccctacgtcactcctgccccccacgagcccgtgaagacgctgcggagcctggtgaacatccgcaaagactccctgcggctggtgaggtaacttcaccctgcccctggggaccctgtggctctgtggggcgcagcctgtggtggaggttctggcttgatgcttgaggaaaagggcaggcgggaggggccccagtttctgcgccctcccgtgtggaatgagaggctgtcctgggctgagcgagggaaagggcatgtggaacaagagccgtttagccagggcttctcagctgtgccgcacagggaccctgggcagtgtctggaggcagccaggtggggtgcttggcatctcaggtgggtgccaggggtgctgcagacttcctgccatgcacaggacggcccccccacagacaggaatgacccagcaccagatttcagcaggttcagaaactgcttaaaccgactagacttgaggcatctggggctgtctctgaaccaaaagcacgtaccccgtcttctgtgggcaggaagaaggagaggcaagccctggaccactgggctttcatgtacaaataggaaacagcccctatgtctactggagaagcgggctgtgtccacatagccacctccacggcccctcagcctggcaggggaggaggcagcctccgcagatggggccgctgacccgctgcctttctctccaccgcctggggtaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtgtgagtcccgcgggcggctggcaccggcctggctgggggccccagactcctgggggaggcttctgtccaccttactaaccagagggagaaaaccaaaccgtgctctttgaccatactcccaggactttaccacgatgtgaggggtttctcccaccccagggactccccacttttctgcgggaaccagctggggtcctttgactggtttcagttccaacgctgcctggaggtcatgcaacccctgcactttgagggcccagtcccacaagactgccccacttcagatgccactcataagcccccgctgtcacctgaacttctcagcaaccagccataaatcaggctcccacagtcccctcctcaggcttgatgagttgctagtgtggctcacagaacccagggaaacacttggctggtgtttgttggtttattgtaaaggattcagatgaagaggttcacagggtgaggtgtgggggaaggggtggggcgcaccaccttcctcgtattcagcaaaccagaagctctcctgaaaaccccatttcagggccttttctggaggcttcatcacgtaggcaggattgatgattaactccatctccagcccctgtcccctccctggaggatggggctgggctgaaattcagttccaggtttttgttttgtttttgttttgttttgttttgagacgaagcctcactctgctgcccaggctggcgtgcagtggcacaatcttggctcactgcaacctccgcctcccgagttgaagcaattctcctgcctcagcctcctgagtagctgggactacaggcacgtgccaccacgcttggctaatttttgtatttttagtagagatgggggtttcgccatgttggccaggatggtctcaatctcttgacctcatgatctgtccatctcagcctcccaaagtggtttttgtttgtttttgagacagagtttcgctcttgttgcccaggctggagtgcaatggtgtgatcttggctcactgcaacctccgcctcctaggttcaagtgcttctcctgcctcagcctcccgagtagctgggattacaggcatatgctaccatgcctggctaattttgtatttttagtagagacggggtttcatcatgttggtcaggctggtctcaatcgctcgacctcaggtgatccacctgcctcggcctcccaaagtgctgagattacagccgtgagcccccatgcccggcccacctggcccaggtttttgtttgtttttcctcgggagctcttagacgacacttccaagtctctaatcatggcttggtctttctggcagccagccacctccaggagccaagagtcacctcactggcacataagacactcctaccacccgggaaattccaagggtttggagttctgtgttgggagcaaaggtcaaggaacaaatattagaacaaaagaggctcctagcacccctgttgctgaggaaatgacaagggttttagaggactctgtgtcaggaactggggctgggaccaaatatttattttttattgtgtcataattagatatttgtactttcagaggttttatttgagataagggtccttctggccctgaaagtttgaaaactgcaacttcagcaggagctggcaggactgcctccaggctacaagggcacatgtgccccaagtggctttagagacaggcaagagcgtgccccctgccttcctgcactggagcacaccgctcagtggtcagctttgcatctggggatagggtgtggttgagagcctaggctttgaatgctgtccccgctgagtggcttgggggcacatgactgcttgtgcctctgtgtcctcagctggaagttcgggtgggtggtgtgaggaggggaccatgtgtcctgtgcacagcccctcgcgtgacaggtgctcttgaaaggagcctgagtgctcgagttgaggggctggtggagacgacttatgtggggaggttcttagggacctgccaccaggtgaggccgcccttgggctctggccttgggctccccggcagccagggctcctcctgtggagcagcactttggggaggaacaggttcctttttctagactttgttctttgaggctctaccttgccccggcacttgattatatttctttaatgacactagtaatgcatgcctgtgtgctatgacaggcgtcgaattcttgggcgtaggagcatttggagtgaccagggcaggcccctctgtcccctccttgcaccccactgcttggggttgagtgtttgacacccacggggcctggtgccctcctcgggcctggccgacatggtggaggagctgggttgtggcgaggtgtccaggggctgccacagagagggtgtgggctgaggacacaggccagtgtaagttgtctatccgctgccccccagtgctccagctgtcaggggctgggtgaccatctcaagtgcacttgaagagagggtcccgctgctaccagaaaggctagagagagcagagagggtgccctgccagccctggctggtgtcaccctctcctagacccctgcgggctagtgatgagagaaatgccacagtccccccctctcaggacctggcacaaggccagcttcccctcccagcaggaatcacagagcaggaacagctccagtgccactgtccccctctgtcaggacctggtacgaggcctgcttcccctcccagcggggatcacagagcaggaacagctccagtgccactgtccccctctctcaggacctggtacgaggcctgcttcccctcccagcaggcatcacagagcaggaacagctccagtgccactgtccccctctctcaggacgcggtgcaaggccagcttcccctcccagcagggatcacagaaaaggacctggaggctccaggacctggaggctgtgcccaggcacccggacaccatccagcctgccagtgctccatccatttgagctgcagggcaagccaccctccctgcctcctgacaaggaaactgaggctcagacagaggggtgtgtccaggcctccgcatctcacaggagaaggctggggtccacctgagggtggcgtcttaactgtgccttttactgaggctgagcccgggcctcccctgtagtgcctccaaccatgctgggctctggcggccatggcaggcctcttctgcctttgtgtgtacagtggtggcccccccacgccccatcccatttctgagcttggtgtgcctttgtccaggagagcctgtggagccctggccacaggcaagcagggcggtggggtggaggggaggggctgtggattgtgaattgggttcctgcatggagttttatcagaaatgaaactgcttgaggcacctgtcttagggatgcactcgtgcctgtggctaagacatgcagaagggcggtccttgaagcagtgttgggaaaagtgagatgttggtgaccatctgctggtgtcccccaggggccctgactgaatcagtaaaaccaaagcgggacctgtgtggtggttcacaggacacagcccctgatgtgtgcagacgcatgaaagagcagtgttgacgcctaccccgtctgaacgttgaggaagagagacccgcgctgcatgtgggcaccattgtgcctccgccttccgggagtgatctgtgggtctctgctggggcggacagcaggcctctgggagcaggcgtgagggttggggaagatgcattttgcactgtgtatacttaagtactgtgttcatttaaaaagtaaactcaagctgggtgcagtgactcaggcctgtaatcccagcactttgggaggctgaggcaggtgcatcacttgaggtcaggagttcgagaccagcttggccaacatggtgaaaccccatctgtactaaaaataaaatattagcctagcatggtggcgcacacctgtaatcctagctacttgggaagctgaggcaggaggatcacttgaactcagaaggcagaggttgcagtgagctgagatcacaacactgcactccagcccaggcgacagagcgagactcttatctcaaaaataaataaataaataaataaataaataaataaataaataaataaacaaaccaacttagcaccgatggaaaggaaaagcacagctacactggggaggtatcaaagggattgggcaggtgtgggctctgggagaattgtagccaggcctgacctggggagagctgcatggtgagcagagaggccgtggaaggccctggaagggtgagggccacgtggccatgtaggctgtttgctgttccccatgagagagggtccccaaaagacaggtgtctgcggcccttccagctgtcggagtgggagggacgggcacggagggccctcttcctgccgcagcctcactgcttgctcctggctccctgcagatacagccccaagagcccctcgctacagtccgagaccgtccactacaagagaggggtgagccagcagttctccctgccctccttcaagattgacttctcggaatggaaggatgacgaggtaatgctggctgggcggctccttgcccttcgctcctcctgaattctctccccttgggggtggggccagcacagtggggtctgtgtgtttggcttcctccagggttcataagacctgggaacggccgccccagtctgtgctcaggtggacgtgtggatgggcgggagcaaggcctgggccatgtgctgatggggccaggggaccagaggccgaccaggcagccgcactcggaggctcagacactggggtttggggagatgtgaagaatggggcaccccctgccaggctgcagcaatgcagggtctgttcacaccaggtggcattccttcaagctttttaaccttacttttgtttaaaatcttggtgcagacatcctttttttttttttttttttttttttttgagacagtctcgctctgtcgcccaggctgcagtgcagtggcgcgatctcggatcactacaacctctgcctcctgggttcacagcattctgcctcagcctcccgagtggctgggactacaggcgcctgccaccacgcccggctaattttttgtatttttagtagagacggggtttcaccgtgttagccaggatggtcttgatctcctgaccttgtgatccgccggcctcggcctcccaaagtgctgggattacaggtgtgagccaccgtgcccggccattgctgcagacctcttttaaccaggtcttttgtaggttgcggcttgagtggctgctttgctagttgctcctcctaggcccctctccagcttttagtcaaagctgtgtcctccctccttccccctttgccttgttttccagcgtccatctggtctgcagcttgcaaagaccctggtccagggggttcctgtgtaacagtacagaccttgtgtggccgggcgcggtggctcatgcctgtaatcccagcactttgggaggccgaggcaggcggatcacgaggtcaggagatcaagaccatcctggctaacacggtgaaaccccgtctctactaaaaatacaaaaaaattacccgggtgtggtggcgggcgcctgtagtcccacctactggggaggctgaggcaggagaatatcatgaatccaggaggtggagcttgcagtgagccgagatcacgccactgcactccagcctgggcgacagagtgagattccgtctcagaaaaaaaaaaaacaatgtagaccttgtgggtcccaggtctgaggccaggaggagacactgaccacatgccctgctagcaggcctcatgagctgacttacgctggggccagtcctgtggctgtgttcctgacgtttagccactctctgtaaaaagcctcccttgtccttgcattaaaaataaaacaagccaggtgtggtggctctcgcctgtaatcccagcacttcgggaggctgaggtggaaggatcatttgaggccaggagtctgagacaagcctgagtaaaaccttgtctctatgaaaaatacaaaaattagctggatgtggtggtatttgcctgtagtcccagctactgaggaggctgaggtgggaagatcgcctgagcctgggagatggaggctgcagtgagccatgatcgtgccagcgcacttcagcctgggtgacagagcgagaccctgtctcaaaagtaagactacctgggagtgggggaccaccaggttgtctaaggaggggtgaaaaccgaacagatcaaaactcccatgctgatcagtagtgggattgtaccttggaatagccactgcagtccagtctgagccacatagcgagactccatttcttaggaaggtaaaaaaaaaataaaaataaaaataaaataaaagtaaaataaacgtctccccagactccctcgggtgggtggagtctctgtcctctcccggcatcactggcgtggaccctgcaccctgctctcacgtgtgactgtgggtgctgtgtggcgtgtgtgctgagctctggggagtgggagtttgggaggtgtctgtgtttcctgtttgtttcatgtttcctggggtccctccccagcccctctggggagccccagtctccgagccctgtgagccatgggtttgcaggtgaggtggccggggtaggggagtggtcattgtggccagcttcctgaggggtacggtgtttagggcccagagagggttggaatcacgatgcccccagttgtccttacctctgtcccggacttggcactggacccgccagggggcctttggtgagggtttgctgaggaagctgaaggagggcccgcgtgcagcatagtgctggctcgtctgtggatggccacgctgagttggcgcacataaggggcagctgctgctgcggggccttcaaggtgctatccttgtcaggacttttgtggatgcaagtgacagaaaaacatttggtctggtttaagaaaagaaaaccagagacttactggtgtagattcagagaaggctgggtggcctgagatttcttccagggcctgtgtcatcagggtggggatctctgtggcttagcctcccatctccctcagctggccctgctccagcgcgtggccatccggctgggtccggagatgcttggaggccgtgtgtcttctctttgtggccccatttggggcgggggcctcccgtcctgcagccaggccgcagagacctggagtaggagggagacgcttccccgaagagaacctgaggggctcagatgctgggccaggcatggcttagcatcaagagcgcagctgcaaggacaggccacaggggtgcccagcatggctgcactggccttgcccaggagcagagaggacatgtgtggaggggctgggggcccactttcgttctgccgctttttctctctagagtgttaggccagttctgcagctctgtgagcctgggtttgcccctctgtagactggggctggaagcagtccctcgcagggtggccacgaggggtccgtgatcagcatgcaaagggctttacctggagccgcccactgtaaacccgtctgccagccggggagtgggagagaaggctatagccaccatcttgcacgcctccccagaccgttggtttttattccacaccagtaaagcactgtcagcacctagtttctgcagtgtgatgagaaaaaaaatcacagctcactcagaggctcctcagagcacagagcggcccacgccagtgctgaggtgctggctgcgcggatgcattccaggcctgggcagaagcgaaggggtgggcaggggcgcgggggtggatgcgctccagaaagctctgcctcccccgtttggctccatcacctaaaggagtggctgccggtgcgcgaactccccatttccgggcttcatgacagcccttgtggcagcagtgtgggagcgttgccaggcaaccctgggacgatgactcctgtgtggactcagtggagtgggcaggaaacaggctcacaaggggcctacagtcccagcatgatcagccctgacaggccccccagaccggggaagggagtgtccctcactctggcaagcccaggtgtctgtggtatccctcagacggctgggagctggaggcctagctgggtcccagtgggtgtgaacatgtgccccacgtccctgcagccttttatttttccccctttttttgagacaggggctcactctgtctcccaggctggagtgcagtggcacaatcacagcttgccgcagcctcgaactcctgggttaagcgatcctctcacctcaactttcacagtagctgggactacaggtgccacaactactggctgatttttttttttttttggtagagacagagtttctctatgttgcgtaggctggtctcaaactcccgggctccagcaatcctcgtacctcggcctcccagagtgttgggattataggcgtgagccaccacgtcaggcccaccagtctgcagctttctgatgtgtgtggacgttttcacaaagccgtggcccaggattggccgccttggccacctttcgcacccttttctcctgcaccctccagccctctcccggaggaggctgggtcggctcctgttgcctggacacacagggcttcagggtgctggtgttgactgtgtgttctgccagccacagcacttggagctttgtgttaggcacggcttccgttccattttgccaaatggggaaactgaggctcaggtggggttctaattgtagtgaatgggtgaggagctagacttgatgccggcagccttgactctggccctgggccagtgccctgccagctcctggctccacccttcctcactaacagagaccacggcacttctcagccttcacagcatagcccccagcatcagtgtctctgtccacctctgtccatgtgtgcgttgttgtccatcccatgggacttgtggctggaacccctgacccttcctcgtgagatgcggggcctaggtccgtgtggacttggtctccaggcttgtggtttgttcagcagatggctgcctgcccagggcttcttgtgtggatgggttacgtgtgccattcattctggtctgaatggaactcttagctccagatggcaggaagctgcggtagccgtgtgccaggtgcctgtgggtatggagtccctgctgggtggggacatgcctgggaacgccagggtgctgccagcctttgccgtgtgtccatgtccacatagcctccctggttcgcagtcgggtactttcttgacactgatgtttgtccccgtccccttctcctgactgctgtctgtggtccgctgtaactcctttcttctcgtctgtatttttggtaggaaattcgctgtgttgacaaatgttaggaagaaacatttccctcggttccttaaataatagtaatatttggccgggcgcggtggctgacacctgtaatcccagcatttttggaggctgagttagtcggatcactggcggtcaggagttcgagaccagcttggccaacatggtgaaaccccgtctctactaaaaatacaaaaatttagctgggcgtggtggcgggcgcctataatcccagttacttgggaggctgaggcaggagaattgcttgaacccagggggtggaggttgcagcgagccgacatcctgccactgcactccatcctgggtaacagatcaagactctgtctcaaaaaaaaaaaaaaatcataatagtaatactcacaacaactgtagcagccaccacaggcagtgtctctgtgctgggtctgtcgagaggacttcatttgcgctttatccttgaaacccatgcggtagcgtggtattgaccccattttacaaggaaagaagccgaggctcggagggaggagggcctgagatgaaagccaccctggtcactggggtggggacgtgtgcccctgccctgcttccgctgcccacttcacggggggacagcaggggagaggagacatcctatgtgtctgttggttctgagcattgctgttcaggggcgggtgcttggctgcgggctcagggttcccttgtgctgggccaggagtagtcccacctggacatccgtgggggtggttgctgcagacatggaggggcttgtcccttcctcatgggtcttagtcagtgaggcctgtggtcggtcttgggaggcaggaggctctcccctcacccaactgcccttgcctgggctgggcctgccaggcctttcctatttgatgtttcatccatattttgtttttgtttttgagacggagtctcactgtgtcgcccaggctggagtgcagtggtgtgatctcggctcactgcaatctccgcctcccgatttcaagtgattctcctacctcagcctcccgagtagctgggattacaggcatgcgtcaccatgcttggctaatttttgtatttttagtagagacagggtttcaccatattggccaggctggtctcaaactgctgacctcaggtgatccgccacctaggcctcccaaagtgctgggattacaggcgggagccacggcacctggccttgttttttttttttttttttttttttttacacctttattgtgttataattaccatctcctgcagctcactcgtgttaagcgaatgattcgctggcttttagaatgctcacagtggcacagccagcatctgttctttcagtaaatcttcattgagaaataaatgattctttttcttcccagaataaacagatgcatgtgtccattgctgttctgtgccagacaccgaggatgtcatggtgactggagaggcagggtccctgccctctatggagggagtcagggagcctgatggtggccggtggctttcctggttgccagggtatgagcaatagaagcccaggggcgaagtgcttcctgaggcccagagaaggacgtggcctgtagagagtagggcgagacccacagagcagtgctggggagcaggggtctgagaggatggcactgtgctgggctgactgctggggccctgggggccgtggggaagagggtggccttcagcctgtgcacagcagggggtgggatgaacgcaagaggaagcttctctttggactcaagccagcctcgtggtctcccttgcttgccttttgtgtttgctggggccaagtccggtgccttcttcagaaagttacagggagttgcccagtgaccagcacttcccctcagaggcacgcacccgggagaactgaaaacgcggttcaggcagacacttgcgcaccggtgtccagtgcagcgctgctcaccgtagccaggacacaggcccagcccggtgtccgtcgcaaaggaacgcgtgcacagcgtgtggatatccacacagtgcctgttatttggccagaaaaaggaaagcagcaccgatgcgtgctgcaccgtgggtgaactttggaaacatacctagacacagaaggtcacctgttgtgcaattccatgtaaatgacaggtccaaaaatggcaaatccctggagacaggaagcacatggtggctgccgggggctggaggaggggatggggagtgtgtgggtgctgatggctacgtgtggggtttccgtttggggtgatgaaaagttctggaaatggatggtggcggttgcatgacattatagatgtactttactcaacgctgttgaaacgtagttaaaatggcagattttgtgttgtatctgttttaacacacacataaaaaaggtgccaagcctggcatccgccttccctgccatctcgaggcgtgtcctctgagctctgctgctgcctcctgctcctgcctgctttgtccagctcatttgttgaccgactccaggcttccaggcttggctgtgtgggtcctgaccattcttggcaactctctcctcagctgaactttgacctggaccggggcgtgtttccagtagtcatccaggctgtggtggacgaaggagatggtgagtgcgtcctcttccgtcctcctgggcgtgcaggccgtgcagggaggaagcacgtcttgagggaggagtgcttgcagcagtgatgaagcaggccaggcatagggccttgggcttcccacagggcagggtgtgagcagcttggagtcccgggcaggtgaggaggtggaaagtgcaggagggcaggtcccagaacaggctcaggactctatggactctgtgcaggctgagccctcggtgccgcaggcctaccagggtcggggaggtgagatgcctgggtggggcaggccccgactctgactactctgcccctctctccccagcagtggtggaagtgactggccacgcccacgtgctcttggctgcctttgaaaaggtaagtgccatctggccatcactttcccggggacctgggagctgggcagggggtggccttttgagacgagaagcctgagcaggggctggggcttggtggggtggctgagtgtcaagggccccggggcaggttggggcgtgtctgtggcttcctgctttctagcattctggtcctgaggccgagtgccgctgtcaggaggcttagcatttcctttttttttttttttctttcctgagccgggctcactctgtcacccaggctggagttcagtggcgtgatctctctcggctcactgcaacctctgcctcctgggttcaagcgattctcccacctcaacctcccgagtacctgggagtacaggtgtgcactaccacgcctggctaatttttgtatgtttagtagaaacagcgtttcatcatgttggccagactggtctcaaactcctgacctcaagtgatccacctgccacggcctcccagagtgttgggagtacaggcgtgagccacgtgcccggccttttttttttttttttttttgaggcggagtctcaccctgtcatccaggctggagtgcagtggtgggatctgtgttcactgcaacctctgcctcccaggttcaagcgattctcctgcctcagcctccaagtacctgggattacaggcccatgccaccatgcctggccaattttttttttttgagacagagtctcgctcttttgcccaggctggagtgcagtggcatgatcttgtctcactgcagcctacgcctcccgggttcatgccattctcctccctcagcctcccaagcagctggtactacagatgcccgccaccatgcccagctaatttttttgtattttcagtagagacagggtttcactgtgctagccaggatggtctcgatctcctgcctcttgatccacctgcctcggcctcccaaagtgcttggattacaggtgtgagccaccacacctggccatctcttttcttttttttaaacagggtctcgctctgttgcccaggctagagggctgtggtgtgatctcagctcgctgcagccttgacctcctgggcttaaggagatcctcccacttcagcctcccgagtagctgggactataggcatgcaccaccacgtctgtctaacttaaaaaaatttttttgtagagaagaggtctcgctatgttgcccaggctggtctcaaactcctggcctcaagtgatcctcccaccttggccttccaaagtgctgggattacaagcgtgagccaccgtacctggccaagaggcttttcaaagggtacttggagtgtgttgagggagaacattgtagactgaggccagccctgtagaattctgtagagcctgctgccatgccacgggctggggctcccacaaggagggctgtctgcggtagactgccttcgccctggggtgtgcagagatcagcaatgttgttacctcctcgggctgtagctttttcctaccaggctcagtgtccttgggtgtcacctggcacatgtcacagacccccagtcctgctgctccttccgccacctgcctgcggcactctgaccctgcaggctgggcaggccctgcttcctacaggagccttttcctgacaccactcaggacaaacatctgttgttcccacttgatgttcacgagggcagcactgtcctcttgggtgtcttggcatccccagagctgagtttgatgtctggcacagagcagacactcagaacactggcaggatggacgaggggttgctgcccacctggcatgggtttctgctgagaacctggcggaggtggtgggacgcacgcttgtttgatagtgccttggtgcctcggtggccccgcccccagtgtgcactgacgttcatcagcaccctgccgttgcaggtctgcgtggcaccatcctgctgcctaggagtcggagggggaaaggatcccgtgtgacaaggcccagcctgcctgctgcgggcttcacgctgcctctgggtcctgcctagcccaggctctccacccacctccagccccatgtgcagccgcagcccctgagagctctaagtgcagagtccagctcttacctgtgatctgggtctttctagagcaccccagggtcgggggttctgttagctgggtagaggaccctctcctctgtgtgtcctgtggcgaggctgggtctgttctctcccgggtccaggaccacagactgtggtgacacaagtgccctgggcagagggcagccttctgcctttttagtactgggctccccagctgctctccccggcccggactcgtcagaagccacggtgactattgacacatctgcatcctctggcagaggcagatgggacatctctggcaaaatggtctattctgtgcttgaagtacagaacccagtgggaaactgctttatttttggagtccaacattctggaaatttctgttagaacccaccagcctcactggaaaattctgagtgctgatggtggttgactgagaagggataatgagtgttgttgcgaggtctccgatctcaagccgtaattaaccttgttgaactctgagcggtggtgtgtttccctggataccgccgggtgtgcttgttctatttcgttcctgcgtttttagagctttgcggttccctgtgtgtgcaccactgtgcgtgctcccgctctgtctttctaactcagccgggcctgggagagcaggaagctgttttgtctgtcttgattcttgctgccaggtgatacttctcggtgtgcaggaggcccttgtccatcatctgaacttggctgattggcattcagcttgagtgtgcttgagaccaaccgaggagagttgggttctgtgggtcagcagagggtccccgggctgtgtgttctggaggcctcagatagttgcacagccaggcctgaggccgtgttttcagaaatcccggctctttcgctgtcaagtggccccacccttttttttttttttcttttttctttttccagctgtgggcatggattggctggggcagggtggccaacccaggcggccacgcaggggtgctcagaggcgccagcttgaccaccttaacctctttgtctttctcccctgcagcacatggacggcagcttctctgtgaagcctttaaagcagaagcaaattgtaagtcatcagaggaaatatgacgtgcttgaattaaaagacacacatatacaatcactcacacgcatactcatacatagacacacactcatacacacgcacatatactcatacacgctcatacacactcatacacattcacttgcacatatatacggacacacatacataccatcagacactcacattcacacatatatagacacataaacacacagacacacacatacacacataaacacactcctactcgcacacactcatacagacacgacactcatacacacatacactcacactcacatgcagtcattcagatgcacacactcagacacactcatatactcagtcacacacatatacatagacacactcgtacacatacacacatacactcacactcactcacatatacatagacacatactgatacacacacatatacccattcacacacacatagacattcatacacatatacacatacacacacgtatacagacacacactcatacacatacccacacatatactcacacacataaactcacatgtatactcatacacatatacatagacacacattcactcgcacacatatacagacatacatacacacaatcacttgcacacatatacatagacacactcatacaatcactcacgcacatatacaaagacgcatacactcacatagacacacacacatacacatatgtacagacacacatatactcacacacacttatatatagacacacacacacactcttcagtagtcttcatgcactggtcttcctaggctacccttgctgctgcctttgaaataactgtgcaggggctgggcgcagtggctaacgcctgtaatcccagcacttcgggaggccgaggtgggcagatcacttgagcccaggagtttgatatcagcttggccaacatggtgagaccccgtctctactaaaaataaaaaaattaaccgggtataataacacatgcctgtaatctcagcaactcaggaggatgaggtaggagaatggcttgaacccaggaggtggaggttgcagtgagccgagatcatgccactgcactccagcctgggtgacagaggaagactgtgtcaaaaaaaaaaaaaaaaagctgtgcaacagcctgttgacttccctgtagagctctaagctctgggacgacgggtccctgtcttgggtgagcatatatgttttgcgtgcccgccatgtacagggacgcctgcaggccctgagttctgtccagtttgagccattgtgtctggaacatagtgttaagtaaatatttgccgaatggatggatggaaaaggaaggaaagagaccagaaacaaagtctgcaactccttctcctcttccttacaaattgtccaatatgtcagtattggacagagacttagcttgacttcatcaatacttgaaaagaaggattaaatagttgagaataaatggagctatagagcagtacatctgttctctggggtcagcgatcctgggatgctgcattgggaagtgttattcctggtggcctcacaagtaggcaccgagaatttagaggatggggtgccctaaacagcagtgttagatcttgctaatgagatgtcctaggccacagctaacagttactccgtgtgtactgttggggcgcataagacctgtttcaagccaccacttgggaatgatttttgttagtttttaattttttaaatatttaatttaattttaattttaattttattttattgagacaagacagagtctcgctctgttgcccaggctggaatgcagtggcgcgatctcagctcacttcaacctctgtctcccaggttcaagtgatttctcgttcaggctcccaagtagctgggactgcaggtgtgcgccaccacagttggttaatttgttttgttttattttgttttgtatttttgagatggagtctcactctgtcgccgaggctggagtgcagtggcatgatcccagcttactgtagcctccacctcctgggttcaagtgattcttctgcctcagcatcccgagtagctgggactacaggcacgcgccaccatgcctggctaatttttgtattttttgtagagatgaggttttgccatgttggccaagctggtctcaaacttttgggctcaagtgatccaccagcctcggcctcctactaaagtgctgggatgataggtgtaagccactgcacccggccatctgttagctttttagaagagagtttgtccaggtgcagtggcttatgcctatgatcccagcactatgggaggtggaggcaggaggattgcttgagcctggggattccagaccagcctgggcaatgtagcgagatcctgtctatttaaaatgtaaatcacaataaacaaaagagaggtgcagcaaactctagcaggtccaggtccctgcaggtaccaggggaacaggagaccccagtgatggtcagggccttgtgttgagagagctgaccagcaggccctgggctccctggagtggtgctcctggcccatggtctctgggaaacccagcagcacaaaccgctttgcaatgtggtcagcgtgaggctttttggttgcaagtgggtggcaggacagaatcagcttggagacattgctttggcgtctttgaaaccagagaggcttcatgccttttggaaggaggatctggaaagcagtgggaacttaggctgctgtctggtgccttcaggcgtcagctcctgctttcctcgtggggctggtggtggtggagccaagtggtgttgggggtggtgaggcggtcagggggtggtggttgggcctgtgggttggcttcaggcccccagtagtggggagagccaccggctccagccctgttccaggtgctgctggttgggtgggggcaagcagcaggttttccctgcccttctcctggcccccaggggttgagctggactgacccctggtatggaagcctggtaagttggaggcagggctaggccaggtgggtatggaggagccctcatatggcagttggcgagggcccagtgagcccctctctgctctccaggtggaccgggtcagctacctcctgcaggagatctatggcattgagaacaagaacaaccaggagaccaaggtgtgtatctgggtgaggtttccctctgccattacagaagcccacaccaggagcagccgcggacagcaatgcttgccggttcccttccatgccttcccctggagtcctagacccgctagacaacatcatttttccttaattttttttaaagctaacagtttagggaacattttatcctttctccagcaaattcactagcttctgatgtaaattgccatccaggttccccagggcagcccaggaatgggggccagtgtctcaccctctaggctcaggtgtgtggcaccctgctgcccggctcctgcccgcctccccagagacagcacgtccctgcagctcctgggggagggatgcttattctgtatgtccatagaaccagtcctggtgcctgacaaataagccgtggtgtaccccagtcagggaatgtagcaggggatgaaattagttttttttgtttttgttttttgagtcagtctcactctgctgctcaggctgtaatgcagcagggagatcttggctcactgtggcctccgcctcccgggttcaagcgattctcctgcctcagcctcctgagtagctgggaccacaggcacgcgccaccacacccggctaattttttgtattttagtagcgacggggtttcaccatgttggccaggatggtcttgatctcctgaccttgtgatccaccctcctcggcctcccaaagtgctgggattacaggcgtgaaccaccgcgcccagcctaatttttaatttttgtatttttagtagagatggggtttcactatgttggccaggctggtctcaaacttctgatctcaagtgatctgcctgcctcagcctcccaaagtgctgggatttcaggcctgagaccaccacgcctggtcgatgaacttgttaaaaggcacactgacatgagtgaaactcctgcctcttaagatctcttggaaagtctcacaggcccgcttcattatggcatctgggcccaggacaactggagcagctccacgtggcgggagcggagcacctggccgggcctcgcctcaacccagggaagtcagtgcattcatgtttcataccagggggcggcccactttgagaaaaggttcagagagggaatgttttcagccgcccgggcatatggtctctgttgcactgactccacgctgccattacaacaggagcagcggggactgtataaaaatgagtgggtgtggcggtgttccagtaagattttatttatagaaacaggccacaggcctagtttgtggacacctgttttagatttttggctttctttttgtccagttgctaatgtggtttctggtagctgccattaatgaaaatacttctaacatattaacttgttttttgttttttttgtttgtttgttttgagatggagtcttgctctgttgcccaggctggagtgcagtggcagccatcttggcccactgcaagctccgcctcctgggttcacgccattctcctgcctcagcctcctgagtagctggaactacaagcacgtgccaccatgcccggctaattttttgtatttttagtagagacggggtttcactatgttagccaggatggtctcgatctcctgacctcgtgatctgcccgcctcagcctcccaaagtgctgggattacaggcgtgagccaccgcgcctgaccattaacttggttttttttaaaccaaagataacgggtaccctgaccctcaggaagatgtgtttcttaggtgcatctgttcctcattttttctttaggtctgaagaacagaaagagaccatgttctcatgatttgggtgggtgaggggcacagaccctccccctctgccaggtgctgagtttgcactggatttgagcctggtgattctgctctggggcaacctccccctcccctctggacttctctttgtcatgacagcccccagggtagggtggagtggggtgggacagctggggacaggaagcaggagccgtactctggcctttgggaggctgctgacccacaagcccttgtcccggcagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcgtgagttccccggccggctgttctgtggaaggttctggaaattagggactggccacaccacggtggtcctgggatagggggccacaggtccgttgatggctaagaaagaagagttgtcattcatctagtctgtgctgaacgtgggcgtgttggctgtcggagtcagtcaccgtgagagagctggcagggacgctagcacggggcattcagatcttcacgtctgcctccagccaggcaaggcttgcagaacaaagggctacagaggcgctccagggcagatgaactgaacgaaaattgatgagtgaatgaaatctttattcttattttatttttattattttttgtttgagacagtttcgtgctgtcgcccaggctggagttcagtagcgagttctcagcttactgtaacctctgcctcctgagttcaagcaattctcctgtctcagcctccctagtagctgggattgcaggcaactgccaccatggccagctaatattttacttttattagagatggggttttgccatgttggccaggctggtcttgaactcctggcctcaagtaatctgcctgcctcagcctctcaaagtgctggtgttacaggcatgagccaccatgcctggctattttattttattttatttttttgagatagagtctcgctctgtcacccaggctggagtgcagtgttgcagtctcggctcactgcaaactccgcctcccgggtttaagtgattctcctgcctcagcctcctgagtagatgggattacagccctgcaccaccatgcctggctaatttttgtgttttaagtggagatggggtttcaccatgttggtcaggctggtctggaactcctgacctcgtgatctgccctcctgggcctcccaaagtgctggaattacaagcgtgagccaccgcttttttttttttcttttcttttctttttttttcttttcttttcttttctttttttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggattacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggccgagccaccgctttttaattaattacttacttttatttatttatttattttgagacagagtcttaactctgttgcctaggctggagtacagtggcaggatcttggctcactgtaacctctgcctcccaggttcaaatgattcttgtgactcagcctcctgagttgctgggattacaggcatgtgccaccatgcccggctattttgtgtatttttagtagagatggggttttacattgttgcccagtctggtctgaagctcctgacctcaagtgatctgcctgccttggcctcccaaagtgctgggattacaggcagagccacagggccctgccttgtttttaaaattttttttgtagagacagggtcttgctatgttgcccagcctggtctcgaactcttggggttaagtggtcctcgtgcctcctaaagtgttgggattatgggcatgagccaccatggccagctcagatctttattttaaaggtaaaatagaaaatatttcaataaatttttagcataacgctggttgcagatcacacctataatcccagcactttgggaggtcaaggcaggaggatcgcttgagcccaagagttcgagactagcctgggcaacatggcgaaaccccatctgtacaaaaagttaaaagttagccagatgtgttggctatagtaccagtgacttggaaggctgaggcgggaggatcggctgagcctgggaggttgagggtgcagtgagctgtgattgtgccaccactgcacccccgcctgagagacaggggaagaccctgtttcaaaaaaaaaaaaaaaaattatagcgaagtgaaaacaaagtatgctgggtagaaaattgaccaaggaattaaattgggttttctagagcattccagacatttcctcagtgaaaagccgctcgtagggccccgttctgagtgtcttccagtagagggaacaacctgaatgttctcagggtgaaaaaacgaccaggtcaaagtgcacatcccactggtaggcccttgccctggatcctgggatccctggcctgggtcctggcggtggggccggagcatagttggggatttgcctgcgcagctgcaggacacatgcgcttagtaggccagcagacctccaagccgggcgtggggctgtgcgaggatgctggtctgtgcagtcaggccatggggtcactggatgtgtccagatcccaggagtaagtgaagaggctgctggggcctggagggagaggccggccgcccagcctgtggcagatcctgtagcagggagggccggcccaggctgtctgtcggcctctcctgtctgaaagccacagagttgcgggggcagggaccaggaagtgggggcaggggtgggctgtctaggaaggttctctgtgcctgcccaggaggcaggcagtgttgaggactgagcctcagggtggctgtgtggctggagatacagcagggctgctttccagggagggtgccctgaaccgagtccaattctggaatcttcaggtgtgtggggtcagtgggtcggggccatcagactggagttcagagctcccgtgtggctttgagcctcaaggacgtggcggtagaggggcccctcacaggcgcccgagggcagagactgctgttctcagtagaaattgacacagaggaggcctgaggccctgtccctgggctgacggcagatgcattggtttgttggaggtggctggtttggtggtttggtggttcggtttcctggcctgcacacgtcactaaaggtgtctcaggaacattctacagcagcctgtggggcccttgtgtgagcaggactggcactgtgggatgacagggcatcctaggtcctggtttatcttctctgctcccagtggctgctgtctgtgcccctcagcttccccagcgtgatgtttttgcctcagtttccccagcgtgactccccacttcagcttcctcagcatgatgtccttgtctcagtttccacagcatgacatccccacctcagcttccccagtgtgatgtccccgcctgccatcctgtcctgcagccaagagctcctctgggctcagccaggactgctgatttgcagtcacgtcctgtctcgggtgcagcctggagcttcaggggtgtgacgctttgggggtcatggccaccagcctcttggaaacaccctctggagccccgccttgggcagcactgcatggccttgctgtgtttcctgcccggggccatttcattaatactgtgtttgcgggagttctgtctctcgtctttggagcgccccctccctctatttctgtacaggggagctgcttctttctttcttcccccatctttcctgcctattaaattcctgctccttaaaactaaaagaaaaaaaaaagaccgttgtgatctggaagcggggtcaccccaggacccctatggtgtggggggggtgttgatccctggggctgggagggtcccctcggggctgggtgtgtcgcctgggcctgatctgagccctccttctgccgcagctttccgggccctcctgcagatccgggcggtgcggaagaagccaggagccctgtcccccgtgtccttcagccccgtcctggcccagagcctggagcatgatgagcactctgtaagtgccgcctcctgcctgcgggatgggcgggagaggggcatgagtgcctgggccaggcgcaaggcccagacggtccagccagcagccccgtgttctcttctgtccagtgggcaggcatggcccccatggatggctgtgaggcatgaagggggtggccaggctgggccctggggtgccgctgctgggaacagcgctgctgccatcagtaccagagcctgcgacaaggctgagcgcggtcgaggtctcggtggagccaggtgcttttttttttttttttttctttttgaggcagggtctcggtctgtcaccgaggctggtgtgcacccaaagtggtgcaatgtcagctcactgcagcctcgacctcccgcctcaagcaattcccccatttcagcctcccaagacgctgtgaccacgggcgtgtaccaccacgccgagctaatgttttgtatttttagtaaggtggggtttcccatgttgcccaggctggtctcgaactcttgggctcaagtgctagtcctgcctcagcctcccacagtgctgggattacaggcctgagccaccgcctccaccccgtggttcttagtgaatgagccatgctgtttcccccatgcgctgctgtgcaaggggcactggtgaccctcctcccacgctccaggcccaccaggcgccctcagtggggaccttaagggcaggccctgcttcagcaacacaagggaggtggaaccctggcttcaaggacccaaagacagacagagacatggagagagatgcacagagaaacacagagacagggcgagagagaggtggagagacacagggagaggcagagacaaatgtggagagacacagagacaggatgagagagatgtggagagacaaagggagagacagagaaagatgtggagagacatagggagagactgatggagagataggaagagacagacagatgtggagagacggagagacagatgtggagagacagggtgagagagatgtggagagacacagggagagacagagatggggatgggtggcaggggctgtggtgggcagggagcagaatgggggagttggacagtgactggttgggcccgggtcttaggccccctgctccccactggccacgcgcattgtcagattgagtgcctttcttggctcttagctgtggctgttatgagccgttggttcttccaggctctgctgcctctctaaacagaaaagaggagcagagccctgaggactggcgttcacagacagcgcctttgctctagaaggctcctcccaagcccccttgatcagggccttgacctgggccctatgggcctccctggcagcaggtgcaatgtttctgaaatggggtcaatgtttaaaagtctggaatttcccttaaaacccagattttgggtttgtcttttaaaatctgacatggtcttgatgctagaggagaaacatggcttgggggtccctgtcaacccaggccctctaggcccctaccatcgtggggctcctggcaccacgctctccagcacttttgatgttggctttgattcggaaacgctgcgtgtgctcaggtttttggtggagagagaagcagcccctgagggatttgcctctgagagggtttcacctagggagtgatcgatgctcaggcgtggctaggtttattgtcccttgtttttgcccctccctgtttgtgttctggtggctgaggatccagtaggtccctccatgtttgtccctcttatgctgagtgagctgggcggccggggtccgaggtgtgaccaggcagctctgacctccacatgccccagaagggctggcacccagccagggagccgccgtcctctctgcatggagcaaaagcaaacgctcctcctcacctgccaggttcctgttggagccccttccacgtagtgacagaaagagccaccgtgggtgttctctccagcgagtgcctaaagatgatggtggggtgggtgggtctggggctgactcttctccccagccctcttgaggggttcatggttggtgataagtgagcggcggtgcctgggcaccggctggctgggggactttgaccagtgtggcttcaggatctccaccctgcacccagcctgcattaggcagcgttcagctgccctcacgtccaccttggccaaatctgttgccccaggtgacccagactgcggggggacaggcaatggggatgagattgggctccacagcctccccactgcagcagcacagctcccgggagctgccgagacgcacacatggcccacccagacccgagtcaaccctcacttaggacagtcccgagattcacgtcccccggaagcttgtgaagttctgcgccacggtgtggcaagaggacagccagtcagacctgtccagcccactccagggccgcgtgggggtggtagttgtaaaacatatgatttttatcttgacagtgtccctttaaaaaatcaaagccgcaccccgcctccctggccagcaagaaacctaaaagggaaacagtaagtgtctggtcctccggctacgtttttttgcccccgccctcatttttaaacccacgacaagtaggggagatcgtttccgccccaggctagtgtctgattcatataacccgtcagctccacttgcccagtcccggcctccctgcccagggagtttgtggaaccggaaaagctctcggtccgtgggcgaaacgccaggtgcgctggccccgccgccctcccctcagctttgcctccgccccgcgtggcccccgtgccgtttcccttttttttcttgctggcagtggaatggacgttgcaggcggaactaacgtcgctgctgcgttttgcaatcgcgccccgcgcatgcttcttggccccgtgtcccgctcctttaccctgcgggttcgagctccttgggctgagctttttggtttccttgggcttcccttgtgccccagggagcaggcagggggaccagcacacaaccacctggagcctccgtggcccaggcagacccagccgaaaccctgtgtgcgttggtgtagaaggtggaggccactccggagccacccggaccgtgttttcctttctagaggggtgaggggattctgtgtggttatttacccttaacttggaggcaggtatgggagcaaatgtggggtacacagaggtccagaaaagcatcccgggctcattgcccgggccgtgcccgctcccccatttctcccccacctccccgtggtctccaggcatcccgcacccatctcactttccccttccttccaggagctcggtcaggcaggccggggtctcccgaaaggagcactgacgagcgttgtgcccctcaacctggttttgtggggacagagcaggggcccccgcagtctgacttccgttccccagaacctgggcattttccttcttcctcagccttgttgattctgtctgctcccagtgagggaagaacagtggctcttagccagggtgcccgttagaaccacctggagcaggtcagcccccagaggcccgggcagggcacagctcccaacagctcagctctccctggtccaggacgcccctgaccgtgtctctcgcctctggcatggctttgctctgcccccgctcccagctcctgtctgtcactaacccttcactctccacctggggccaggcgggactgaaagccagggaggggctggttgaggccagggctggggcggttcttggcagatgccctcgtgcccgtcatcccaggcaccagcgtgggcatttgggcatccagccccgtgctggagctgatggctgaggcagggagggcatcggtgctgccagggagctcttggccaccctctgagggtgggggagtctcaatcccccaaagaacagagtggacaggaggtcatcaggaggagcgtctggggagcaggtggtccctgggcatgagccccctcacgcaccctgtccctacagaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacaggtgagcagcagccaggccaggtgcatggcagggtgtgtggtggcgcgcgtgcggagcgggtgtctttgtggtttcaaatcagtttgtgatgtgttctgtgtggcgattccccagaaggactcggagaccccgtatcaggttagactcatgggtaaagtttattacggcaaagaacgcagcagacgaggcaggaagagcgtccgggcagctggaggctttgatcccccgaccagggccacaccggcgtgcaggcgcatacgtgctctcgagcaggaaactgcaggggtcggtgctgtgtctctgctgaggggagcccctttgagcctctgggttcccagacttcattggggggctggccacgtaggcccactctgccggtgaccagccagggcagccgaaactcaggacctgacagtgacccaggcacactcactgctcttgccgttcgcccgtgacgagccacggggcacggtccctctccaggcgatgagtgcatcatccatcactcatacgacagccttcggagggcctggctcctggggttggccacgggtcattcgtggttcccctggagccttgcggtgtatagagcggcggctgccagggggactctgtgcctcaggcctgtcggttctcgtagaagagtgtcaggaaggcgcgggttctgcaggcccgccctgggcaccctccatgcccacgaggaggcagcgccaaagctcagagaaacgggggcctctgtctcctgctgcttctcctccccaggaaccaccagcggtttctcttctccttctagaaagaaaaggaaggctaggcccgtgccagtgtgtcgggagcccctctgtcgggcgggtctgtggtggccgctgttgcctgttggccgtttgggttggtcccggtggctggtgatgcccttctccagggagtgtccttgcgtgggtcctggcaggcgtgtgcaggggcccccaggtgccctgcatggctttggcagggttagccttccttgtcgttatcctctcacccctgcccaccctctcctctgtccccagcaccctacggtccccgtcttcccccatccacgaagaggatgaggagaagctctccgaggacgtggacgcccctcccccactgggtggcgcagagctggccctgcgggaaagcagctcccctgaggtgaggcccccccggggaagctttgcgcacccgcccgggccagccctcctccagcttctgtcgctggaatcagaccccatcccactgcccgcctgggcgcccccgtgcttgttggctcttgctgagctgcgcggctccttagcctcggtctgtggaggcagcaccccctggtggagcggctgtgcggtcccgggagggccgtgcctgatggcggcttgtcctggagcggtggccgcggctctctgagctctaggctactttcccctttgtttcctagagtttcataacagaagaggttgatgagtcgtcgtcaccacagcaaggtgagcgcctccttccatgggcacaaaccgcatgcagggaccaggcagccctggcttactggggccttagggctccaggtggtgttgggccagcacctcttctgccccaggaaccctcggccaagaggcccccctcggcggcactgggatcccggctgggagggactgaacgggtgactgggtcaggctgcgctgttgaccctgcagggctgtctgcctgggatggggaacacctgccagcattcagtcctggttttgaaacatgagcgtgtaatgtttctatgaccaaaaaaaaaaaagccctatgctctgaacatccaggacacagtgtaaaaaaggggaaaaaaaagccccatgctgggggatgggaaggagggaaatagaagggaaacacccagctttggggtccctggagagcaggtggggtcacggtggagtcctgctggagcacaagcctggggtccccacagtggctacagagcccttgggtaagagagacggcctcctgcccagagggacctgccgggacctggcccctgcctgtaggtccctaacctcaccctctgcctgcagggacccgagcagcttccattgagaatgtcctgcaggacagcagccccgagcactgtggccgaggcccacctgctgacatctacctgccaggtaaggggctgggggtctgggggtgaggggctgggtgcctgtcttagtccccagggagggggccctgctctgatggtcggtgcatagcagcagaggctgtccattggagcctggttctctccctggctctcagccatgcccctgctattgaccgtgaagcaggatgcgggccagggccatggccacaaagcagcctcaggcagggcctggctcttgggagcggaacctgcaccaaagccccttccctccctggggccacattggccacaggaggtgagagacgcgagagaggctgcctgtgagaggatggggtccttttccctctgcctgctgctcacgccaggagggcagatccggccccactgggatcaccacatgttcccccactcctggtcctatcgtgggcccacaggccccatgctgggtgccacgtgcgctcctggcagtgcctgagagctgcagacagagcaggagcaggtaccacacgctgtgctgggtagcgggggccctgggccacagagcgcaggggcagtgtcttctgggtcaccctgccccgggcctgacagaggccacctgatgcagcagcacatcccaggccaggcacagaggacggcgggggcgccaggcgccagcggggaacagcaaggcagcaaggctgggacagagggttgctcttctcacctttcccggaggctcgggccccagaccccatcagccaagcaccttcgtgctctgctctgctgggataagatcctcagtttcgaatcctaagctctaaagaccgggagggaatgggggctctcagactagtgtctcagcacctgccacgaggctgtctgcggctctggaactgcgataaacagccacggtgctttcagacatgaccccagagccactgcttagggagtgtggctcttccctcgcggctgccaggcttcacccgcttcctggccccagggcccaccattgctcaatcctcctgagtcacctggtgacctgggcctgacattgggtggttgtgacgtgctttagttggaaaggggctcttgtgcccccggactctggctgagcagtggcctgtgctcatgggctgggcgtgacaggtcgcaggtgcaggagcaggcactgcctctggtgccctgatgaccacagcggcctgccccgaacaactcacagcagaaggtgtgtttaggaccagcttaccttaaagtgacacagaattcgagtaaggtctttcagaggatctcaaatatttcattctgattaaaaacttggggggtgatcggggaagaggccagaaggacctcagcttctgggagccacgaacatgatatctgatcctgcagggtggccctgtgggggagcatctcagaggctgcgcctcccctctgtggccaggcctgggaaggattgggacagctacagaggaggcccacacagaggaggccaggactccgagtctcatgccccacccacaggggagggtctcgggccttcttcaggcccacagacgggggcaggcagtcgtcatctgtggaggcggtagaggagaggccgagtctacatcggggcagcctgaggtgaactcctgggccctgggccccgctcttggagttggctgctgctgaatgccagcaggtcagcctgcacggcctcagttctgagccacggagagcacatgtgcctttgggggctgtttggcgccatctccgtggctgtcagccttgtcagcacaggtttctgtgtgtttttaaatccatgtggtggcccctctgttccactgactttttcacatcacagagcccttgactgtctatccgtgtctgtgcgtaaggcatgaacacacgccagagcctttggtttctcataggggtgcagccgctgcctggcggggtgggcggcatcactgaaccctgctgtccctgtagatgggagggcccatgagatggtgaacactgggggccctggtgtcttggacttggccctgagctcggtcctgtctagcctcagccccccacccagggccttcactcctgaaaccagaggtggactgcgcccgttaggtccttcatgcgcccttccctaggctgcggcagcgggaggtatgggagggaggggcagggccagtgcgctcctccgcgttgaattctggctgcgctctgcctcccagctgtggttctccttgtggttctctgtggttgcagcagagtgtttgtttctagacggcctcgaccgtgtccccaagctggtgcccttgctgtggctgtgctggctgctgcgcgcttgctaaccgagcttccgtctgtctctccccctctccgcgcagccctggggcccgactcctgctctgttggtatagacgagtaagccggtacgtgacctcccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcgtggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatcccccccaagaggcgccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctatgaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccgtgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatctggggacagcgcccggcggcgtcgtgcaggccacagtctgggcattggggctctgtgggaggctcctctctttgccttgcagtagccatccgggggctactctgagcacgggcttgttctcacccagggccgctccccacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggtgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctctttttttttttttttgagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttttttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgaggtccgcctcctgggcgagacccagcagtggacagcatggtcctcacacccagctccctgcacacccaggccagccacccctcccgctcgtgcacaggcacgcagatgcgctcacacgtacacacacacaaatgcacgcccacttgcacatgctcacgcacatgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaatatcctgtctgctccttcctccgggtgcagccctcaggattgtggctgtttcctgacccggagttttgccgctgggtggttggcggtggctcccgcaccgtggcagctccacggcctctgcctggcttccctctggggtcagggcagtgagcaaggtgagggctaacgagaacgggcagctcccagccatccctgtcagggctagttgtctggttggagggaagccacaccctccagattgggctctctcgtgaacaggtggttggggagcccagggcctccaggtttgtgagtagtcgctccggtccccatctctagtcctgatcatctcaaggcatttgctgagcacctgctgtgcgtcagtggaggcagaagagctgaggccccggccctggccccgggcgcctgccttccaggcagtgagatgcccagcagctaatcagaatcctgccaggtttggttactattaggaagaaagtcagcatggtggtgagatgaacccgtacaaggtctcatttaaccgggtggcagggagggcctctctgaggagacttaaacagccctgagggctgaggaggagctggccctggaagagtgttccaggtggcaggagtgagcctgatgtgtcccctggggacggagcccctggctggagtgaagggtgctggatagatactgaagagcttgtaggggctgctggagtgtttttataagggggagtcagttttaaaaacaggcttccaagcggagaagcagtgctagcaccctgcggctggcgtgtggaggccggacggtgggagcaggtctagctgcccatggttgtgggctcgcaggctggagcccggccccaggcctctgcacagcccccgctcccctgcccagggagtggccagtgccccagggcacccaccacaccactgcctaccactcagggccccagctcctttgcgtgcaggtcaagctgccaccatggcccttctttgaagactgtgagggtggagggaaagcccgtgttctagcccatcagtccctgccccgagaaggctgccacccatgggccctgcagctgctctgacctgcctgggtctggccccatcccagtgtgggtagaggggtgcccagggtgtcagacgggtgcttgcatgggccagatgggctccccctctgtacctcccagaagagccagcgcttgtattgatgtctggtctcggggaggggctgcagcaaggggagcctctcctcctctgcccctgcgtcccacgggccctgggcgctggctgggcttggctgcctaggggtggggccctctttgggtgagaggacccttcccctcgctgccctctcgccttctcacatggtcgctcactctggaatctggacttcccctgctgcttgcagctgtcccatgtgacccctgacccactggtggccacaggaggagagagaggtgccctctctgggtccttattctccacatctgaggccaccacggacctaacaggtgagtttccaatgcccaccctctccctctctcttctcctgcctgcctccactgaaggcagccttctctgtgccagcgagctcggcctcactgcacggctctcccgaggctgtgccccagccctgggcacccatgctgtgagtgcaggcaggggggttcatgtgctcagcaaatccattcccctggtggggaggaaagtggccctgggccctgctgctggtgaggtgagccttgccatcatggagttcagggcacctcgctctgccttgggctgtttcggatgcttctgagccccagagacatctccagtacaaacacaaggtaagtggtaagtacctcaggcccttgtggaatcgggattctgcctctgtcatcaactgccagttgtacttaggcaagttatgtccctctctgagctccaagttcctcatcgtaaattggggaaacccctcttccccccacagtacctggcacagggtgcccggcttggaggatgctggaaaggtccagccccggaatttaagtcactttctgcccagcaagctgggtccacagagccccagagctcccggtcgtccgccctgacccagcgtggactcggggactggggcactcaagccctgccaagccctgctccccgtgctgtcctggatcgagcctgccagcagggtggctaggtcgggacagctgtcgtgcatggcaggcgaaggccatctccctccgggcttgggtccggtggcgctggcggagcaaggctccggggcatctctggctcgtgtggtcgtgccaagggtgccattgcggatggacggggccatgcgggccgggtcggcctcctggggagaaacgggtgggcgcaaggggatcggcgccatcgagggtggagaaaccgcagggaatttcggctgtccgctttggggcgccaaggaagatgttcgtcgcccacaatgtcaaccttgagccaccacggcaccgaccagtcgtctaggctctcccgtcggaggcggggccgccgcccagggtgtgcgactattgggtgacggctgacgcgcaccgccctcctttgcacaccgcccgcagcacctctcgacgacgcaccgcggcgctgcgaggggctcggtcccggggcgcgccggcgattggcgggggaaccggacccgggggcgcggccgcccgcggattggcgaggcacggcgggggcgggctcgcgcatgctcttaagtggcagcggcggggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctggtgaggacgggcgagggcgcgggcgagggtgccggcgcgggcgggcccgggcgggggcgtccgtcgaccccgcggctgtgacccgcgctcccttgcagatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtaacacgtctcctgagggtcccctggccgggctgggtcgggtgtcgctgtctccagcaatggggtggggagaggggtctggggctgggaggccgggaaaggaggggcgggggtgggggccggcgctggggctccctcagggctgtgttacatccgccttgctgcctgccattgccaatcctgggagtgggggagtgggatcggtggggaggaagggatgggggaggagcggggattgcttggggagttgggaaacttgagcacagcgggggttgtaaaacttgggaacctcatgttgggcgtgaaggctcttgggatttgtactttgtggtctggaagggctggactgcgggtgttcaggcttcgttgggtggacggggggagcatggggtgcggaccccggggtggggtggcctgggtacgaggggggggagtgcatggggtcagcctccacacttgcttggggaggagggggctgcactgctccgagggagctggctggcttctgccaggccctgcgtgggtctcccattaagtccttggcaaagctggctgctcataccctggcctcatagcttccaggcccctcctgctggaggtgccattgtgtggcaggcctggccccaacccctacctcctgtctgcgcaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtttctcagctgccctgtgtgtttgttttggttctggatggaaccagctcaggccccctgccctaggtgggggagggaggagctgccccagccaggggcacgtttgttccccagtgtttactgggggcactcccagcatgaatgctgtgcccatcagccaggttggggcgtctgggccgagaccttcagggcaggctccccttcctgatcctggtggccctggctgcacctgggctgacctgctttgctttgcaaacccaccattccccactgtctgcaagcagctccaggggatggtgtagaagtgcaggcttactgtgcagaaggacagcagcagagccatccctcgtggtctcctacagccccacatctggaaagactccagcggcatcgtcagaaaatttgcacagcccatgcctggcccggtgagggaggcagtgtgcccagctccatctcagagctcggtgtgagagcagcatgtcccgggggaggccctgtgctacggcgggctggggatgttcttggctctcaaagccttatcttgagttgtctgggctccaggagcaaaagacacacccctgaacagcagaggacagggcagtcagggttgctgcattggccagtgcctcatgtcatgtgaccagaactgagcccttcactagctgttcttaaattttattttccaaaaaatggcattttccaggtgccccagtcctcattcctaaggtcccacctcagttggcacctgtgcgtgtatatggatacactttccccccagggccctgcctggtatgggccagggcagcccatgaactctgggcctcaccacgaggttctgggtgaggccctcgtcccgcctcagtgctggcccgagctgccgagccagggccgcagcccccgtcttgcctctgtctgccggctgctcccggggcctgatcctctggcccccactgggcctgggctgcacatggcagctacctgctcactgtcctcctcactccctggcacacagcttcagggtggaccaatcacccaacgtcagattctgaaagaaaaagccccggtgagaagggagggggacaggtgggtgcatacccacacctgcagccgcccagacaggccctgctgctcccaccacgcgggatccaggctggcagacactcaccggcccgcaggctaggtctcccgccacttcttcccgttcagcacctgcagcttctccaggctctgggtcactaagcacagtgcttgccctgaggaatgatgaccttgagcctctcccggccaggctcaggagggctgggtggtgctgccccggggtctcagctgcaggatgtgacctgcccctcacccgttatggccccagccccgaggtcagccttggggtagagagacacaaacccgctttccctggaaaggggtccctttgcctccctcggaaacaaaaggagcgctcagtcgtctggtccccggagactcacccatctcacggacacggtcctccagggctcccgagagctcggggaggctcatggcctgcagggacgcttgccagcccttggagtctgtggtgcaggtgcagggaccgagttagctgggggtctgcgtccccacaggccctgctttattctgagcccatgcaaccaggagaacctgcttggatcagaacctccctacccgcctgacagtgtctaagcaacctcccaaggccgaggcagggaagccctgttgtgcccttcctcccacaggctgagcaaacactacgaggcccgggtcagcccgagagaaggcaaagctctgccggtggggacccgggtctgggccctggctggaggctacagaagtcactggcggtctcagcacagcacagccagccaaggcacagggcctttctcgagtacctcctacccctgggggataggcagttttcctgtcacaggtgaggaagtgggcttgggtccccagggccccctcttttccttggactctgggatcatgtgcacacagggacctgggagagtggctgccggccggagaaccaggccaagcccactgggtcaaacctggcttcagggctcccccaccttcccctctgcccagtgcggagtcaggccactgctcttaccagctggggggacggctaggcccagagtggctgcaccagggggctggtcctgcctcactcgagatgacagctcagcttgacaggctctgccagacacagaaacaaatattggtgagagcagaggcctggccgctgcagagcccccacctcagaccttctaggggagggaggggctcagccctgtccttgcagctggccctcatgggctgggccagtgccccatgaggctgcactaaagagcaggagggcgaccggtgcagattcccggacccaactcctgcctgggtctgcctgcaggaaggaagggcctgatgaaatgggggtggggtggctccagaccctgaaatccacccctcagttacaaaatcaggaggaaaggatgtgtgggggcccaggggccaggtggctgaccactggagacccagcccagggcagctcagagccactcaccgcagctggtccaggacgagggcagcatcccgggccagggcccacgtctcccgcagccgggcctggaggtcctcgcgggcgcggtcctgctccagcaggcagctctccaccacggcgcgcagctcctgctcctgacacacctggccccgcgtggcctctacctcctcgcagcgctgcaggggggtggggggcgcggggaggctgggaggtggccggtcaagccagacccttggccacggccctgtcctgtgtgtggggccctctccccactgcatccacctgacccctccacacagcacccaccttttctgtcagagatggagccaactcacgggtgtcaccctgcccccccatcccccacccagccactcaccttgtgcagctggatggcgagctcctgcatctcagcctccagccggtcggcgtaggccagctccagggcatccccgggtgggcgggcactgctgtgccagcgggcaatggcggacgtcatcttcctcttgggcccaaacagcctgcggggggaatgtgaccaggatatgcctcagcgtcccaagagcgcttacatgagtgggagtttgccccaaccccgggctgagggccagagcggcccttctggacgcacgtgatgccaatttccttcaggtcgctctcagtgagggtcagaaagatgcggaggtccacgtcctgctcctcaaacacctgcaggtacttcagacacccgatctgctccagcagtgcggcaaggtcctggcaggcacaggggacaggttgggggaggtagtggctgacgacgaagcagagacgttttcctccactcggagccccaccacttccccaggctcagaaccaagacagtgccttgtgtgtggcgcccaggctgtcccctcctactctggtggctcaggcagggcaggatgttgcaggcaggtgagtcctcacactatggtcggccacgtggggacaatgtatgttcatcaccagaaactggcctcctcctcccacacatgctcagttctgtgaagggaccatggagctgctgatctcgacaatgctttgtaggcggagagcgctgccctctaattctagagtctcagtgtcggatgttctgatttccacttgtctaagcgcagctcttctccgagttcacctgtctggagttcaccgagctccctggatgtaagatccgtgtttctgatccactgagatggtcaggctgtttctcacccatcgtttctgctctccttctggaatgccactgtatggggtggtgtcggtgtgcttgaggggatcacagatttctgttaattttttttactcattctttctgttcctcaagcgagatgatctcaggtgacctgtgttcacaagttgtctgactcttctgcctgctcaattctgctgtgagctcgtctagtgatattttcatttcatttacttttcaactccagaaatcctacttttgagagtttattgcttttaatggacaaacaaatgttactctgacattttcttcaagctattttctgaaagaaacatacttaggacactaccctgaccagactccactcaacgtatgttgaagggaccgagacgtgtgcctgctcactgagccaggggctgcagggagaagccggcaaatccaaggctctactgaacagcaaagccagtgctttaacaaataaccagccaggccgggcatggcaccaggccaggtgtggtggctcacgcctgtaatcccagcactttgggaggtcgaggcgggcggatcacgatgtcaggaatttgagaccagcctggccaacatagtgaaatcccgtctctactaaaaatacaaaaaattagatgggcatggtggcgggtgcctgtaatcccagctacttgggaggctgaggcaggagaatcgcttgaacccaggaggaggaggttgcagtgagccgagatcgcgccactgcactccagcccagatgacagtgcgagactccgtctcgaacaaacaaaccaaataaccaaccagagcttccctctgcctctcctctccgtgcctcttctgcccacacagggtaggagaactcagcagacacaggtgagacagctgagctgtgagtcacacctctgatccctaaggtaatgtgtggtcagagggaccacagaaaggaggaggatggtggcagctgtaaccatcaccaagcacacactgtgtgtagttcctgtctctgcttcaaccacatcttgtcagactcctgcaggcagctctgaggtcaagtgtgcttttcttctccccaggctcagggaggccaactccagtatggaaagcagggagacaggtcctttccgtggagaggaacagagtagaagcgctgcagcggggctgccagccatggagccggctgtgagcctgtggagcctaacaggccatggggatgccaccgccattctgttctcctagcagcgcctggcacgtcatatacacaacacatgcctcctaagtcacaaaaagtgccgtctctgagtgtaacctccagtttcacaagcggtcttacctggggtcctgagtagggggccctctgagtctgggggctggactcagcgagaaagccttccctgtcagttgcagcgcggggaggccactggctgtcaggattcttggtcttcatgtaacttttagcttgtttgcgagctgagcttttacaggcatgatccgagtcctgcagtgagaggcgtgcatctgaaagagtgcgcgggctaacttgagagccttggtgaaacccccacccgccacacaggggcttgagaggcttcgtgaaaccccccacccgccacacaggggcttccggtgcgttcgctgtcgtctgagaagccagaccctggacacagcacgtcccagtgcagcacacacgtgcagcagctgcttcttacatacatgctcatcttaaagtaactgggggatgtcaggcatcccagccagggaccggctatgggagaccaagaaagaaagaatccgtacctcgttgctctccacagaagcttcgctgctgagcccctgggctctggccaggccctcgctgctgctgctgctctggacgggccccaggttggcacagaaagcatgttcctctgagggcgggaagacagggcgtccgcctgcagccctcaccgaggtgctgcgcatgggcgtgccccgggctgagccgcctccaccagggcactccttggggcctgcagcggttgcttccttatatttcaaacttcctgcctgtcctaaaccctcccctctatacagacgggcagggcttctgtcttttttgttcactgataaatcccaagcacccggagcagtgcttggcacacggtgggcactatggaaacagctgctgcacggaggtgcagttataacagacattcctactggggcctgccctgaaagcctcaggggctcccaagcaaggagctaaacctgttgctgtggaacggctcccttaagccgcacggggatgctggaccagaagcttctcccattcctcacaagaaccagggccgtccacacctacccctttcctgtcctctgctggatggctgtgtccagcgccaggcccaggggataagtggggatgggcacacaggagctccaggacctgcctgagccacgggccggatgggtgggggtgcacgtaccccgactgctgctgctgctgctgctctccacatcccgctcattgatgggggaggtgacatcccggcagcagaggccctcttcttccagggggttctcgccactgctgttgaaggtgacatagccacggggaggagcctgctctgtgtacagaatggggcccataagcccagggaactccaaagtgaaacctcctcagaggccgaggcccaggatggaggcaggtgacttcccagtcatgacctcacctacttgcccctgcgacctggcatggctctatctgtggtgtgtgggtggaaaagatgctctgagggtcagtcagtggcccaagcaagtgcctggtggggcgagggctggcagccaggtcaagcctgggccctctccatttcttttccaaggggaaaacgtagcaaatggtcagctgtatttacagatgcctgaccagagaaaactataccatgagtgttccttttagcaggaggtagctaatgacctcacacagacacccatcgaccacgtgtctttatgtccctgtgacctttaaccacaggcgcttagcgggcctcctctggtcagtcaaccccggcgaaaaagagacctggctgagcaggaaggaaaaaggccttgaggtaaaaattaacaacaataatatgaaattacctaactctacctgcctctaaaaccaagcagaaaaaggggcatgtataccaggcaatttcactccagttttgcccctttacataaaaagactgacttgaccagtcacggtggcacatgtctgtaatctcagctacttgggaggctgagacaggaggatcgcttgagctcaggaactggagccttcagtgagctatgatcgtgccactgcactccagcctgggctacagtgaaaccctgtctcaaaaaagaacccaaaggactggttgatgggaccatggggaacttactttcctctttacgtattttcctagttatggagaagtttttctaatcagcacatgctatttatcattgccccctaaactgtttttgagacagggtcttgctgtgttatccagactggaatgcaatggcaccatcatgggtcactacagccttgacctcctgggctcaagcaatccttccacctcagcctctcatgtaactggggctacaggcatgggccaccatatctggctaattttcaaaattttttgtagagatagggtcttgctacattgcccaggctggtctcacaactcctgagcccaagcaatcttcctacctcagccttccaaagtgctgggattacaggtataagccactgcacctggcccccccaattttttttttttttttttgagacggagtcttgctctgtcaccagactggagtgcagtggcacaatctcggctcactgcaacctccgcctcccgggttcaaccgattctcctgcctcagcctcccgagtagctgggattataggcacgtactaccatgcccagctaatttttgcatttttagtaaagatgggatttcaccatgttggccaggatggtctggatctcttgatccacctgcctcggcctcccaaagtgctgggattacaggcgtgagccactgcgcccggccccaaatttcttaattactggcaaataaaatatatgcacttatagaaaatttaaatttcacaaggtatgagaaaacaaaaatcccctgaaataccacacctgagaccaccaccatgattacttctctgtggatacatacaaagaaccgcacacaagcggcttcagacatgtatgattttgttaaagcatttgttgtacagctatatagattaattaccaactcagccccaggatgacagcttccttcctgtccccaccacacctcaggctgtagcaggtggcagggaccttttggaaggaagagactctgccactcagaacgaccagcccggtgtcccagagccagtgctcacagctcagcggacgggacacgggcgggccctcatgctgtggtggggctggccagcagctcgagagaggccttcccagtggcccagtcagctcacccttcccaggatgatgggagaaggtgggtctccagttcccaacccagcacccaggcttgggaagacagaagtctgcacatctgcttgttcctggggtctagaagggaattcaattactggtggacccctggctgaaacactgtctactctcactcttccaagtcctggcctcaaagaggccttgctcccgagaaggaccagccaccaggcctgtgagaccagcagccttggcctggctatgagtgggtgacagccatcaaaggaagacataactcacacctccagctgagctctgggacagaccacagcaatagagagtaggcaccaaacccaactcccctaaaaagaaaccccagcactccccaagagcaaaacgctcaacaccctggggctgggaatctgagaatgaacgagactggaaaacccaaaggctaggattcttcaccagcaagtcaacaagcgggccctctctcaggagggtctgagtacaacttcatcgccctgagaaaacagcagggcctgttttcttggcctcctgcccccagcagcgcacccgacccagctggtatgggcagggcagggaagtgaacttcacgctttgcctcctccctgtatgagccaacccacctatgtgatgaatgaaatctgaccttagctacatttctgctgcaggagagaaagttctattcctaaatttaaccaacgaaaaggaaactccaggagataaagcaaaaaacaagagctagtccgtgaccaatgcatttccatcacaggactcaatcctgagtctccctgagcatgaaagctgggccacctgtcccgctgccacctgaggtccagcgacccacatttcaggagcctaagagctattccattcttgccaacacaaaatcctggtatgcaatgagaaagagccctcgggaaacgcgggccactcaccatagcgaggccgtggggctctgccgcccaggccaatgcctgtgatcctggccagggctcgcggtccctcgtggatgctgacacccttcttccggcaaggcctctgtctctgaggagcagggcaggactcgtcagaagagctcagatcttcgtacttttctgtgatcaaacaccaagattaagatagtgtgttcagtaatggactcatttactaatccttacggcaaactgaaagaaagtgactgtcgccggttttgttaaattaaggagaagggtatctgccagggcatcacttctgagaaatgccctaacaggccggggcgctgctccaatgggccacagggagctgcaaagttagtgaggatgggaagtttcatttttcttgagacagagtctcactctgtcccccgagctgaagtgtaatggcatgatcttggctcactcactgcaacctccgcctcctgggttctagcgattctcacgcctcacccttccaagtagctgcggttacagatgcgtgccaccatgcccagtgttttttttcttttctttttcagtagacacaggcttttgccatgttggccaggctggtctcaaactcctgatctgcctgccttggcctcccaaagtgctgggattacaggcatgagccaccatgcccagccaggagtttattatctctgttggggtttgccaaattgttcataagtctgtattgttcataatcagaaattctgttctaatttgaataagtaaaacccatctcttcattaaaatatatggtaatataagtcacaactactttttcctaatcccttcctttggaaacaacttttttttttttcttttgagaaggagttttgctcttgctgcccaggctggaacttccgcctcctgggttcaagcaattctcctatctcagcctcccgagtagttgggaattataggcagatgccaccatacccagctaatttttatattttagtagagatggggtttcatcatattaggctggtcttgaactcctgacctcaggtgatccacccacctcagcctcgcaaagtgctgggattataggcacgttaccactgtgcccggctggaaacaacttattaagcaattctgtattttcttttttttttctttatttttttgagacggagtcttgctctgtcacccaggcaggagtgcaatggtgcgatcacggctcactgcaagctccacctcctgggttcacgccactctcctgcctcaggctcccaagtagctgggactacaggcacccggccaccatgcccagctaatcttgtttttgtatttttagtagagacggggtttcaccatgttggccaggctggtctcgatctcctgaccttgtgatccgcccaccttggcctcccacaaagtgctggcatcacaggagtgagccacagcgcccagccacaattttgtattttctaaagcatggcatgtgtttgctatgattataaactgtttcaaatcacttcccagtctgagctttcagagctcaaaccagagcttttattattttgtagcttttcagtttttcatatttgatttgtataaggctctgatctgattctacttttaagagatacgtgagttgtatacaggaggaaatgatgagatctccttgtggagtgggtaagctggggcagaaatgaagggaaaggtcctttgcattaccacctgagctgtgtttattatgaaacaatcccaatgccagggaagaggctgggctgagcctgacactgagaaaggagctgctcgctcaggtgcaaactgacaggacaactcagggcaggccagcaaagagggagagctcaggccctgaacgtgggccactctgtccttccccatgacgaggctcaagctctggcgactgagctagccatatggacacacacctcctcacactcaaagatctatagcactccagggagactgtgcttccatccaagctgaaggggagggagctgtaagacaaatgcaaagaggcagcaataagcaagggaacggcagctgcgtgaatctcagcacccaacacaccctcagagcagcttaaaaagaacaggcagatggaaaccacaaaagagccagggctgcaatcctgctatcaacgtggaattcagggcaaaacacattaaatatgacacggaaggacacttttttttttttttttttgaaacagagtttcactccgtcacctaggctggagtgcagtggcacaatctcggctcattgtaacctccgcctcccgggttcaagtgattctcctgcctcagcctcccgagtagctgggattgtaagtatgtgccaccatgcctggctaatttgtgtattttgagtagagacaaggtttcaccatgtaggctggactggtctcgaactcctgacctcaggggatctgcccgccttggcctcccaaagtgctcggattacaggtatgggccatgcccagccagaaggacacttctaatactaaaagccataattcacagtgaatctataacaagttatgaaaatctgtcaccaaaaaatgcaccaacttccttcataaatcagaaacacgctaataggtaattttgtagaaaatgaactaagagtacataatcctaaataagatagactcacagatatgctaaactgtatacagataatagagaatacaacttctcaagcaaaacacggaacactaaaaaatattgatcagggccgggcgcggtggctcacgcctgtaatcccagcactttgggaggccgaggtgggcggatcacttgaggtcaggacttcaagaccaacctggccaacatggtgaaaccctgtccctactaaaaatacaaaaaaaaatgagccaggcgtggtggcagatgcctggaatcccaactactcgggaggctgaggcaggagagtcgcttgaacctgggaggcagaggttgcagtgagtcaagatcgcacttgggcactccagcctgggtgacagagtgagactacatctgaaaaaaatatatatatatatagatagatcagtagatgataaataagatgacaaggaagttatgtaaatgtaagaattataaacactctctgatcagacacattaaagttaatcagaataacatgagaaattaattgcaagatcaaaaaggcccttccatctagaaattaacaaacaaaaacaatcataatacttctattagacaactcctgggtgaaggagaaaatataaataaaaattacagaatttctaaaaataacaaggaaagtattaaatacagaacccccagaatacacttaaagcagcaatcagcaaaaattcacagcctctaacatttagcaacaaaagggcaacaatgaaaatgaaagaagtttccaactcaaaaaactagaacaacaaagtaagccaaataaaaataaaagcagaaattaaacagacaatcagtaggtctcattaataaatcaaaatccgatgggtttttcttgtttttccactaaacagacaaagtactagtatttaacttaagaaaaaaaggaagaggctgcgcacggtggctcacacctgtaattctagcagtttgggaggccgaggtgggcagatcacgaggtgaggagatcgagaccatcctggctaacacagtgaaaccctgtctctactaaaaatacaaaaaaaaaattagccaggtgtggtggtgggcaccctgtagtcccagctactcaaaaggctgaggcaggagaatcgcttgaacctgggaggcgggggttgcagtgagccgagatcgcgccactgcactccagcctgggcaacagagcgagactctgtctcaaaaaaaaaaaaagaacaaacacaaatattcaaaataagaagtgaggccgggcgcagtggctcatgcctataatctcagcactgtgggagactgaggtgggaggatcgcttgggcccaggagtttgagaccagcctgggcaacatactgagacactgtctctattttttttaatagaagaaatttttgccgggtgcagcggttcatgcctgtaatcccagcactttgggaggccgagtcgggtggaccaccttatgtcgggagttcgagaccaccctgaccaacatggagaaaccctgtctctcccaaaaatgcaaaattagccagacgtggtggcacatgcctgtaatcccagctactagggaggctgaggcaggagaatcgcttgaacccgggaggtggaggttgcagtgagccaagatcgtgccattgcactccagcctaggaaacaagagcgaaactccatctcaaaaaaaaaaaaaaattaaaaaatataagaaatgagatccagcaattccactactgggtatttatccaaaagaaaggaaatcagtataccaaagagatgtctacaccctcatgtttactgccgcagtattcacagtagcctagatagagaatcaacctgtgtccatcagtggatgaacgaagacagaaaatgagtttatatacacaattgaatattattcagacataaagaatgaaatctgatcatttgtggcaacatgaataagcctggaagagactatgttcagtaaaataagccagacatagaaaagaaagacaaatgccagctgttgtggtgactcacacttgtaatcccaacactctgggaggccaaggcgagaggatcacttgagcccaggagttcaaaaccaacctggtcagtatagcaagaccccgtctctacaaaaaaataaaacattagccaggtgtggtggtaggtgcctgtagtgccagctactcgggaggctgagataggaggatcacttgagcccaggaattggaggctgcagtgagccaagattatgccaccacactccagcctgggtgacaaagcgagaacctgtctcaaaaaccaaacaaacaacaaaaaagactacatgactacatgatgtcacccatttacaggatttttaaaagctcatgtcaaacatgtagagtagaatagtgattatcagaggttgggggtggggaggtagtgggagagattggtcaataggtgtaaaattacagatcgaagaaagaagttctggtgttcacagtagagtgactatacggaacaacagcttatacctcaaaatagctactagaagacatgattttaaatgttctcacctcgaaatgataaatgtttgaggtgatggataagctaatcaccttaatttgatcattacacagtgtatacatgtatcaaaacatcacacactgtaccccataaatatgtagttattttgtgtcaattaaaaatgagataaatattttccaggtcaggtgcagtagctcatgcctgtagtcccagcactttgggaggctgaggcgggtggattgcttgagctcaggactcttgagaccagcctggtcaacatggcaaaaccacctctctacaaaaaatacaaacgtaagctgggcgtggtagggtgcacctacagtcctagctactcgtagagctgaggtagaaggatcgttttgagcctgggaggcggaggttgcattgagtcgagattgggtcactggactccagcctgggtgacaaagcaagaccctgtcacaaaaaataaatcaatattttccatgccaaaaaaagataataacaggagaaaataaccactgaaacagagtattttattttgttttattttatctatttacttttctttgagatggagtctcgctctgtcgccaagctggagtgcagtggcgtgattttggcttactgcaatctccccctcccgggttcaagtgattctcctgcctcagcctccagagtagctggcgcacaccaccacattggcttatttttgtatttttagtggagacggggtttcaccatgttggccaggctggtcttgaactcctgacctcaagtgatccacacgcctcagcctcccaaagtgctgagattacaggcatgagccactgcacccagcctgaaacagaattttttttttttttttttttttgagacagagtttcgctcttgttgcctaggctggactgcaatggcacgatctcggctcacctcaacctctgcctcccgggttcaagggattctcccacctcagcctcccgagtagctgggattacaggcatgcaccactacgcccagctaattttatatttttagtagagatggggtttctccatactgatcaggctggtctcgaactcccgacctcaggtgatccgcccaactcggccttccaaagtgctgagattataggcataagccaccgcgcctggccctgaaacagaatattttaaaaggagaaaaaaattggccgggtgcggtggctcacacctataatcccagtactttgggaggcccaggtgggcagaccacctgaggtcgggagtttgagaccagcccggccaacatggagaaaccctgtctctactaaaaacataaaattatccaggcatggtagcgcatgcctgtaatcccatctacttgggacgctgaggcaggagaatcacttgaacccgggaggcagaggttgcggtgagtcaagatcgagccactgcactccagcctggggaacaagagtgaaactctgtctcaaaaaaaaaaaaaaaaaaagggagaaaatattatcttgtagacctctgcagataagtctgaaatcctagatgaagtgatctctcaggaaaatataatttaccaaaactgaccccataagaaaagaaagtatgaggaggccaatctctatagaagaaatagaaaaactgttatcgaggaaccacctcacagaaagagaccagatggtttcatgggaggattctatcaaaacttctaagaccaggtagcactaatgctacgtgtattgtcctagaacacaaaaaaggaaggaaaacttccaaattatttttatgaagtaaacactgatacccatacctgatagacagaacaaaaatagaaaagtatagaccacgccgggagcggtggctcacgcctgtaatcccagcactttgggaggctgaggcaggcggatcactggagatcaggagttcgagaccagcctggccaacatggtgaaaccccgtctctactaaaaatacaaaaattagctgggtgtagtggtgcacgcctgtgatcccagctactcgggaggctgaggcagaagaattgcttgaactcaggaggcggaggttgcggaggttgcagtgagctgagatctcgccactccagtccagcctgggcaacagagcaagactccatttcaaaaacaaaaaaaaagaagaaagaaaactatagaccagtatcacttatgactgaatatccatagaaaaatactaaatattaataaacagaattcaaaaacacattaaaatagtacaacatgtgggatttatgccaagaatgtaaggttgattcattattaggaggttcatgaagacaatctaccatatgaaaattcaccatcgtctccaaagatatgggaacacaattcaatagttactcctgtaaaacaccactcaggaatagaagaactgaggaatactttgttaataagctaaaataacatatgccttcccttttacagtcagcctctcatgtaacgtggcatttccactaagatcaggaccaaggtaaggaggctcactatctccactatgttgaacaatgagctagaggtgttagcaactaaacaaaagaacggtgcaattcaacaaagtcagagtcatgagaatcagcaggaagcagtgtatccatcgatacttaaagattatatgttagtacacctgtaaagccctaaagaatcaataacaaaactaacctgaacaatgtaagaattctgtaaggtagcagaatataaaattagtttgcagggctgagtgcagtggctcacacctgtaatcccagcactttgggaggctgagatgggtggatcacctgaggttgcgagttctagaccagcctgaccaacatggagaaaccccatctctactgaaaatacaaaaaattagccgggcatggtggtgcacgcctgtaatcccagctacctgggaggctgaggcaaaattgcttgaacctgggaggaagaggttgcggtgaggcaagatcgcttcattgcactccagcctgagcaacaagagcgaaactcccgtatcaaaaaaaaaacaaaagtttgcagaaatccactgccttcaaatgcactgacaatatgcagtgaaacgatataatgacaccactaaaggacttattcacgtatccaaccaccacctgttctccaaaaacctactgaaataaaaaataaatagcactgaataattaataccctgagagttggggggaaaaaaaggatataatgatagggaaaaccccatttacaatagcgacaaagatgatcaaacacttaggaataaacttaagtcacatgcaaaatgtagatgaagaaaaatttaaaaccctcctgcaagacccaaaagtacattggaacaagaagtcatcccttgttcttggataagacaacaacacaaagatatagttaatttatacattgtcacaatctcagtaaaaatatcaatactgtttttaaggagctagacaagttgatattcaagttcatatagaagaatgaacaagccatagctcaggaaacagtgaaaacagaaaactaagaggggcctgcccctactcggtagtcaagcatactacagaaagcctctacattcacaacagcctggttttgtaccactctccatcgtaaccatccttatctcctgttagagcaggggcctcaaccttgacatgtaagcagctgggggaggcagagccaaatctcagagaaggtgggagccggggaagcgggggacatctttctctgccaggtcacctaaagctcaaggcaaccagagaccccagcagggcgcggctggcaggtgtgggtacctgggctccgatagaggctcttgggcagagagggcgagtaagtgtccatcaaggccacgatcttcatgtgtccgtactgcttggccagcatccgggctgtggctccactgtggtctctcgcgtccaccttgactccctgtgaatgtccgtgaaagggggttaggggcctctccttcaaagcacctgcccttcctgggctgctggctgggaagacagaagggcatatgctggtttctgactgcctccctgtgtgggaaacatcacatctgcatgagaaagaggcaggcttgtctgcaccgcagccacaagttttgctctcactctcttcttagggacaaggatgaggagggctgggggctggggagtcatctcccacgctcatgacctcccttgcagggggctggcagccaccatgcggagatcccagccttcaccttctgcgcctgggctgtgtcccactcacttcgcttgtcttcaaagaaagcagccttttaaaccagtcagaatgaaagcaccatcctctgaagcagaattcgtaactttgatccaaagctctataatgtatttacaggtcttgcagcgcaacaattccacttccatgaccctaaggaaataaccctaaatacagaaaaggctttagtgcacaaagatgtttggcacaggccgggtgcggtggctcatgcctgtaatcccagcactttgggaggccgaggtgggcagatcacgaggtcaggagattgagaccatcctggccaacatggtgaaaccccgtctctactaaaaatacaaaaattagccgggcgtggtggtgaacgcctatagtctcagctactcgggaggctgaggcaggagaattgcttgaacccgggaagcggaggctgcagtgagctgagatcatgccactgcactccagcctgaagacagagtgagactctgtctcaaaaaaaaaaaaaaaaaaaaaaaaaggatgtttggcacagcatattcacaataatgaaaacctacctagagaaaacttgaatgctcagggggataagcagtcagttctgttattgccatagatggtgatatttacaaacagctgtatgatcaagttgaaaaaggatcatggccaagtgaggtggctcatgcctgtaatcccagcatttgacaggccaaggcaggtggatcgctcggctcaggagttggacaacaacctgggcaacacagcatgaacccacctctacaagaaaaaaaaataaactataatcaatacagcatgtttttggtgtcactgtacactgtaactgtccttctctcctgtcagaccaggcagctgggggaggcagggaagccagagccaaagctcagaggaggaggcgggaccccggaaagggggagcatctttaataaaaaattagcagggtgtggcggcacatgcctgtagtcccagctactcaggaggctgaggcaggaggatcacttaagtcccagagcttgacgctgcagcgagctgagatcgcaccactgtactccagcctgggcaatagagcgagaccttgtctcaaaaaaataaaaaaggatcatgatacaaaactacatatacattacaactccggcaaaatgagaccaaaaaaattacacagaaaacaatattggaaggtaacatacccaaaatgttgctatttttaagttatttactatttttgatggggatttttccaattttccaatcttctatgtttttaaaatgtactaccataagcatgtttgcttttttttttttaataggatcttgctctgttacccaggctgaagtgcagcggcgcctaaggaaataatgcaggacatacactacaatttagaattttcactgtggcattcagcatagtgagaatcagaaggaacttaaaataagagattaatgagctacgtgagagcatatccagaaaacagagcgcctcccgcccatttacgtggtgggtgggagtacctgcggtgacacggactagggtgcacaaaacatcattaagagaaaaaaggcacagccaggcgccgtggctcatgcctgtaatcccagcactttgggaggccgaggtggacggagcacaaggtcaggagttccataccagcctggccaacagggtgaatcctcatctctactacaaatacaaaaagaaattagccgggcgtggtggtgggcacctgcagtcccagctactccggggggctgaggcaggagaatcgcttgaacccaggaggtggaggttgcagtgagccaagatcgcaccactggactccagcctgggcgacacacggagactccaactcaaaaaaaaaaaaaaaaaaaaaaatcacaacccttaaggagttttgctaccacccatacggcaactgtctctcccgttagaccagggggcctcaaccttgacccccatatgtagttggtgggggaggcagaggtggtctctgggcagggatacaggacaaaaaactgtgttttcacaaagtataaggagttttactttctagagtgccccccatcctacttttgactctgattaaaaattacctatgagactttgtgccttaaaaaataatttataggccgggcacagtggctcacgcctgtaatcccagcactttgggggaccaaggtgggtggatcataggtcatgagttcgagaccagcctgggcaatgtggtgaaaccccgtctctactaaaaaatacaaaaattagccaggtgtggtggtgcgtgcctgtatcccagctactcaggaggctgagggaggagaaatccttgaatccaggaggcggaggttgcagtgagctgagatcgcgccactgcactacagcctcgacgacagactgagattccatctcaaaaaaataataataaataataacaataatttataagctgggcacggtggctcaagcctgtaatcccagcactttggtaggccgagacgggtggatcacctgaggtcaggagttcaagaccagcctggccaatgtgggaaaacgtggtaaaaccccatctctactaaaaatacaaaaattagccgggcgtggtggcacacgtctgtactcccagctactcaggaagctgaggaaggagaattgcctgagtccaggaggtggaagttgcaatgagccaagatcacgccactgcacaccagcctgggcaacagacgaagcaagactctatctcaaaaataaaaaataatttcttggctgggcacagaggctcacacctgtaatcccagcacttttggaggctgaggtgggcggatcacttgaggtcaggagtttgagaccagcctggccaacaaccagcctggtcaggagtttgagaccagcctgtatctactaaaaacacaaaagttagctgggagtggtggcacacacctgtaatcccagctactcgggaggctgaggcaggagaatcgcttcaacacgggaggcagagattgcagtaagctgctgcactccagcctgggcgacagagggcgactccatctcaagaaaaaaaaaaaattctagtttaagtttgatagaaggaaccctaaggtttaaccagaataaaacagtagcctctttactgtaggattttaactcgttatatatttttggttttgtttttgaggcagaatctcactctgtggcccacgctggattacactggctcattgcaaccctgacctccccagctcaagtgatcctcccttctcagcctccctgggattacaaacacacaccacaactggctttttttttttgagacggagtctcactctgtcacccaggctggagtgcaatggcgcaatctcggctcactgcaacctctgccttccgggttcaagtgattctcccgcctcagcctcccaagtagctgggactacaggggcacgccaccacgccccgctaatggggtttcaccatgttggccaggctggtcttgaactcctgacctcaggtgatccacctgccttggcatcccaaagtgctgggattacaggcatgagccaccatgcctggccaattttttttttttttttttttttaatttagagacaaggtctcactgtattgcccagactggtctccaactccagcctcaagcgatcttcccactttggcctctaaaagtgctgggattactggcatgagccactatgcctgatgtgaaaataaatttttaactacttaggctttaagagacttttttttcctattttataatgtccatattactaaagagacacatgatcaaaactcattttaacatgaaggtgggatcagaaagtttagaaaccctggaacaagactatccggaaggcacgaatcaactttctcttaaagagagaggcccagacagatccatatcctcttctcctgactgagctgctggggcttggccccactggcagaagggaaatgggggacaaggaaagcagccacagccctttcctcccctagcaaagagcacaagatgcccagacttgccccattctctacctccagaaatggagcccagctctggagggacaggctgggaaaccgggtgggccccctcctctggctccaggtggtctaactactgggcggcaggaaaaacgtgggagagaggagcttccaggcagggcttgcccaccagcatcgctggcaggcaaaccacccaggccatcgggccacctgctgccagtcctgccccatcccccaaagcagtcactaaccaacactttgattcttgtcaagtgctggaggaagaactcagtgttgagttcctgagtctgataattttgtgtgactgggaaagagaacatttttgcttttaggaaatacataatgaaattcttactctcaggaaatacatatttaggggaaaaggggcattatgtcacaatttacatttaaatgattcagaaaacatatgcatgttatacataaagagactgataagaaaatgaggtgaaatgttaacatttggggaatgtggtaaaggcatgcaaattgttggccaagcaccgtggttcctgcctgtaatcccagcgctttgggaggccaaggtgggaggaccacttgcagccaggagtttgagaccagcctaagcaacttagtgagaccccaactctacaaaaaaatcaaatcagctagtgtgatagcatgcgcttgtggtctcagctactcaggaggctgagttgcaaggatcccttgaacctgggaggttgaggctgcaacaaactatgatcgcgccactgtgctccagcatgggcaaacagagtgagactctgtctcaaaaagaaacaaacatacaatcaaaaattataagagtacatatctcttatgatctccagttctaccttacttaaaatgactctaaacttacaagtagaggctctttatggttctgggctattgattctatgatgtgtcttaaggaagtctagttcatgtcagcaggattatctgtcaaagaattatctggccgggcatggtggctcaggtctgtaactccagcactttgggaggccaaggtgggaagattgcttgaggccaggagttcaagaccagcctgggcaacatagtgagatttttgtctctacaaaaaaaaaacagccaggcgtggtagtgcgtgcctgtagtcccagctactgaggaggctgaggcagaaggattacttcagcccaggaggttgagactacaatgacccatgatcaggccactgcactctagtgtggtgacaaagcaagaccctatataaaaaaaataaataaaaaatacaaaaataattatttgcagaaaaagaaacccaaatggccagggagccaaaaagtctaacatcctggccaggcacagtggctcacgcctgtaatcccagcactttgggaggctgaggcagacagatcatgaggtcaggagttcgagaccagcctggccaacatggtgaaaccctgtctccactaaaaatacaaaaattagctggatatggtggcacacacctggaatcccagctactcgggaggctgagccaggcgaattgcttgagcctgggagtcagaagttgcactgagctgagatcacaccactgtactccagccttggggacagagcaagaccccaccccaaaaaaaaaaaaaaaaaaaaggccaggcacggtggctcacgcctgtaatcccagcactttggaagaccaaggcgggcgggtcacaaggtcaagagattgagaccatcctggccaacatggtgaaaccctgtctctactaaaaatacaaaaattagctgggcatggtggcgagtgcctacagtcccagctactcgggaggctgaggcaggaaaatcgcttgaacctgggaggcagaggttgcagtgagccgagatcgcgccactgcactccagcctgggtgacagagagagactccatctcaaaaaaaaaaaagaagtctaacaccctaaggggaggggtgtgaaccaggaccactatggaacaaagcaagtttacactacccactaccgactgaacccacctcacacaacaaagactctactttgaagaacacatcctaagctcctgaagaaattcccatatgtgcttaaaaagacgtgtaagaaatgtcaacggtaggccaggcgcagtggctcatgcctgtaatctcagcactttgggaggccaaagtggtagatcacttgaggtcaggagttcaagaccatcctgaccaacatgccgaaaccctgtctactaaaaatacaaaattagctgggcgtggtggcacacgcctgtaatcccagctactcaggaggctgaggcaggagaatcgcttgaacctgggaggcagaggttgcaatgagccgagattgcgccactgcactccagccagggctacagagcgagactccatctcaaaacaaacaaacaaacaaacaaaaaaactctgattcatccctacagggaataccatgccaccataaaaaaaaaaaaaaaaaagagaggccaggcacggtggctcacgcctgtaatcccagcactttgggaggccaaggtgggcggatcacgaggtcaggagatcgagaccatcctggctaacgcggtgaaaccccgtctctactaaaaatatgaaaaattagctgggcatggtggcgggcgcctgtggtcccagctactcgggaggctgaggcaggagaatggtgtgaacccggaagtctgaggttgcagtgagccgagatcgtgccactgcactctagcctgggcaacagagcaagacgccatctcaaaaaaaaaaaaaaaagagaggggctgggtgcgttggctcgtgcctgtaatcccagcactttgggagaccgaggcaggcgaactgcctgagctcaggagttcaagaccagcctgggcaacgtggcaaaaccccatctctacaaaaaaaatacaaaaattggctgggcgtggtggcacgcacctgtaatcccagctacttgggaggctgaggcaggaggatcacttgagaccaggaggtcaaggctgcagtgagctgagactgcaccactccactccagcctgagggacagagcaagaccccatctctttattgatttattgatttatttatttatttatttatttatttatttagagatagtctcactctgtcacccaggctggagtgcagtggcaacatcttggctcatcgcaacctctgcctcccaggttcaagtgattctcctgtctcagcctcccaagtagctgggattacagcgtcagccacctgtattttgtatttttgtatttttggtagaggcgggtttcaccaccttggccaagctggtctcaaactcctgacctcaagtgatctgtctgccttggcctctcaaagtgctgggattacaggagcgagacaatgcacctggccccgtctctttatacaccaatatagaaaaatcttcatgattaagttttttaaaaaatgcaagatgggagcagctgcacatggggcaggaccatgagcatgtgtgggtgtattcccagagtcgcccgtggggagggtgccaaggagacgcaggcagggtgggggacaggcctgcggtgcacccaccttctggtctgcatgtgtaccatgtgcatgttgtgtcccaaaattctttgttaaaaagagataccatgtgaatttttcactatttaagaaattcccaccaataagtgagaaaaaaacaaactatccaatagaaaattgggcaataaacatagacagctcgtaagagaaatacaaatggccagccgggcacagtggctcacacctgtaatcccagcactttgggaggccagggcgggcagatcatgaggtcaggagatcgagaccatcctggctaacacggtgaaaccttgtctctactaaaaatacaaaaaattagccgggattttttgtatttttagtcccagctactcgggaggctgaggcaggacaatctcttaaacctgggaggtggaggttgcagtgagctgagatcatgccactgtactccagcctgggcgactgagtgagactcagtctcaaaaaaaaaaaaaaaaaagaaatacaaatggctaagaaatcaatttaaaaatgttcaactggctgggcgcagtggcttatgcctgtaatcctagcactttgggaggctaaggtgggtggattgcctgagttcaggagttcaagagcagcctgggcaacatggtgaaacctcatctctactaaaatacaaaaaattagccaggtgtgcgggcgggtgcctgcagtcccagctactcgggaggctgaggcagaagaactgcttgaacttgggaggtagaggttgcagtgagccgagatcacgccactgcactccagccttccagcctgggcgacacagcacaagacttctgtctccaaaaaaaaaaaaaaagaaaaaaatttcaactactctaacaaggacaaactaaaatgagacgctacaattcacccgccagattgacaaaaggttgactgacatcaggactggtgaggacaagagaaaatggacacctttgtctatgactggtgggcaggacaacagacaaccttggtagtgggaattcatcaggaccgcctgcacttccccccattgggtttaacagccttataaagatataatccacataccaacaagtcacccacttacaatgtacaattcaacggcttctcgtatattcacagttgttcaaccatcaccacaaacaattttagcacatttttatcaccccaatcttcccattccccaagacccaggaaaccactcatctattttctgtctatgtatttgcttattctggacatttcctatgagtgaaatcacctagtgtgtggcctgttgtgtctggcttctttcactgagccgaatgttttccttttctttttctttttgaggcaggatccactctgtgacccagaatggagtgtggcggcgcaatcatagctcactgcaacctccaactccagggctgaagcgaccctctggcctcagcctcccaaagtgttgggattaccggcgtgcgccaccgcacccagcccagcctaacgcatcagggttcacccctgccgcagcatgcagcagtactgcattactttgtagggccgaataatatcctgctatacagatatatattttgtttatcaattcctcagtagatggacttgtgggtttttctactttttggcaattatgaataatactgctatgaatatttatgtacaaggttctgtgtggacaggcttgcacctgtgatcccagcactttgggaggctgaggtgatcgcttgagctcaggaattcaagactagcctgcacaacatactgagacccccaactctaccaaaaaaaaaaaattaaataattagccggggcatggtagcatgcacctgtagtcccagctacttgggggctgaggcaggaggatcgcttgagcccaggaggctgaagctgcagtgagccacgatctcgccactgaactccagcctgggatacagggcaacaccatgtctcaaaaaaataaattaataaaataaaacagaaatacaacatacagaaataactgcaaatgtattaaagctatgtgtaaaaggatattcccggaacactgtttataattgcaaaatgttaaaaactaagtttctactaataagaaactcattaaattaactgaggcagattgtacacggaatactgtacaaagataagatgtctataagatgtctctaagttacagactatacgtagaatcccactttgttcaaaacacaaagcaatgtgcacacacttgcctacagacacatctttccacagcagaggaaaagtcctagggcagctctttctcaaaccaagtgggcatcagggaggttgaaaaagagaggaggatctctgccttcttattctatataatttttctaagtgacaggattatgagtgctatttacttttaaaatatttttccataattttcagatagtattttcaaaattattacaggaataggtgtctatttctactcaccactgtatccttaatgcctaagcaccactcaacaccgggcgtcaatagataatgaaaatgtgttgaataaatgaatgaaagttatttctgtgcaaaggaaaattctgtaatagcttatacttcagtaatatgattcctcatttgccgtgactacattacatgctaataatcagggtcacttacgtgattcagaaaatactgcacgattatctcatggccagcagcagctgcttccatcaagggagtaaatccacatatcggctccctgcaagatgtgggccacagtcagatgattggaagagacaagttccgccaggcaaaaactccctgctgaagataaaccctgagcagtgcacgagtcaccgatccctaagcgtagaacactgtccctttccagaattaacaggtgacatgagaacagtgaatataacacatcagctccatttactcttctggtgtctgtccccagggctggtctttgtcctaaagacagatgtctgcctgtcgtcccacctgttggctattcccactggctacctctgaaatctccacctcaatcatattcaaaaagctgttctaattcctcacagaaagccagcatctcccatccattcatccaaatcctggcttcaagttcaacgtcctccatgaacccactctgaaaagttcaagtactaatgatctaagctatctttgccacgcttagctcctgaagcttgcttttcatgcttggttatgctaactcggcactgtcttcagagggcttccaaatccctccttgtctcatgctggtttggaagtcaggaaccatgcatgggaaatgctggttttcatccatcttaagacacacagtgttcatattttaacatctctcaagtcagaaaacatctttaaatcaacaggcgagttgaatgttaattagtagcatattttttctttcttagtggcatacaaaattatcaggtgtcttagaatgaatgacagccagggtgggtgctgcattggtacccgctgcgtttgttcaaaggtgattattatcatgacaagctttagacaacaatcccacttccaacttataaaactcatgactggttttttgtttgtttttgagacagagttttgctcttgttgctcaggctggagtgcagtggcacgatctctcagttcactgcaacctctgccttctggtttcaagtgattctcccgcctcagactcccgagtagctgggattacaggcacctgccaccacgcccagctaatttttgtatttttagtagagacggggtttcaccatgttggccagactggtctcgaactcctgacctcatgatctgcccgccttggcctcccagagtgctaggattacaggtgtgagccactgagcccggccaaaactcatgactgttgtttttgtttttttttttttgagatggagtcttgctctgtcacccaggctggagtgcagtggtgcaatctcggctcactgcaagctccacctcccgggttcacaccattctcttgcctcagcctcccgagtagctgggactacaggcgcccgtcaccatgcccagctaattttttcgtatttttagtagagatggggtttcaccatgttagccaggatggtctcgatctcctgacctcgtgatctgcctacctcggcctcccaaagagctgggatcacaggcgtgagccaccacgcccggcctcatgactgtttcaaagcatcacctcacctcatccatacaaaaagcaagaaaatggaaggaatttgcatgtaatgtatgacatttaaatgccattcagtatgttaggcccctggcatacaataaaacatgtaattcttacaactgtatgacccaggtgggtttcagataaagaaaaggaagctgagagggcttgaagagatgcatctcacagatgtacgaaaaggcctgtgcctggaaggactctggtcctacccctcatcttgagcctctcgtgccgaagcagggtggccctaaactctggttagctgcctccagagccaccctccttagagtcagatgacacctaggccactcctgtggccactaaagatgtggcaatcacctcacgttggcattggctccactgtccaagaggaacctgaccatgtgctggtgcccggcgctggtacagtggaagagggctgtccagccctggatgtctttcatttctagctctgcaccttgcttcaagagaacacagaacgtgcgttacggcctcatctcctctgcgtggggcgggcgccctccaggcggccatgctgcaagaatcagaagtgattacacgagcacacacgaacaccgtggcctgcagtggttcgcatctctgtcagggtggccacggagcccctcaggtttctgggcctgagttccctcgtagctcacctggagaagaaagtaggcgatgctctcgttgccacagctggaggccagcatcagtggagtctgcccttctggggtcggcacattcacactcacccccgcctcaagcagcaggtgcacgattgtgtcgtggccaatgtaggaggcatacatcagcggggtccagccaccaccattcttcttattcaaatctaactctctcctaaacaaacgcaagatatgctagacatggccagccgcctcgcatgtggggttcaccaaagctggtggcgaggctaggccaggcgggatgagttgacaggaagcagaagttatctgccaccctggacgttgtggggattggaggcaggcaggcagaaaaatgctgacagttgctcgtacactgccttgtgaggccctgagccttcgtctccttgctctgatttcgcatcctcctagcccaaggccagctatgctctttcacaccaccagataggcagatggcactcaaccagggaatatgtggcaatgtgtgaaggcatttttggttctcacaactgggcagggaagggctgctggaggccaaggctgccgctaaacatcccacagtgtccaggacagcccccacagcaaagaatgatccagcctggattgtcaacacagccacagttgaaaaaccctgaccaccacaggcctggcatctactagcccactgctgggtggagaggagcagtgaggaaagaagggactccaccgtggacaagtcccaccgccactgattcatcctttgtcacctcaccttaaagaaacattcttgaaaaatctgtgaccaaagaatcccatctttctcactgattgctgttaaaattctggcaatgcattttcccatgggaaaaaactgtgggcttcctagctgcgactctggggttgggacaagggagtcacatttaaaataatacccacttgcatggttacctgggatcctacatggttaacgcccacaggccttctttcccttccccagttcttgcctgcagaggggataacaactggtgactgaaccccaggatctgtcccttttacgggattcacttttttgttgtttttttgagacagagtctcgctctgtcgcccaggctggagtgcagtggcgcgatctcggctcactgcaagctccgcctcccaagttcacgccattctcctgcctcagcctcccaagtagctgggactacaggcgcccgccactacgcccagctagttttttgtatttttagtagagatggggtttcaccgtgttagccaggatggtctcgatctcctgacctcgtgatccacccgccttagcctcccaaagtgctggattacaggcgtgagccaccgcgcccagccgggattcacatattagaccacagcaggcaactaccttccattgcctggcagccctcagtgactctgggatgcacacctgggcagccattccagaaggtcctgataccagggttcagtggcagcccctggccaggggggctgcatggagatgcctctgcagcagggctcgaatgcacccagctcgtcctaacactatcttcctttacacaacagcagagcatctccctggggctctcttaccactcctcgttcagccccaccccttccttctgatgcccccagctcccctcaggccccatcctgtgcttactatcagcaagcctccacctcagctagtgtcaaaatcccatcacaacacaaacgcctccccctgctcctctatggagcggttatggactctgcatcttaacaggacacccaaagacttaagagcctgagaattccaaacgtgaccctttgaggggccgtactgactgcatacccagctgcctatgcctagagcctcctgtggagggagcgcaacagaccaccctgtaccaaggtgcaccagcactccatgggctgggtatgtctaagtgagggccacaacttgggaaccggagacctggggcttcagcaatgctttgctttggctcactgggaactggaagaggcacgcagagagaggaagagaggtcgctgcaccacaatatcaaatgagaaccaggagacagagttaggctgtgtgtggaacataagggggtggaagtgaggagacgacccttttccaaaaacaagatgatcacatcctactatgggcaagacgcagccatggaccctgccaggggctttatattgtctctaactattgtacacagattagcaaagggcaggtgggcagtgacgtcgggaggtcattccccagaggcactgaaagcccagcctctctcctcctccatggcagaagctagaggggaacagggatcacagggatcgaatgaaccctccgggaaaagaaggccagggatcactttcttttttcttttttttgtttttgagacagagtctcactctgttgcccaggctagagtgcagtggcgcaatctcagctcactgtaacctccacctcccgggttcaagcgattctcctgcctcagcctcctgagtagctgggattacaggtacatgccaccacacccagctaacttttatatttttagtagagatggggtttcatcatgttatccagaatggtctcaaactcctgacctcaagtgacccgcccatctcagcctcccaaagtgctggaattacaagtgtgagccaccgcaccaggccatcactttctgtctttatttttattttgcttgtttgtttgggcatttctgcaattagtgaataaaattagtctggttaaagaatgactgtttataagcttctgatcaaagtttactccctctttttcttcctaggaataaaaacggcctctttgtcagggctcagcatcaatacttactgacagctgcctgagataagcaggttaacctattctacacgcattaaacatccacaactgtgtgcaaagccccatcacgtgggatcgaagccatcactgcgctgctcaaaatgtgagaggaagttccccgagatctcttaccgctgcacacactccttcaccacttcatactggccaatggaagcagctgtgtgaagatccagggggacatccagctcctccccgctgacctgtgtcccgagcccgtgccacatggacaagctgcggttcaggagttccggctcgctggcttcatcgctgagctcggacatcactgaggaggaaggcccaagggttagatctttcctggctggttgttccagggcatgaaacaggctggtcctgcccctgctacaccactgcactagcagactgataacccagtgcagtcaaccccgggagtaactcagacaaatttatttgctgaaataatgtatgctttgggcagtcccaaccatgctaaatctggtgagcctgctatcacaccagtaaagaggagcacatatggtgaggcattaactgtggagtacctgctcctccttccaaccgcaggcaccaggtaaaagagaattctccaccaactctaggaacctgacaacctcttggatgggcagtgaagaaatgctaattgggttgtttaacccaatcagttccttgatgtggtggggaagaaccctggatttggggtttgatcaaaattcagcttggacccggtgcggtggctcacacctgtaatcccagcactttgggaggccaaggtgggcagatcacttgaggtcaagagttcaagaccagcctggccaacatggtgaaatcctgtctctactaaaaatacaaaaattagctgggcatgaaggccagctactcgggaggctgaggtaggagcatcacttgaactgaggaggcggaggttgcggtgagccaagatcacgccattgcactccagcctgggaaacagagcaagactttgtctccaaaaacaaaacaaaaaaaaaaaacaacaaaaaagcagctctgctacttagcaactccaatccctagtgcctcactgtctaacggggacatatctaaaaaggctgctattatgatacataaaagaatggataaacaaacggtggcacatccatataatggatgctactcagcattaaacacaaggatccaacagttgacatgcaacacgtgaatgaatttcaaatgatttacgctaaatggaagaagcctgcctacagtataatttcacttacatgacattctggaaaaggcaaaattaaagggttggaggttggggcagagagggaatttgggggacgatagacctgtatgactgtgacggtggatctgtgactccatgcctttatgaaaccacagaactgaacaccaaaatgaattttactgtatgtaaattttatttatttttttgagacagtctcgctctgttgcccaggctggagtgcagtggcatgatttcagctcactggaacctctgcctcctgggtttaagggcttcttgagcctcagccacctgaatagctgagattacaggtgtgcgccatcatgttaggctaatttttgtatttttagtagagacgggggtttcaccatgttggccaggctggtctcgaactcctcacctcaggtgatccgcccgcctcagcctctcaaagtcctggaaatataggcgtgagccactgcacctggcctgtaaattttaaatataaattaatttttctggaatggttatgaaattgaaaatttcaaaaaagtaaaaataaatttttctgaaaaaaatagaaagcaattccccaacagacaaaccaggatgtgactggtggcacgcagcaaccgtcaactgaataggaatccacttaggcatcctttgaagagagagctatggggggaaatataacaggccggtgaactggtgaggtaacactttccccgagatgggcctacatgggtaacggcacaccaggaatccccaaatcaaggcaaggtcatcagcttcctagtagaatccttaggtacaagagtgccaggaaacaagggtaggaaagggagcaaaggcgaaaacaaaggccttgtcaggttgtgatgacctacaggtgctatggtagttaatagatgcgatgaggacctcagtttctattaaagaatgcttccaagccccaggtgacagccaagatggctaaagaaacaagccaccaatgtgggagacgaacacttcacagacccttggtgaagagtgtgtgtaggtgcggtggggcaagcaaagccctccttcctggagccaccacctcttcagctagcagagcccaagatcgtgcagtgcccttccctcactttgcaggtgagaatcccaccctaacagccctggccaacgaagcctggataagaaaccaaacgagctgagggtcagttcagagtcccttccatacctccctcaagccttcactgggcatgtctcttccacgccaaaggcctcctgcagggtgaggccgtgttctctatttactggagacttgcatatctgacatccccagaggtctgaaggacaatgagaaccagaccaagcgtgacggaccacttgaggccaggagttcgagaccaccctggccaaaatggtgaactcccatctttactaaaattacaaaaattagctgggtgtggtggtgggcgcctgtagtctcagtactcaggaggctgaggcaagagaatcgcttgagcctgggaggcgattgcagtgagccgagctcaagccactgcactccagcctgggcaacagagcgaaattctgtctcaaaaaaaaaaacaaaaaaaaaacactaaagtgaaaactaaaatgtcccatcccgagtggtgtggtgtaaagtagcattagagataagacgttttagttttcattcaactttttggttctgtccattctgaaaatgctaagtatctgttacctttacagtgaatcctaaagaaaatgtggtacttagacacaatggagtactattcagccataaaaaaagaatgagatcctatcatttgcaaaaacatggatggaagcggagatcgttatgtttagtgaaataagccaggcacagaaagataaatattgcatgttctcaattatttgtggttatctaaaaatcaaaacaactgaactcatggacatagaaagtagaaggatggttacttctagtgtaaccaaggctgggaagggtagtggagggtggggatgcttaatggatacaaaaaaaacagaatgaataagatctagtatttgatcaagccactgcactccagcctgggcgacaaagcgagactccgtctcaaaaaaaaaaaaaaaaaaaaaaagatctagtatttgaccgcacaacagggtgactatagtcaatataatctaattgcacattttatttatttattattattttttttgagacataatctcactctgttacccaggctagagtgcagcggcgtgatctcggctcaatgcaacctccgcctcctgggttcaagcgattctcctgcctcagcttcccgagtagctgagattacaggtatgagccaccatgccagcctagttttcgtatgtttagtagagacgaagtgtccccatgttggccaggctggtctcaaatccttgacttcaggtgatccgcccgcctttgcctcccaaagtgctaggattacaggcgtgagtgagccaccgcgcccggctgcacatttaaaaataattcaaagagtataatcatattgtttgtaacacaaaggataaatgcttgaagggatggagacccccattttacatgtgattattacgaactgcatgcctgtatcaaaatctctcatatacgccataaatatatacacctactacgtacccacaaaaattaaaaaatttttaaaaatcttaacaaatgtgatgctggtggtaactgtcacgcccacagaggaggtctgtgaaagcacccaggcaccccctctcgccccgtggaaccgcatcgcaaaggtagctcactggccccggggcgggtccctggccgacaaacccgtaactcacagcagtgacgcttcccgacgccccccggccacatccccacaggaacgctacggcgcacagggcattactgtgcccccaccacaaccacataaagaaaatgtgggggctcggtcctccagtcacgcggcgagcaagtgcagcgcgggacgcccgagcgccgggtctaggcgggctgcaggtgccggcaagtgctggggccgggccgccgcggaacccacctgtgctgggcctcaggccttgcgccgccctcgggctgccgtcgccaaccccccccaaacagctcgccgccacgctccctcgccggggcaccgcccccggcacccgccccggaagtagttgcgggagggcgcggagcacgccgggaagctcgcgggtcggcaccgggacagctcccgggcgccgtggaatgcacacgtcccgcacccggaccttccggtcagcttcccggctcgctgtctgatgcccgcggtagccaatgagctagtggtgtttgtcctgctccgtccccgccctccaggggaaccaatcccattgcaggagaggcaggacgcgcaaaggcccgaaagaggagctgggcggggtggggggaaggcggaggcagtctagtaatgtaaagctccgctgagagggagagtgctgaagaaggggacagcctctgtacctgcggcgcggcccgaggggcggacgcgagcggagtgacgcgctggaggctgtttatagcgctgtcaggacagcgcggggagtggaggcagaggcctgaggtgaggggcctcgggcctgctgcgcctgcagggagttgaacaaaacgcggggaaatacgggctgggggtgggtgagaggaggagcgatgggctttccacttccacagctttaaaatttaaaagctcgacccgggaggctgttggcgtctggttgccataacaaccggcagcctcgtggcaggccggctgggggcggggctctgagaaccggggcggggctgtggcggggctaacaggctgcagctgagaaacccaccccgagacggagccggaaggccgttattcagaggcggctccgagcctccccttcgccttctggatgctctgagctcctcaacttggcgttcagggccctgcattgtctggtccgttttcaccggagagtccagcaactgacactttcttcccttaaacctgttgggcggttcattcctttgagctactgtacatgctcttccttctgccggtaatgccgttccctcccctattgtcttgtccgcctgaagggtttatcagagtctctggaggccctcttcatcccgacgattctgttgccctaagaaatactgtgccctgaattgcggaacagagctctagttacaaaaaacacccgctggctgtgtgcaccagatgcgtccccaacccgctgctcccagttcagagtgcaccaagcacctgccctattcccagaagtacagaggaagcaagcagcccccaattcacatctcctgccgctgccctgattggggatgaacgggcactgactgcagggccaaagccacagcggcctctcgagctgcagagttctcctgacactggctctagaggaccctcaccccccagctctcaagctcaagctccccagccccctgaataacaggaccatctcctttaagactctaagatataaatgcaggggctggtcagagtagtgactccaaaaaaaaaaaaaaatcacttagtgactccaaactgtcagccaggcgcgatggcacatgcctgtaatcccagcactttgggaggctgaggcaagaggatcacttgaggccaggagtttgagaccagcctgggcaacagggagactccatctctacaaaaaataaaaatgttagccagatgtggtggtacacacctgtagtcccagttattcaggaggctgaggtgggaggatcacttgagctcaggaggccgaggcttcagtgagctatcattgtaccactgcactctagcctgggcgacaaagccagaccctgtctccaaaacaaaaaagcaaggtgtcttctgttccttggtaaagggcagtaaagggtagtaggacttgaaattccccctgattcagagtccactgttgctatttactaaacaccctgagcctatgaaatgaagagaatagttatgctatatggggtatatataaaatatacctatatatcattatatatcgtacatatggcattctatataacatgtacatatatctacataggtatatttatatcaatacatatatttgtatattattatgtatatatcactatatacattatatacctgcaggctccacatgtgtgcatgagtgggaacacacacacacacgtacacacacagtgcctggcactaacaggagcttgcataactagaaggaaactgaggcaggtggtgaggcctgccagcctgtttggtctcctacagctggtagagcagcccctgctctcctgaccttcagtggcccggaccctcttccatcaccctgtgtaccccacagagctccccggattatggtgcactgagaaggcatctggaagcctgggccctcatggcatccaacgataaaggcatggcaccctcgctgggctctccctgggcctcccagatggggccctgggatgccatcctcaaggctgtcaaagaccagctcccgtctctggactcagactcccctttggtaagcaagaactctctccctggatgccttgtccttcctaccagagcaggcatgacgctggccaggacagctttggagcacttctctgaagacttttcctgctgacctgtgcagtttgttgtcattttactttaaatcgcatggccagactcaaagttgtgttttctgggtgcctatttccttctttactctttcttctgccttgattgtcatctctgagcatgggtattggtgctcagcatcttgggagaccctttcagtggagtttttggtgctgacttggaacccaggtcaatttgatgcagaagctctgtcctttccattctgctattctccactctctcgtgccaggacagggccagaacacccactgagaatgcacaattccagtgcattgtgataagccttcgagggattctgcatttgtggtttggggtccctgaaatggctctcaaagacgctcagaccaatagccctaggtgcaggcataagaccctgctaaagatgctcctggcgggggctgctcagtgcacaggttggcactgggcgttaagagacagtatgagggttttaaaaggaacgggcagggtttgggtcctacctgggcaccagcaacagagcttcagggacctcagacgtcatccagtgcatgacgaggctaaggagaacctaaggggaccccacgcctcagtgctcagggtgttttcacaccttcagtctcatttgagagtatgagccccaaccccttcaagaagacaaactaagctgtgtaagtgatggctcagggtcacaggggatggggagggctggaccctgctctttcagctaccacctcactgccctgttcatgtcacgaggcattaatgaagcacctgctgtatgcgaggtacttgcagaaccaggagccccagtctcacctccacgaggttgtgctgccaagcccatttctaaacggtggcaagaagccgcgcacagcaaggctgactgggagagaaccggatctcccccaggctcctgagcagcagggctggacgggctggatgggctgggcgggctgggctggaagtgagagtggagagtggagagcgggggtggctaggccctcagggctctgcctgctgccttgtcctccaaaagccctctcatttgtccacagtcggactatggggaagaggagctgttcatcttccagcgaaaccaaacctccctgattccagacctgtcggaggagctggctgaagatcctgccgatggcgacaagtccagggcctgggtcgctgcagctgaagagtcccttcccgaggtctgtgggacacagaagagtatacgcctgtgtgtgtgcgatgttagtctaaactgactggtctaaaccactgttctagcatttccacgatatgctagaacatggtccttttttttttcccccatgtacaacccaaggtattcagatgcccaacatctaacctccacgcacctccctctcctggggagcccggcaccttagggctggcatgcacgcttgattttccatccgattttgacccttctcttcttcttgatcgctcctatcctgttctctaccatggcatcctgaatagcttctggccattgtcacaactgcttgtcctaattgtctctcccttaacccagctggcttcatggctacctggctcatcccagcacctggcgagtacacaggaactctggtttactaaactgctaaactacactgctacaggctacagtggggagtgggagggaggaagatggcccatcagtgcctgagcaagcacacaagctggacctcgtgggagggacaacccaggagacaatgagcaaatgtggactaagcgtgccaacgcaggcctgtgttgccagtgctggaggctgagacagaggttcccatgaggccaggagtttgagaccagcctgggcaatacagcaagaccccatttctggctgagcacagtggctcacgcctgtaatcccagcattttaggaggccagtatgggtggatcacttgaagtcaggagtttgagaccagcctggccaacatggtgaaaccctatctctactaaaaataaaaaaattagctgggcatggtggcaggtgcctgtaatcgcagctactccagaggctgagacaggagaatcgcttggacccgggggagcagagatggcagtgagccaagatcacaccactgcacactccagcctgggcaacagagtgagactccatctaaaaaaaaaataataataaagaaaagaaaacagtgtagaggcactaacccacttccaaaatggagacggggcctagctccagcgtaacttctctcaggtgttctgctgagaacaattaacctactgaatgggagggcatgggcaccgaaccagatcatctcccagaaccaggacatgcacccacccatcaccttgaaggaaatctcccatcagcccagccattcctagacctaggtttgaaataaccccacacaagagagatccccagggcagctaagaactctggtgggttcaggtggaacaatttgcatgtgattttattttgctgcttcatttttacaatcaattacttcagaaactcttctggatgattttttcttgtttttttttttttttttttttgtaatgtgggatctctactaaaaaattagctgggtgtgatggtgtgcctgtggtcccagctactcaggatgctgaggtggaaggatgacttgtactctagcttggggtatgaatttctgagccccaacattatcatgattgataatttaaatattgtttcattgctgtaacagtgcattccactctagccttgtatttaaatagcaggatgcctcagtggtgctgtctttagccagcccatattcaacagtagctttccaacttttttttttttttttttgggacaggatcttgctgtgtcacccaggctggaatacaatggtgccctcactgctcactgcagcctccacctcccgggctgaagcgatcctcccacttcagcctcccaagtagctgggattacacgcacgccactgtgctggctcatttttgtatttttagtagaatgaagtgtgcagttaaaaatggttaaaagaggtcaggcacagtggcttgtgcctgtaatcccaccactttgggaggctgaggcaggaaagatagcttgaggccaggaacttgagacaagcctggaagaccaactatgttgtagagactctgtcactacaaaataatattaaaaaaaattaactgggcctagtagtatgtgcctgtcatcctagctacttgggaggctgaagtgggaggatcgcctgggccagggaagtcgaggctgcagtgagctatgatcgcaccactgcactgcagcctgggcaacaaagcgagacttcacctcaaaaaaaaaaaaaaagtacatatttttctatgaaaaacattccctgaagcatgtttttgaggatgctaactgaacatacctgttttcttgacagccagttctggtgcctgcagaattggccacagaacctgggtgcagacagaacacaaggacaaaggatgcatcctctcaggaaggaagagaccctggcaggccttttgaaagctctggtgaggtcagcgctcttcttgggatggccgaggagccccccaggtggctggaaggcgaccttggaagcctgtctttcaacaccaaaggatcccagggtcctccctgggacccacaggccgaagccactctctcctgccatgaaggagacccaaaggcagagcccctcagcactgcctcacaagaatctgtgaaccgccgggccctccgacaggagagaaggaagatgatagagacggacatcctccagaaagtcacccgggatgcctgcggcccgaccagcagtgacaaaggtggggtgaaggaggcgccctgccacgctgcggagtcagctcccagatccaaaatgcccctcgtggagcctccggagggaccaccagtgctctcgctccaggtaggcgcctccccgtgcctggctgtttctcaggcctgttacctgtggcatggctgctgttcccatgcactggagctagaagcagcttgagggctggcccactaggaccttaggcccattatccaccattctgtgtacctgtctcagtagaggggtggagggtcccagcagagcacatcctgggggagggttaacaagaacaaagaacaagcagggcctgccttccttaaagagagaaaaggaggccaggcacagcggctcgcacctgtaatcccagcactttgggaggccgaggcgggagccccggagttcaagaccatcctggtcaacacagtgagaccctcatctctaaaaaaaaaagaaatcatcctggctaacacggtgaaaccccatctctactaaaaatacaaaaaaaaaaaaaataattagctgggtgtggtggcgggcgcctgtagtcccagctactcaggaggctgaggcaggagaatggcgtgaacctgggaggcggagcttgcagtgagccgatatcgcaccactacactccagcctgggtgacagagcgagactccatctcaaaaaaaaaaaaaaagaaagaaagaaagaaacaaagaaagaaagaatgtataaatttaaaaagagagagaaaaaaggaattccactcccgaggatgttcataaatacatatagccatatctaaaatatagaacctggttctgtcaaagcctgatctcaaaatatgaaagccctcattctcataaactagtgagcacctgttaaaaagttgtatttagtgcattaatgagggaaccagcaggatgacagtgccggtttaatgagatcataagaaactgggattttggccaggtgtgatggctcacgcttgtaatcccagcactttgggaagccaaggcaggaggaaaatctgaggtcaggagttcgagagcagcctggccaacatggtgaaaccgtgactctattaacaatacaaaaattagccaagtgtggtggtgcgcgcctgtagtcccactatttgggaggctgaggcaggagaatcgcttgaacccaggagatggggatcacgcccctgcactccagtttgggtgacagagcgagactccatctcaaaaaaaaagaaattgggattttgtaaaacactggggaaaaagagaggaatgcagagatacgcttgtcacattcatgtcctagaggagttatcttgtctactggacagaaaagtaaccatcacaccgtctcggttttacacattttggataatttttcttaacaggttagagaaaactggcaccaggtatacacagaagtcatctttactactgtttaaatcaaccgttctttctgctcacctaaaaacttatttttctccacttagagggctgcaaagagttgaaaggtcatatgataaacatgaattcttgattaatttcctccctcctcctcagactcactctgcccctaagcactcactgccaagccttccagttttagctcctgcctggaacagcttgattcttaaaagaacaaaattttttaacctccaaacattgtgaacctgtatgaacctaaatagtgtttctgaaaacaacacagggtttggctgggctcggtggcttatgcctgtaatcacaacattttgggagacccaggcagatggattgcttgaggtcaggcattcaagaccagcctcgccaacatggtgaaaccccatctctactaaaaacacaaaaattaggctgggcgtggtggctcacacctgtagtctcagcactttgggaggtgaaggcggaggtggaggcaggtggatcacctgaggtcaggtgtttgttcgagaccagcctggccaacatggtgaaaccccatctctactaaaaatacaaaaaaaaaaaaaaaaaaaatgaagggtgtggtggcgcatgcctgtaattccagctacttgggaggctgaggcaggagaatcacttgaacctgggaggtggaggttgcagtgagctgagctcgcaccactacactccagcctgagcgacagagtgagactcggtctcaaaaacaaaacaaaatgaaacaacaatacagggtttccttcgggtcagacaacgtctttgtgccaaaaacaaaagtgaagtactgatccccaagaaagcataggaaggaggtggcaaagtgcaggcccaccttaacggaggcgttcaatctgtaatggaaaggcggggtcagcctatttgcaaactctgtcatgcactgaattcctgatttctacccccaacatcctgtgaccatctccatgggtcacagcagctgtgaagcaggtacttgtgcctctgggacccctcagcatcctcataatcactggttttaatgatttcagcaacttgaagcgtgggatttggatgacatccttcagagtctggcgggacaagaagacaaccagggaaatcgtgcacctggaactgtgtggtgggcagctgaccaccgccaagttcaaggtctgaccttgaacactggagcccacgtgaatccccacaagcagcaccttcctgggcccctcagacacagagggctgcaggctggtcacagacagtcctgcagcccacacaagtcttccctgctggccccgccctaaacactcatgctgccagtccccaaaagacttcattcattcaacatatatgtgaccgcctgctacgtgccaggcgtgggccaggtcctagggacaaaggagaggcctccgcaccccaccccatgacccatacctcctcttccccacctccctgggccagcctgccttccttctccctcctcctccttcctgggggaaggaagccccaccttctgtgcgcagtcagctcctaagcacgctcccgcttcccctggcctccccatttaaaaagggaggcaaaggatgtcaccactgtcactacactcatggctttgctctgggaagtcctgcaaataaaatgaaagttctccaacccctccctatccactcgggccacaaaggcgaggggaggcaggtctgaggcagaggagccagggcaggtgcggcgcttccgcctctggtcccaaagcaaagactcccctgtgactgacagcccgtgttatgttaaatacattttgttggtttgtaattcaaatcccataaagcaggaggtagagagccaaccattctggaggacatgtgtgtgcatgtgtatgtgtgtgtgtaactggcactccctttgtggaggggagtagggcagaatgtattcttttttttttttttttttttttttgagacagagtttcactcttgttgcccaaactggagtgcaatggcacgatctcggttcactgcaacctccacctcccgggttcaagcgattctcctgcctcagcctcctgagttgctgggattacaggcacgtgccaccacgcctggctaattttttttgtatttttagtagaaacgggatttcaccatgttagccaggctggtctcgaactcctgacctcaggatccgcctgcctcagcctcccaaagtgctgggattacaggcgtgagccaccgcgcttggccgaatgtattctctgttttaaaggcacataaccctttaatcaagctattgcaattagaaaatctgtcttacactctgactctagtaggtaaagatgtgtgttcagagctgtttgctgcagtgttgtttaaaaatctgaaaagctggaaacaacccatattcaggaggagtccagctagatcgttttagcacagaatacactgcggctcgatgaggggatctccgtaggttaacgtggaagcatgtaatatacaaagtgaaaaaagtgaagttgaaaaaaaacctatagaggatgaccctattttttttttaagtcaacacacagaactgttcattatgatcacctgtgacaagtgggaccggggtgtgaggaagtgggataaacttaaaaatacgtcactcctacttcaccaagcccttgtgccacaggccctgctcataaagattctgcccccctcagccctgctgagctagaggtggagtcctcagagggctgagtagggagagggctgggcgggggcagtggaggagcctgaggtccattcacatgtggagaccccaggggtcctgaggctccagctgctgtaagtcacaagtgggccaagtccccactaatcagcctctcctttggccatcctcagaccgcatggtgccgagcgcccacaacaggctcatggaacagctggccctcctgtgcaccacgcagtccaaggcctctgcttgtgcccggaaggtgcctgccgacactccccaggacaccaaagaggcagattcaggaagcaggtgggacttgtagccaggcccggctcctgtggtcctttagaatggccccatggttttgtagcactgactgggcctaccaagggcggggcactccatgtgcattttctcagtcactctcaagcatctgatcaggcagtcgctccagtcatccccattttagagatggggaaaccaaggctcagagaggttgactctctctggccataaatggcagggctgggactcaagccctcaagtacctgctctttccccaaacccaacgggaaccctcctttcaatgggaggccatgaggcctccctgagagtaggaaggttatcatgtgaccctgcccctctggccacagctgattggtccagctctgggcatgtgaccccagctgcgggatttttcaatctctgtgtctctgtgtaggggtggaagggcaacagccacctgtcctgccacagggagaaaggcaagctgcagtgaagctgggagaggcagaggtggaggcagggccccagggtcccgtaaggcccctctatatgcctgccctccccacactttggttgctccgcacttgaggaatctgagaaccagtgaatcccttttcacctgaccagcagtgggtttctgtgtctggaaaccaaaagtacctaacagaagtggctacacctggctgggcgcggtggctcatgcctataatcccggcactttggaaggccgaggcaggcagatcacctgatgtcaggagttcgagaccagcctggccaacatggtgaaaccccatctctactaaaaacacaaaaaaattttccaggcatgttggtgcatgcctgtaatcccagctacttgggaggctgaggcaggagaaatctcttgaacccaggaggcggaggttgcagtgaccaagatcatgccactgcagtccagcctgggcgacagagcaagactctgtctcaaaaaaaaaaaaaaaaagaaaaagaaaaagaaatggagagaactgcagtgttaaccatggcagccattagccgtgtgtggctactaaacacctaacgtggtgaatgtgactgaggaactgaatgttttatgcattggatttaaactggcttaaatgtaaacttagccacttgtgccaagtggctacacttaccacagatagagagcatgtccatcatgagggacgttctgttggccagtggtggcctaaatctcgcatgctgttctgaagagtaaaagagcaaatgtgtttaatgtgcccgtctgtagagagtgggcactcactgggtggcagccacgagcactgtgactggacaaacccagcgcaggtcacagagttatcacagagaactgactccacaacacctgcttttctcatttcagatgtgcctcaaggaagcagggctcccaggctgggccaggcccgcagctggcccagggcatgaggcttaacgcagagtcccccaccatctttattgacctgcggcagatggagctaccagaccacctgtccccagaaaggtccggagggcagtgactaccccataccagcctctactttgcagagttgcctgttgaccgcacagagcctctggtggatcctgatggggaggaacagggacttcaaaaggcttggatcaattctcaattgaaaagtgctggcctacagtccccctgggtccctgcagggagggaagaggggcatgaggcacacctcctcgggctgggctctatgcaatagagcccaacacgtctaggctggagggcatcacccacacctgtcctcacctcctggcaggacgtccaccggcctccagtgtggctgctgacctcttgcattgggtcaccagcaaagcccgagtgcttcaagccccaacaagagttggaacaccaggtggagtgggcacatccagaaacccatttctctccctgcagctccagccacagctcctctgacagtgaggaggaggaggaggaagagatggcagctctgggagacgcagagggggcatctccttcctccctggggctacggtaaccacccaggggcctctcgccacctgcagatgtcccacctctgctttctgcagcaagccctccacctggcacatttaccgcctgtggtgaggtcttgctgcacccaccgcacagggtgagggggacggcacagctttcatcatcctgcccacgtccactgggtcccagcagtggcagcagtgatgggctgcctgaattgcattcttgctctgaaatgggagctgggctcatctgcttttctcctgtttcagtaaggagggctgggaggggcggcccccacggggttgagtgaatttggtctcattgtgtcacaggacctgtaccgggaaaagccagcttctccagcagctcagggcctttcagaaggggacagcccagcccgagctgcctgccagcaaggggcccgcgggtgggagggctcaggcccctgaagacacagctggatcacgaactgggaggaagcaacacatgaagctctgtgccaaggggcagagcgcccaggctcgactcccaagaggcaggcccagagccctgggggatgttcctgagccaggggcagccagggaggccctgatgcctcctctggagcaactatagctgcctcaggtagtgggatcccaggagtgggcaggggcgggctgacttgccatggaccctgggccccggtgtccccttgttgttcctgcatttccactagcaggggcattccagaggcagggaccctcagactttggactgttgcccaccctgttagagctcagtcacaggtgcatgaacttagaggaaggatgcagatacaaatctgtatgtaacctgtgacaacagctttgggataaaggggcctggtcctctgagggagatgggcagggacagcaggaggacggggtgctgctctctgcgggactctgaggctcttcatctttctccagttctgcatttttttaaacaggcatctattatttccatcaataaggtctttttaaaaaccaagtaaaacgtatttagaggattttagggttgaaagagacctaagccttattttctggcttcctgcatacttgctattttgggcacctaaattaacacacgacacacacatgcctacccacacagatctaatacacgtggttttttctcttttcgagacgcagcagctgggactacaggtgcacaccaccatgtccagctaattttttttttttttttttttgtagagatggggtctcacggtgttgcccaggttggtctggaactcctctcaatcctcctgcctaggccttccacagtgctgggattatagcactgtgagctgccagcctggcttttaatgaactttttgaaagaggagtaacgagaatttgctttctctttctcttctttacctaagatagaaaggcacacatagattctcaaggcctttgacctttatgaatctagacagaatactggaaacccctggaaatgctgtcctgtgtagaatggagcagcggcctcacttgttgatcaccagcaaaaactggggacatctgcttgccccctgccaagacccggcccctccacaggacaagcctggtcttcctgggtcctgttcctttgccagcaccgtcttgcagccccgtcttcacgggatgcttttgtaactgctgtgatcagccctgacctgggcacctgtttgtctccccaaccttgtctccaggatgtgtcctgctgtctgccccgtgggaagagcagagaaatcatcaccaccttgggccccacggtgccacgggctcaggcagcacagtagggcgccgggcctttgggacagtgtcccagcttcccctggggttcacccctggctgccaggccactgaggatgggcaggggtctcttctcatcaagccttgtaccaggcaaaagacaggccctgcttggccgtggtcactggccgccaagatcagggctacagatgtctgctctctggaccccacgtgatctggccactggggacccccacccgaccccactcccaatgatgaggggcattttcattgcaagtcaaaggcaagacaggcttccataaagtcccaggaggtccctcctgtagggcacaaggccaggctgcctcccagcccccaggccctctcccacctacagagaccctcccctgccccctccactccggggcctgtgccgccagaaccgggctctgcccccatacgctgccctcgcagcctggcggcctccgctgtggctgcctagctgtcaagagcaaaggctttttttttcttcaaccccattttcttccatttctcccacctttttaatgccagtaacctcactgagaatgttttacagtgatggaaaataaactctgttccaagttcaactctgaattactgtgtctgtcaaggcaaggggagtgaggtaggaagtcagacctgcgtccaaagctggctctgccacctgggcaaggttttcacgctcccagtgcccagttcctccacccacagaaggagaatcatggccgggcgcggtggctcacgcctgtaatcccagcactttgggaggccgaggtgggtggatcacaaggtcgggagttcaagaccagcctgaccaacatggagaaaccccatctctactaaaaatacaaaaattagccaggcgtagtggtgcgcacctgtaatcccagctactcaggaggctgaggcaggagaatcacttgaacctgggaggtggaggttgtggtgagccaagatcgtgccttgcactccagcctgggtaatgaagtgagactgtgtctcaaaacaaaacaaaaaaaggagactaatgggagtcccccctcactggactgcatgagataacatcacagcacacgcaggcacctgggactcacagctcctacaaaactctcccatcacgtgagtgctgaggatgacgcccatgagatggggccaagcagcaggcagcgaccatgagatggggccaagcagcagccagtgggaggccacagcctcggcagggggagggaagtgggcagaccccaaccacactcccccagaggccgccacctccagcacaggcctggatatgagagaggggcctgggggctcaggctgcgctggggagatgggtgtcagcaacgctgggtgctttgctagctcctggagtgtggcctggccacatctagctgggtacctcatgccccatgagagatcccagagctagtctagaaggtaaaagccgtccctcaaccaggcagccccattctgcagacacaggacagagcacacaggggccagaagcaatgacttaaaaaaaaaattgtttattttatctgagacaggatctcactctgtcttccaggatgagtgcagtggcacaatcacagctcactgcagcctcaacttcctgggctcaagtgatcctccagcctcagcctctcaagtagctgggactacaggcacaccccatcatgcctggctaattttttttttttttgtgtggagtctcgttctatcaccaggctggagtacaacggtgcgacctcggctcactgcaacctccgcctccctggttcaagtgattctcttgcctcagcttcccgagtagctgggactacaggcacgtgccacgccaccatgcctagctaatttttgtgtttttagtagagatggggtttcaccatgttggccaggatggtctcgatctcctgaccttgtgatccacctgcctcggcctcccaaagtgctgggattacaagcgtgagccactgcacctggctttttttttttttttttttttttggtagggaagaggtctttctatattgcccaggctgctcttgaactcctgggctcaagcaatccacccgcgttggcctcccaaagtgctaggattataggtgggagccactgtgctcggcctctgacactaaataatgtcagttaagggaatgagaaaaagggcaggtcacgcacctggaacctgggctgtgccaaaaggtcaaatgtgcacgtatatacagtgactaggtgacaaatgcaatggagcatcccaggctgggatgaaggccaaggccacctacctatgaggaacaaccactgcctggctggaacgttccagaacccagtggtttccatagctgccctacgacttccgagatgactaaacccaccaaggactctatcacactgcttgtcttggccactcacccaccgtggatgtgcacagaccagtggctcccacgcagcacaggccagacaaaagctggaaggtgaaggcttcttaccttagaaagacaaagtggggcaaccgtggaaggccacattccagacactaaggggccaggagcaaacgcagccctgggccccggccctggggagatgtcaggcccgtcacatcccaggcaacatgtcaggaagatggaactcaggggtgctttcccgccccaggtgtcttccgccctgcagagcagctatggatctgcaaaggggactggaatgctgcagagccccgggctccatttggaaactctggcaggatgaagaagctggagaccacgtcctgggaaggctggggtacagcagggctccctgcagcagacgaggggtccctcaaattcatgtgcacccagacctcagaatgtgaccttatttggaaacacgggttttgatgatataattagttaagatgaggtcacagtgtattgggggaccctaaacccagtgagtggtggccctaccaaaaaagagactgggcatggcggcacacacctgtaaccccagctactcaggaggatgaggcaggaggaacacttgagcccagggattcgaggctgcagtgagctatgatcatggcactgtattcccgcctgggggacacagcaaggccccgtctcaaaaaaaaaagggggggggagcaggtggggggtacacacagagacagcgcacagggtcacagacacacaggagaggggttgggacgtggggatgaggctgtatgccagcagccactggatgctggaggcagctgatggaccctcccaggcccttcaggagccagccccacgaacaccttgagtgtcggcttctggcctcctgagtgtgtctctgtggctgaagcccctgctctgtgtcacctgttctggctgccactggacactcagagcctgtccttgcccttgttctgcacccagtgcccagcttcctctgcggcctgggcatcccaaatgtcccctgctggcctcatactgggccatgggaggaaacgggcagctggcaatgctttcggaccaggctgtctagcagtttcctgaattctgtgcccagggatgagagtcctggaaagggagtttcaggcctggtgatcaggctttggcaccggggcctccaggagccaccggctggagcgtcggcaaggagcctgcccccatgtgggtccgctggtgcttgtgcaggtcggtgccccggcggaagccccggccacaggccgggcaggtgtagggcttctcacctgtgtgcgtccggcggtgggcgctgaagtgcgagctgttgttgaagcgcttcccgcactgggtgcaggcatagggccgctccccgctgtgtgtcctgcggtggatgaccaggctggagctctggctgaagcgcttcccacactcggggcacgggtagggcttctcgcctgtgtgcaccctctggtgcgtgctgaagttggagcggtcgctaaagcccttcccacagactaggcacttgtaaggccgctcgcccgtgtgtgtgcgctggtgcttggtcaagtgggacgtcttgctgaagcctttgccacattcggggcaggtgtacggcttgtcagccccatgggaagcccgtcttcctggtggggggccgcctcttggctgatcaggcctgaccaagcccctgactggggctggcctctgacctgggagcgggtggccaggcccctggcatcgtgccgagagcactcggtaccactccattctcaacggggcatcctccctgccatcaccgccgtcctccaactggatcccaggtcctgagacagagaaagcacgatctctaggaactcacagcaagagggcaagggaaatccttctaataggaaaatgaaggcctcacagggctcctaaggttcccctacaaaacatttagcaggggctgggcactgtggctcacgcctataatcccagcactttggaaggctgaagtgggaggattgcttgagcccaggagttcaagaccagcttgggcaacgcagtgagatctcgtctctacagaaaataaacaaaactagctgggcatggtggcgtgtgcctgtagtcctagctactcaggaggctgaggtcggaggatcacttgagtctaggaggtcaaggctgcagtgagctgtgatcgcgccactacattccagcccgggtgacggcatgagaccctgtttcaaaaactaaacaatcaataaaacaaacaaagaggaacgcacttgaccatcacaataacccagtgggtcagtgctgttaccatctccatcctgcagatggggaaaccgaggcacacaagtgttaagaaacttacccagaatcaccgggctgctaagttacagagtgagggccatcaagctctgcactctgctgtatcctctaagccaggggttcccacccagtggcaaggtctggagacatttttgttgtgtctggggagggggttgtaaatggcctctagtgggcaggggccagggctgctggaaaacctcccacccagcacaggcagccccacgtggagagccatctggcccaaatgccagcagcaccaaggtggagaagccctgctctgggctgttctggctgagcagagcagtcgtggctcccagccactggacctcccttgtcgtacttggtgtggcccctgaggcccctctgcagatccaggttctagagccaccaccaacaggacaggagaacagggagaggggcctggaatgatccaggctttgcccctttcaggaaaaagcccttgacttctctgctcttcctttgcagcatgagggtgactgcagctggggacctggtagcacaaagtgcactggggtgcctggggggctgggggagcagccgtcttcatagcagtcccgcaagaggctctgcgcatggtaggcacacgccatgctgacctcacaggggagggacagaaccacccactgcccttggaaatgtccactttaagacactcccagccccagacctcctgggcgaatccttcttgccctcccctcccatctccaggaccaacttccagatagccgaaggtgggtttggcacgtactgagcctcaaattccacatctaaaaaactgagaggaggccgggcatggtggctcatgcctgtaatccaagcactttgggaggccgaggaaggcggatcacttgaggtcaggagtttgagaccagcctggccaacatggtgaaaccccattttattttattaaaaataaaaaaattagttgggggtagtggtgggtgcctgtaatcccagctacttgggaggctgaggcaggagaatcgcttgaactcgggaggcagaagttgcaatgagccaagatcgtgccactgcactccagcctgggcgacagagcgagactctgtctcaaaaaaataaaaaaaaaaaaaatagaaaataaataaaactgagaggaggattggaaccacctcattggcctgctataataatattttatttatttattttaaagacagggtgatatggtttcgatctatgtcctcacccaaatctcatgtcagactgtaatccccaatgtggaggtggggcctggtgggaggtgagtgggtcatggaggcagatttctcatgaatggtttggcaccatcctcttggtactgtcctgacaatggtgagtgagttcccatgagatgtggtcgattaaaagtgagcggcacctcccctcgctcctttgctcctgctccagccatgtgagacatgcctgctccctctctgctttccaccatgactggaagcttcctgaggcctccccaaaagctgagcagacaccagcatcatgctttctgtacagccaattaaaccttttttctttataaattaccaggtctcaggtatttctttacagcaatgcgagaatgacctaatacacagggcctcactatattgcccaggctggcctcaaactcctgacctcaagtgatcctcccacctcagcctcccaaagtgctgagatataggcgtgagccacagcacccagccttgttgtaaaaatatttttacttatttatttatttatttttgagatggagtctcgctctgtcttccaggctggagtgcagtggtgtgatctccgctcactgtaacctctgcctcccaggttcaagcgattctcctacctcaggctcccgagtagctgggattacaggagtgagccaccacacccagccaatttttgtatttttagtagagaaagagtttcaccatgttggccaggctggtctcgaactcctgacctcaggtgacccaaccgccttggcctcccaaagtgctgagatcacaggggtgagccaccatgcctggccgtacaaatatttttaaaagagactgagtctggcagctcatcaaaaggtaaacaagagtcattatatgagccaatgactttactcctaggtacacacccaagaaaactgaaaacatgtcctcaaacagaaatgtgtacataaatgttcacgacagcactcttcacagtagccaaaaaatggaaatcacccaaatgtccatcaacgaaaatggatcaacaaaacgtggtctatccatacagtggaatactattcagccatgaaaaggaagcactgacacatgctataccacggatgacccaggaacacatgacactgagcaaaagaagccagtcaccaagggacagtccctgcacgattccctttacagaagacaaccagaataggcacacccagagacagagcagacaggtggctgccagaggctaggggaggggaaatggggagaaactgcttgttgggtacgaggtttccatttagcatgataaagaatgtttttgagggccaggcctgatagctcacgcctgtaataccagcactctgaaatgccgatgcgggctgatcatttgacgtcaggagttctcgccaacatggcaaaacactgtctctactaaaaatagaaaaaatattgggaggccgaggcgggcagatcacaagatcaggagttcaagaccagcctgaccaacatggtaaaatgctgtctctactaaaaatacaaaaattagccaggtgtggtgatgcacacctgtaatcccagctgcttgggaggctaaggcacgagaattgcttgaacccaggagatggaggttgcagtgagccgagatcatgccactgcaatccaacctgggtgacagagtgaaactccatctcaattaagaaaaaaaaatgtttttgagcccgggtaacacagtgagactccatctctatcaaaaaatttttgtcgcccaggctggtgtgtaatggcgcgatctcagctcactgcaacctctgcctcctgggttcaagcgattctcctgcctcagcctctgagtagctgggactataggtgcatgccaccacacccggctaatttttttgtatttttagtagagatggggtttcaccatgccggccaggatggtctcgatctcttgacctcgtgatccacccgccttggcctcccaaagtgctgggattacagacgtgagacaccgtgcccggcccaaaaattttttcaaaattagctgggcatggtggcattgacctgtggtaccagctactcgggaggctgaggtggtagaatcacctgagcctggggaggttgaagctgcagtgagtcaaaattgtgctactgcactccaacctgggtgacagagtgagatcctgtctcaaaaaaagaaaaaaaaagttttggaactatgtgttactgcacccaacctgggtgacagagtgagaccctgtctcaaaaaagggaagaaaaaagttttggaactagatgaaggtgatgattgtacaacactgtgaagatacgaaacgccactgaaccgtttactgaaatatggctaattttatgttatgtgaatttctttttctttgagcagcagcaagatttattacgaagagtgaaagaacaagtttccacagtgtggaaggggacccgaacgggttgcccgtgaatttcatctcattaaaaaatgtaaaaactttgaggccaggtaccaacctaatttgtttttttgagacagagtctcactctgttgcccaggctggagtgcagtggtatgatcacagcttactgcagccttgaccccccaagctcaagtgttcctcccacctcagcctctcaagcagctgggactacaggcatgcaccacttttgtatttttttgtagagacaaggcttctccatattgctcaggctggtcttgaactcctggactcgagcaatccacccgccttgacctctcaaggtgctgggattacaggcatgagccaccatgcccggcccgtttttgtttttgttttttggaaacggagtcttgctctgttgcccagactggagtgcagtggtgtgatctcggctcactgcaacctccgcctcccgggttcaagcgattctcctgcctcagcctcccgagtacctgggactacagatgagtaccaccacacccagctaatttttgtattttttaggagagacagggtttcatcatgttggccaggatggactcgatctcctgacctcatgatccacccgcctcagcctctggaagtgctgggattacaggtgtgagccaccgcgccagccaattttttttttttttttgacacagagtttcgctcttgttgcccaggctggagtgcaatggcgtgatcttggcttactgcaatctccgcctcctgggttcaagctattctcctgcctcagcctcccaagtagctgggattataggcacccgccatcacgcctaatttttgtatttttaatagagacagggtttcaccatgttggccaggctggactcgaactcctgacctcaggtgataaacactcgcctcggcttcccaaagtgctgggatcacaggtgtgagtcaccgtgcctggccatttttttttttaagcaagatcaaatagatccaattttcctcggccccacagaccttttttaccataggctctggcgccgggtaagtaaaacccaaacacatgcctgtgaccctgagagggaagctgtgtctgggctccaggagctggtggacagagctgggcagaatctcattccttcccttctgaggattccacgtaaccacttgggagccgggagggctggcaaattctttcccttttgacttctgccttttgcacagggaatgaactggaccacaggtaatgtgcgctcagagatcttcagatcagggttcctcaatcacggtgcaggtggtgtccatgggacctggcccgggctgtctctgatgcggccgccctgtgcaccgcaggaggttgggcagcatccccaccttctgctcaacaaataatcactttcatcagtgacaaccccagggtcgtgacaaccaaaaatgtctccaactcatggacagatgtcctctgggggacaagattgccccaggtggagaacccctgctctggatgcctgtcactaaagctactgatgaccaaccagagccccatacaacatcatctaaaactcttcataggcaacaaaagaaaaaaacgatcaactggacactagaaccaaaaacttttgtgcatgaaaggacgctaccaacaaaatgaaaatgcaacacacaaaataggagaaaatatttccaaatcaggccaggtgcggtagctcacgcctgtaatcccagcacttagggaggctgaggcaggcagatcacttgagatcaggaattcgagaccagcttggccaacatggcaaaacccagctctactaaaaatagaaaaattagccgggtatggtggcacacacctgtaatcccagctactttgggaggctgaggcaggagaatcgcttgaacctggaaggcggaggttgcagtgagctgagctgagatcgtgccactccactccagcctgggcaacagagcaagacttcatctcaaaaaaaaaaaaaaaccctgaaaataacaaccattggtatggatgtggagaaactggaacccttgtgcactcttgctgggtgcatgagatggtgcagatgctgtggaaaacagcatggcggctcctcaaaaaattcaacacagaatgaccacatatgctccagccatcccactgctggatacatccacccaggaacggaaagcagagttgatcagagatacacttgtacacccacgttcactgcagcattatttacaatggaatattcttcagccttaaaaaggaaaaaaattctggaggtttcccaaagaaggaagtctgcctcaagaccgtggcacagaaatcctaagcttccagtctgctggcctggcctgcagatttcagacttgtcaacttctgtaagcaaccaagggagctgtctaagtacccattccttaaaataaatctgtgtgtgtgtgtatcttctgttggttctgtttctctggagaagaaccctaatacaaagcgatatctcactgtcattagaaaaggcttcagcatggccacgcacggtggctcacacctgtcatcccagcactttgggaggcctaggccagcggatcacctgaagtcaggacttcgagaccagcctggccaacatggtgatgaaacccatctctactaataaaacaaaaattagccaggcatgatggcgagtacctgtaatcccagctacttgggaggctgaggtgggagcatcgcttgaacccaggaggtggaggttgcagtgagccaaggttgtgccactgcactccagcctgggcaacagagcaaaaatccatctcaaaacaaacaagcaaacaaaaaaccagaaaaggcttcagcagcatcaggaaaggcaggaagagacaaacggacagagaaagagcttaggggacggtgctgggtaacaggcagggcagtgctcagtgtgatggggagaggctggagaaccaggtcctgtgggagcagctctgcccttgagaggagggcacagggaagctgaagtgaagtaggaccagcatgtagggggcagaggcagaagaacaggatggcaaggcagtgctgggcatctgcctgagtcacggccgagtggctgtgcaggccctgcaggtgggactctgcagggatacgggtagccctgtccacggaggatcgccccaggccaactggaccaacagaaccaagccccggagctggtgcctgacagttcctatttttggcaagccccctagaggacacaatcacttgcaagttaccttcattctccagcggcgcgtcccgctgagctgggtccatgcatcttggctcctccccagaaaggtatacagccacgtcctccaagttcacgggcacctgccagaacgcaccccactcagtcctggccccaagcaagctgcctcctccccaactaaggccactggcccagggagctgcaccgccactgcccctcgaggctggcgccaagcctggtggtgcagctggtcttctccactctcgttgcagtggtgagtcctggtgtctccgcccactgctcccatgtgccactgctgcagagctgggacaccaccggagaagggacagattcgccacgaggagtggtggacccactgcacactcagccaccgaggcccatgctccacagggagacaagagcatcccctggctccgtggctagccagccccaggaccccattgcggcagacgggggacttcaggatgcctctgggccagtggctcccagatgtagcaccagattgacccggaagcatgattaaaaaaacaagcaaactctttccagaacaggcaaattcacagagacaagaaggagctttgtggttgccagaggctgagggaaaaacaggtagagactctggtaatgagtctagggggttttcggggagggtctaaaggaaatgttcggccgggcgcggtggctcacacccgtaatcccagcacattgggaggccaaggcaggtggatcatctgaggtcaggagctccagaccagcctggccaacatggtgaaaccccatctgtactaaaaatacaaaaaaaattagccaggcatggtggtgggtgcctgtaatcccagctactcaggaggctgacgcaggaaaatcgcttgaacccgggagccggaggttgcagtgagccgagatcgcaccattgcactccagcctgggcaacaagagcaaaactctgtctcaaaaaaacaaaaacaaaacaaaacaaatacacatacatacacacacacacacacacacacacacacacacacacacacacacacacatataaaaattataaataaataaataaaaataaaacaggccaggcatggtggcttatgcctgtaatcccagtgctttgggagacttaggcaagaggatcacttgagcccaggagttcaagaccagcctaggcagcacagcgagactgtgtcccattaaaaaaaaaacaaaaaaaaaacaactagccgggtgtggtggtgcatgcctgtagtcccaactaactgaggaggctgaggcaggaggatcccttgagcctgggaggtcaaggctgcagtgagctgtaatcacactactgcactccagcgtgagcacagagccagactttggctcaaaacaaacaaacaaacaaacaaacaaacaaaaaccccaaaaaaaccagcaagcaaacaaaggagactcccattccagcccagcggtgtgggaggaagctgtgttttcccccagagtcccaagagattcctgtgcccagcagagtaggagtcaccaccctgtctcactggtggaccgcagaatcttccgggcacagccgagtacttaaatggcctctggagagaagaaaagacttcccaggaggccaggggaagtgactccagggttggggcaaagggagaaaactccagggaagagctcctctgacatccaaaaccttggcccccaggagaggtgtccccttaacaaggaagtgtgacacacaggaggtcgggccagaccccaggatgctgcagaccaggagcatcccactcacctgggaccaggccgaaaggaagggcgaggctgacgccatctcctgatgccggggagctggagggcctgggaaggagcagagtcaccaccagtcacacagctcacccagtactgcccctgccgtcccctgcacaccaaggccccaacagcccggcggctgcccacccaagatccactccttgctggagagcctgtgcaccctgcatccaggcaggcctctgccctggccacagtccacaccccagtcaccttcacctccctcccctgcaccacttctcattcctccaaaggggtgctactcacctctctctggccacaacagcgggcccctctgtggcctgtggctcagctgggctgggggctgctggctggagaatcgagcctcttcctccagggacagatcctctggctgagcctctgcctggtgttttaagaactgtccccctatcccgaggggcacctcgtcatcagaaagcagctctgagccctgcacacagacagtgatctccccaccagctcccagaaggccagaaggaaaaatccccgcagggccccacacccctcatctcaggcaccccagccggctgcccacccccgggctgtctgcagcctccctccctctgcccagccgtgtggcagtgttccctgcagccagctcccagcctgctctactccatggtctctccctgtcaccacaatcgtttccccatcacattcttaccctctattccttggtcctcctgatagaccctgggatagaccctgggccagaagagccctgagtcagcgctggactaatttcagaagttcacagaactgcatttgctagattttttgaaattatctggccagctgcaatggctcacacctgtaattccagcactttgggaggccgaggtgggtggatcacctgaggccaggagttcgagaccagcctaaccaacatggtgaaaccccatctctactaaaaatacaaaaattagccaggcatggtggcagcacgcttgtaatcccaggtacttgggaggctgaggcaggagaatcgcttgaactcgggaagtacaggttgcagtgagccgagatcgtgccactgcactccagcctgggcaaaagagcgagactccatctcagggaagaaaaaaaaaaaaagaaaaaaaaaagaaattatcaacaggtgctctgagatgatctatttcctaattccaggaaaggtgagttgaatgaaattgggtcttagaattgagctctgcaatagcacttggacaagagacatccctaggcaactacaaacccagcgtcagggacccatctcaggcttcctcttattcaacattccacacctctaagggagcgtagtccccttggggagcacagcctgcccctctcagctcagtgatggccatgaggcatgtgtgcagaggtgtcggtgcagtgacagaaggaagccatgccgggaaccccaaacactgaagctgtggtggccaggaaagaggctggccggctgggaagaaaccccgatttcttggccaccccgatggcaggattttctgactgcggtcagctcacgccgtggtcaagcattaggggatgtgcctcctctgttggctgcaaaaggccagcagtgtgcagccagcagcactgccacaggaagaaaggcagctggtcagcactgcccatgtgccccatccacgcaaggccctgaaaaatgaactgaaacagcaggtggcaggacttctttctaatctcaaggagttccacaactgaaactgaagcagcaggaatgagtaagaggcttcctctactccttcaaatggggctggaaggaggtggagaggcactgtctatagagatttcggtgtgtcagaagggtcctgtctgtgccatccagtacagtagccactggccatgtgtgacgactgagcccttgagaggtggtcagtgtgactgaggaactaatttaacattctacacagtggccgggcacagtggctcatgcctgtaatcccagcactttgggaggccaaggcaggcagatcacttgaggccaggagtttgagaccagcctagccaacattgcaaaaccctgtctctactaaaaatacaaaaatcagcctggcgtggtggcagatccctgtaatgccagctacttgggaggctgaggcacgagaatcactccagcctgggcgacagagagagactctgtctcacaaaaataaaagtaaaataaatgggctaggtgcggtggctcacgcctgtaatcccagcactttgggaggccaaggcaggtgaatcacgaggtcaggagatccagaccaccctggctaacacggtgaaaccctgtctctactaaaaatacaaaaaaattagccgggcgtggtggtgggcgcctgtagtcccagctgctgaggaggctgaggcaggagaatggcgtgaatccgggaggcggagcttgcagtgagccgagattgcgccactgctctccagcctgggcgacagggcgagactccatctcaaaaaaaaagaaaaaaaaaaaaaaagtaaaataaatgtacatagctataatttaaaaagctacatgtggctggcagctactgttttgcatggcacagctctagaacctctgggggctctaaccaaagtgccccccatgcccctggtctttcttcccagtgttctcccactttgggggtagtttcaactccctgccttggaaggtgccggacctctctcccaccaaaacctatgtttggggctggcgtagtggctcatgcctgtaatcccagcacttcgggaggccaagatgggaggatcacttgaggccaggagttcaagaccagtctgggcaacataacgaaaccctgtctctacaaaaaatacacaaaattagcaggtgtagtggtgcatgcctgtagtcccagctactcaataggctgaggtgggaggattgcttgaagcctggaggtagaggctgcaatgagcggtgatcacaccaccatagcctgggcaacagagcgagactatgtctcaaaaaaaaaaacatgtttggcctaccctaggacagtgttcacaaaccatctgcactagctaataaagggctattggggtaggatgaggttaatcaaagggtggacacccattagccaaggctgagaaatcttttgcagttgctttcctcaaaagggctcaggggccaggcagccacacttggtcacccaatgaccaaggaatctgcagctgcagaccccagcagcagggccccatttcctcacctgagggtcaaaatgcccccactcacccgctgcctgtgtttcctgggcttccgctgcagcccttccacaaggaccacggcctcctcaccgctctccggctgctgctcgcgtacccgagcctggatctcccccggcagcacagtcaggaactgctccagcaccagcagctccaggatctgctccttggtgcgcagctccggccgcagccagcggcagcacagctcccagaggcggctcagggcctcccggggcccagccacctcctggtagcagaagagccggaagagctggcggaaagtctcagggctggggtcctccgtctccacggagggctcctcttccaagcagaagtcctcctccaccttcacaatcaggatctcttcctgttccaggtcctgctccaaggttggcaggggctggaggccagggacagtggccattgcttccggtgggccttgttccttttcaggccttagagttgaacctgtctctctctatacctctggccagacacaggaagagagtttttttcagggccctgtggagagacgataaaaccatctgaagggcagccctggggctggataagccctttggcctgggaagcccctgccctggttccaaggccagctcaccccaccatggaaaaggaaaaggaagtggatgaatgtcatctttgttattaaccccctgttaattcccgggtaatttactgaagggctctgggctttgcttcctcactgggcaaacagagatgataacaggacctacacacacaggttgctgacagaactaaaagggatggctgggggcagtagctgacgcctgtaatccccgcactttgggaggcagaggagggcagatcacgtgagttcaggagttgaccacctggtcaacgtggtggaaccctgtctctacaaaaaatacaaaaattagcccgacatggtggtagcacatctgtaatcccagcaactcgggaggctgagacaggagaatcgcttgaacccgggagatggaggttgcagtgaactgagatagcgccactgcactccagcctgggcgacagagagagactcaaacaaaaacaatctaaaagggatgtttgcggtcagagctcgagaatcgttattttccatgattagagtgggtcctatatggaaggggttcctttggaaatctgatgaaaagtagggcctttctgcagactctgcctcaacttgatccccggtgtccaggtctggcgaaccctgaagcccctacgcggccccgtcaggcacccccgcgtgggtggtcacgacagccccccaattccagggtcctgggagagctgggacccccaggccgggctgctttcccgtctcatccctcaggtggagggtgagcggtacccgaggccgcggcacagacccgggtgctggcgcgggccgcgaaatcgaagcttcggccgggacccgcgtccccgcgccccccgcactcactggaagcgctgccggccgtgggcagttcggggcaggaccggagcggcgggtctcggcgggagtaggactgcgggcctcaggcttggcagccagggacgccagagccggggccgaagaccctaaaccaggggtgcaaaccaggccgtgcgggtgggcccgcaggcggcattgtgggtaacgtagccgtggcaccattggctaagccggccgttgggggcgtggcaacacggccgagtgggcgggtccgcgacgtgcactgtggttaatgtggtcctcaaaggcacgcattgtgggtaacgtagtccagcacctcggtgaccgcgcgagcgtgcggcgactctgcagcctctgggctactttcccagtcactgttccacacccgctccgctctcctctggccgcctcctccatctttaaagccagcaaagtcgtccgggcacggtggctcacacctgtaatcctagcactttgggaggccgacgcgggcggatcacctgaggtcgggagttcgagaccagcctgactaacgtggagaaacctgggcgtggtggttcatgcctgtaatcctagctactcaggaggctaaggcgcaggttgcagtgagccgacatcctgccattgtcctccagcctgggcaacaagagcgaaactccatctcaaaaaataaataaataaataataaataaataaaataaataaaggcagaagttgttcaagataaaactggaagagatgccaagtgcttgcgcccaccctcccccaagagggcccccaacaacgtccaaccccaaatatcccttgtcctgcctgcttctttctgacaacataataatgggcatcaatctttgttgttgttgttagagatgaagtcccaccatggtgcctaggctggtctcaaactcctgggcccaagcaatcttcccgcctcagcttcccaaagtgtcaggattacaggtgtgcccagccaggtatcaattcttgtatgtatgtatttatttatttagagacagggtctcactctgtcgcccaggctagagtgcagtggctcgaccttggctcacagcaacctccgccgcccggttttaagcaattctcctacctaacctcccgaatagttgggattacaggcacgaaccaccaggtccggctaatttttgtatttttagtagagatggggtttccccatgttgcccaggctggtctccaacggcctcaagcaatccacccacgtcagcctcccaaagtgctgagattacaggagtaagccaccgctcccggtcgcatcaattcttgagcatcaagcaagcaaaacacatttgtacttcgtttcttcctcatttagtaatagaggtactataactagacctaccggttcaacaaaacaaaacaaaaccctgaagctctgagagttttaagtattgaaccccccagagaaggtcaaacaggaagtacagaaatgggattggaacccaaatctttgattccagaacttcagctcctaactaccaggttaacgtagtttgcccctaatcctaacttgggcatcctaaggcccgtctcctatgctggattctcgctgcttttcctctttggttgaacatgatccggagtttccctctgcctggggtgcccaggaaagagtcccagcaccgagttcgggtgagcagcaacgcagcatacacagcaggcgtacactcaacgtacgccccgccccgcacaagctccgccccgcatgcgcgccccgcctcgcatcccggatctacccccggaatctcgcgcgtctttcccaaagcatcggctaggactcagcccgccggaaacaaatttggggacgccggattcaggaagctggcaggactacatttcccagagcgccccgcgccctccccggaggcagattcctgggcgctctagagggggtgggttggcggcctggagggtctcctcaagtggcggcactgccaggggctcggaggaaggggctgcagtctcccggtggcagcgtccttgtcgtcgagactgcgggcggttcccttgcgcgccctgaacctcagtttccatatctgttaatgggggacattaaccctcaaggttgtaactcattcaagaccattcatccaggcataataaatgcataaacgctgcacgttgagtcctcccaactgcccccttaactaggcgctcgggtgatggagtggtggcaggtgcctgctttcatggagcttgccatgagaggcatacagtggacaaaattaccatgagaggcatacagtggacaaaattgcacgaagaattgtttaatcacttctttggcaaatgttagcaagcggcgtaaaagagggaacctgataccttcagggtggaagtgacagttgagcagcctagggttaacctggggaaccggtggggaggattccagacagcaggagtgaaaagtgcaaaggtcctggggccggagagaacacggtgcgtttgaggaacagaatggagaccagagattgggagatgtggctggagggatgggcaaggcctgaccatacttggagactctggtgaggattaaggattttatccttggagtcaatagagtttggggttttaagtaggatagcatcgtgatcagataagaagctttgtggagtacagatctcagaaagactggagaggagcagtgagactagctggaagctcctggagtggtccagagttggggtaactagtgatggtggtagtcactgacaaggatctggccaagattcctggagcacattcaacagtgcttggtggttgattagcttggggtggaggagggagacaaggataactcctttgtacaatggggatggtaacatcacctgcagtaggcaccattatggtaaagagacagaacagaacgtcagacacatataggcttaatatgtcctaattctgttagtaataaagactacctctgtgttcagggcagtgttgtttgtaatggcaaaaccgaaaacagtctaaatgttagtcaacaggagaatgatggataaatctcacggaggctatgccaaacaaaaaaaggcaagtggcaatatgatacaattttcataaattttgaaaatgcaaaacaattctacatatgatttagagacatgtatgcggttcaaagaaatgtttgggacttggatgaacaccaaattcaggatggtgatggggcaaacgttgaagagggatgtgatggggggaaggttcagggggcaaaaactgcaagttttaatgtgctttttatttatttttaatttatatatttatatttttatatttatttatatttttttatttatttttacttattttatttttttttgagacagactctcactgttgcccaggctggagtgcagtggcgcaatctgggctcactgagacctccgcctcctgagttcaagcgattctcctgcctcagcctcccaagtacctgggattacaggcatgcaccaccacacccagctaattttcgtattttcagtagagacgggtcttcaccatgttggccaggctggtcttgaactcctgatctcaggtgatccaccctccttggcctcccaaagtgctggaattatcaggtgtgagccaccgcgcctggccattaatgtgctttttaaaaacaacaacaaaagccattattttgaatttgtattcatgaagtattaaaacctaccaaatgttttaataaataatcttaaataggccaggtgcggtggctcacgcctgtaatcacagcactttgggaggccgaagcaggcagatcacttgaggtcaggagttcaagaccagcctggccaacatggcaaaaccccgtctctattaaaaatacaaaaaattagccaggcatagtggcacacacctgtaatcccagctactagggaggctgaggtagaagaacagcttgaaccagggaggcggaggttgcagtgagccaagattgcaccactgcactccagcctgggcgacagagccagattccgtcttaaaaaaaaaaaaaaaaaaaaagccgggcacggtggctcacacctgtaatcccagcactttgggaggctgaagcaggtgggtcatgaggtcaggagatcgaggccatcgtggctaacacggtgaaaccccgtctctactaaaaatacaaaaaattagccgggcgtggtggcaggcgcctgtagtcccagctactcgggaggctgagacaggagaatggtgtgaacccgggagacggaggttgcagcgagccaagatcgcgccactgcactccagcctgggtgacaaagcgagactccgtctcaaaaaaaagaaaaaagaaaaaagaaaaattagaaggccaggtatggtggctcacacttgtaatcctaccactttaggaggccgaggagggcagattgcttgagtccaggagttcaagaccagcctggggctgggcgaaaccccatctctactaaaaatgcgaaaattagacaggcagggtagtacacgcctctaatcccagctactcggggggctgaggcaggaggatttcttgagcctgggaggcggaggttgtgatgagctgagattgtgccactgcactccagcctgggtgacaaagagagaccctgtctcaaaaataaaataattaaatcttcaaaaagagcctccagaggctgcagggctctgtagacaccttgattctggcccagtgatattgatctcatactcctgacctctggagctataggaggatacacgtgtgttgttttaagcctctgcatttgtgctaatttgttacagcagccacaagaagtgaaaacatatggaatgtagtgctctgggtggccagggaggctgtttcccctcctttacaacactggacagccttgggggatcccctaacacatgcgcataacagttagtggtgcacaatgtgggggtgctatgcttcccccaggggacacgtgacttgtcctggataatttttttttttttttttttttgagacagagtcttgttctgtcacccaggctggagtgcaatggcacgatcttggctcactgccacctctgcctcccgggttcaagcaattctcctgcctcagcctcccgagtagctgggattacaggcgcctgccaccacgtctggctaatttttgtatttttagtagagacggggtttcaccgttttggccaggccagtctcaaattcctgacctcaggtgatccacctgcctcggcctcccaaagtgccaggattacagacttgagccactgtgcctggccccaggataatttttaattagcaacaaagtgagagttgctactggtgtctggtgggtggaggccagggatgctactaaacatcctacagtgtacaggacagtccccaccacaaagaatgatctagactgggtgaggtggctcgtgcctgtaatcccagcactttgggaagctgcagcaggaggatctcttgagcccaggagttcatgaccagcatcggcatcatagtgagattctatctctacaacactagataaaaattagctgaggggcccagtgcggtggctcaagcctgtaatcccagcactttcagaggctgaggcgggcagatggcttgagctcaggaggtcgagaccagcctgggcaacattgtaaaaccctgtttctaccaaaaatccaaaaaaaaaaaattagctgggcatggtggcatgcacctgtggtcctagctacttgggaggctgaggtgggaggatcgcttgagcccaggaggcagaggttgcagtgagctgagatcatgcccacggaattccaggttcagtgacagctagaacccatctcaaaagaagaaaaaaaaatctttggctgctttgcctgtggagtagtcattcttttattcctttgctttcgtttttttttttgtttttttttttttgagacagagtttcgttctctcgcccaggctggagcgcagtggcgtgatctccactcactgcaagctccgcctcccaggttcacgccattctcctgcctcagcctcctgagtagctgggactacaggcgcccgccaccatgcctggctaattttttgtatttttagtagagacggggtttcaccatgttagccaggatggtctcgatctcctgacctcgtgatccacccaccttggcctcccaaagtgctaggatgacaggcataagccacagcacccggcccctttgctttcttaataaactttttttgaggcagagtctcactctattggccaggctggagtgcagtggtgcgatcttggctcactgtaacctccatctcccaggttcaagcgattctcccgcctcagcctccctagtagctaggatcatgggtgcgtgccaccatgcccggctaatttttgtatttttagtagagacagggtttcaccttgttggccaggctggtcttgaactcccggcttcaggtgatctgcccacctcagcctcccaaagtactgggattacacaggcatgacccagccttcttgattaactttcaaaaaaaaaaaaaaaaaaagcctggcactgtggctcatgcctgtaatcccagcactttgggaggccgggacgggcggatcatgaggtcaggagtttgagaccagcctactcaacatggtgaaaccccgtctctactaaaaatacaaaaattagccgggtgtggtggcgggagcctgtaatcccagctattcgggaggctgaggtgggcagatcacctgaagccgggagttcaagaccagcctggccaacatggtgaaaccctgtctctactaaaaatacaaaaattagccgggcatggtggtacgcacccatgatcccagctagtagggaggctgaggcgggagaatctcttgaacccgggaggcagagttgcagtgagccaatattgtgccattgcattccagcctgggtgacaagagcgaaactccatcttaaaaaaaaaaaaaaaattagctgggtgtggtggcatgtgcctgtagtcccagctactcaggaggctgaggtgggaggatcacttgggcctgagacgttgaggctgcagtgaactatgattgagccaccgcattccaacctgggcagtagagcaagaccctgtctcaaaaagaagaagaagaagaggaagaagaggaagaagaaggagaagaaatagaatgatctagcacaagtgctggtggtgcagaggttgagaaacctggtctgtgagatgtattcctagaaatgcaacggctgagccaaagggtgtgtgcttttgaaatgctgtagatgtttccatattgcccagggctaatcttttttttttatttatttttattattttattttatttttttattgatcattcttgggtgtttctcgcagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacccctttctacacagacacggcaaccatccgatttctcaatcttttccccaccttccccccctttctattccacaaaaccgccattgtcatcatggcccattctcaatgagctgttgggtacacctcccagacggggtggtggccaggcagaggggctcctcacttcccagtaggggcggccgggcagaggcgcccctcacctcccggacggggcggctggccgggcggggggctgacccccccacctccctcccggacggggcggctggccgggcggggggctgacacccccacctccctcccggacgggcccagggctaatcttaaaccttgggatgtgctgtgacgtgggccagtgtctcagccaactcagatgttggtcgtgggtggtttgagtgcccacgggctctggaagctccccagtcctggagtcagcctgcggtgtgggtggagaagctggtttgtgaattcaaccagcagatcgctgtagggcaggcaatgcagggtccgttctgttcagtcagcagccctgttcttaccacctgccatgcactggatgcagggatgaaactgacatatctctgccctcactatgtttccagcctaatgggggagactgaccaggaaacaaactaggtgacacacactcagagggggcagtgagtgggttgcctggggaaggcaaggagggcttcagggagaaggtgacttttagttggaacaaaactgctactcattgttgtcatttgttgaaggctcaccttgcacccagcttcctagattagaggggtagccctttcttttattaccaaactaatgactaatgtagctttggcccccatggtgtgggattctgtgaaatccatttattttctagcttttttgttttgttttgttttgtttttgagatggagtctcgctctgttgcccaggctgaagtgcaacggtgtgatctcggctcactgcaacctctacctgctgggttcaagtgattcttctgcctcggcctcctgagtagctgggattacaggtgcgtaccaccatgcccggctaatttttttttttttttttttttttttttgagatggagtctcgctctgtcgcccaggctggaatgcagtggcgggatctcggctcactgcaagctccgcctcccgggttcatgccattctcctgcctcagcctcccaagtagctgggactacaggcgcccgccactacgcccggctaattttttgtatttttagtagagatggggtttcaccgttttagccgggatggtctcgaactcctaacctcaggtgatctgcccgcctcggcctcccaaagtgctgggatttcaggcgtgagcaccgtgcccggcctattttctagctttctggagagtccctgggctgtggagctcacacattctgcagcaggtcctccaccctggactgctgctccatcttgatcatgtagcctctgtcttcatgccatttctccaggttgtggtcggcacatcctagggagtattttattttgtctgaacaacagtgctatgtgcttggtaccatgatccccattttacagatgaggaaagtgaggcaaggggagcataagtaactgacttgcctgctgggattttcacactggcattgccaggctccacagtgggagctgtttgctggccatgctggcccctggggcaggggaatgaggaaggtgggggatggtggaacacagagatcaggtaagacagccagagatcaggccacaaagatggggattttgaaagtgttcttggcctgtgggcctagccccgggccaggagtaaggggctgggacagatgggagagctgattttgtcacttgggtctggctctggggcagagggggctggttgtccaaggcatgccttcccaggccttcaagattcctagggccttgggtctcacattattcaaaaagaaacctgggtgctgtggctcatgcctgtaatcccagcactttgggaggctgaggcagatggatcacttgaggtcaggaatttgagactagcctggccaacgtggtgaaaccccgtctccactaaaaacacaaaattagctgggcgtggtggtgggcacctgtaatcccagctacgcgggaggctgaggcaggagaatttcttaaacccgggaagcagaggttgcaatgagcccagatcatgccactgcatttcagccagtgcgacagagtgaaactccatctcagaggctgagtgcagtggctcatgcctgtaatcccagcactttgggaggccgaggccggtggatcacttgaggtcagttcaagaccagcctggccagcatggtgaaaccccatctctactaaaaatacaaaaattagccaggcatgatggtgtatgcctgtagtccccagctacctgggatgctgaggcaggagaatgacttgaacccgggaggcagaggttgtagcgagccgagatcacgccatcgcactccagcctgggcaacaagagcgaaactccatctcaaaaaacaagacaaaacaaaaaaaaaaaaaccccagaaaactccatctcagaaacaacaaccaacaaccaccacaaaaacatacttggttggcagcagtggtaatcccagtgttttggaaggctgaggcggaaggatcacctgaggtcagctaaagaccagcctgagcaacctagtgaggccttatctctacaaaaaaaaatggtaaaaatcagcccatcaaggtggtgtcatgcccatagtcttggctacttgagaggctgaggcaggaggatcacttgagcccagaaatttgaggctgcagtgagtcatgattgcgccactgtactccagcctgggtaacagagtgacacccagcctttttatttgtggatagctcaaagaagtcatttacaaaatgccttttgttttcaaagcacagcttttcataaaaagcaaggctcacatttaatagatgctctggtacataggtgtgtgttgagagccgctggggactcaggaagcccagcagccccgggatccgccggtggtcagaactcatcatcagaatcgtcatgggcccccctgcagaccttgaaggtccggggggtggtcagctgtcctggggaggccggggccaggttcacccagccgggcccgcggggcagcaggtggctttcattgagtctgatgacgcggtagttctcatagtggatgttgtgggttatgtccttcaggtcttggaggtgggagctgggggaccggagacggtcagccccgatggtggtgtccccagggcccctcgccagccccctagccccaggctccccacaccctcaccggataagcaggtctctcaggagaggaaattcacagtgcgccatgttctccactgcaagacatgggactcagtatgggcgctgcttagtgagcactgagtaagtgcctactgtatgcaccacctgacaccatttcccttagcccttttcccacatttctctttaccctatcctgccttccctttgttggttcattcattcattcacccactgttgtgttcccagtgcctggtacaggcggctcctacaaatagctgtagaatgaatgaatccaccaatcattattgtattatatgtacactcggcctctgtatccatgggtgcccactgtaggacttgagcatctgccgattttggtatccctgggggtcctggaaccaccctctgcggatagcatgggtgctatatcataggcaatagtatagtatatttctggctgggcgcggtggctcacgcctataatcccagcagtttgggaggctgagttgggtggatcacctgaggtcaggagtttgagaccagcctggacgacatagtgaagccccgtctctactaaaaatacaaaaattagccgggtgtggtggtataatctgtagtcccagctatttgggaggctgaggcaggagaatcgcttgaacctgagaggcggaagttgcagtgagccaagatcgctccactgcactccagcctgagtgacaaagcaagactctgtctcaaaaaaatatatatatatagtatagaatatttctaataattataataatacatcacctgaccgggcgcggtggcacacgcctgtaatcccagcactttgggaggccgaggcgggcagatcacgaggtcaggagtttgagaccagcctggcaacatagtgaaaccccgtctctcataaacatacaaaaaattagctgggcgtggtggcaggtgcctgtaatcccagctctttgggaggctgagacaggagaatcacttgaacccaggaggcggaggttgcagtgagccgagatcacgccaccgcactccagctcgggtgacactgcgagactccatctcaaaaaaataaaaataaaaaataataataatacatcaggggctacatcctcgctgcccctcctgtgtcactttccctagctccctaaggcagtctcctctccctcccgccacaatcgccttcactgtgcctccccgacctgtccttgtcctgtcagctctatggggacagggaccctgtcagtcctccctttaccgtgcactgcagtaactgcacatagcggtgcctgatacacagtaggcccatcgtaatttccggccagccactagggcagccttgggtattgggcattgtgcaaaatggtggttctccccgctccaacaccctaggaagttgatgcactgtgatgcccactttactgtgaggaaactgaggcccagagggtccggaaacttgccacagcctcccagctggaaagagggaccattccccagggctctttgtctagtgggcttcacctttctgtgccctgtgatgggtgcgaaggttgcccaaggctgctctggtttccaaactgaccccacctgcatcctacccaggggccccgcactgaccttcaatgatgccccacttggtcttccggcccaggacacacctcccgttcaccaggtgctcttggtcagcccctaccacggcaaaagggattcggtcctgggaaaggagaagacacagagatgggaggattgacttcgctggggagaagagaagaaaagtcaaggcacccaggcaggagaggggagtcctatccttttcgaggagggaacatggtagaaagtgcacagaattcccaagttcaaagacataaagtctaattggtgcctctggctgagtgaggtagctcttgcctgtaatttcagcactttaggaggccgaggtgggaggatcacttgagccctaggagtttgagaccagcctgggcaacatggtgaaaggccatctctgcaaaaactaaaaaattagctgagcttataatcccattatattatatagcgtattatatagctcacacctataatcccatagctcactgcagccttgacctcctgggctcaagtgatatccccgcctcagtcccctgaggagtgaggaccataggtgtgcaccaccatgcctggctactttttaaacatttttagtagagatgagttctctgtgttgcccaggctggtctctaactcctgggctcaagtgatcctcccgcctctgccttccaaagtggtgggattataggagtgagctaccacacccagcctgcctgtcttcctatatataaagttttattggcacatagttgagcctatgagtcatttttgtctatggctgctcttgaaccatgacatcagagttgaatcatcacaacagagaccctacggcccagaaagtctaaaacatttactacctggccctttgcagaaaaggttgttgaaccctaccgtaaactccagttgtttacttgctcatggccagaagcagaaattcaaacttgcaaactccgaagtgacatatatgggtttttacttctgaattcatctgtgatggggagtaatgtggatgttgataatattgggcgtggtggctcacacctgtaatcctagcattttgggaggtgaaggcaggcagatcacctgaggtcaggacttcaagaccagcctggtcaacatggtgaaaccctgtctctaggaaaaataaaaaattagctgggtgtggtggcgcatgcctgtaatcccagctactcaggaggctgaggtgggagaatcacctgaacccaggaggttggaggttgctgtgaacggagatcctgccactgcaccccagcctgggccacagaacaagaccctgtctctgctgggcacggtggctcacgcctataatcccagcactttgggaggctgagatgggtggatcacaaggtcaggagatcgagatcaccctggctgaaatagtgaaaccccatctctaccaaaaagacaataattagccaggcgtggtattgtgcacctatagtcccagctactcaggaggctgaggcaggagaatcgcttgaacccaggaggcaggggttgcagtgagcggagatcacgccactatactccagcttgggtgacagagggagactccatctaaaaaaaaaaaaaagaccctatctcataaaaaaaacaacattaaaaacaaaacaaacaaaacattgtacggtacgggggtttttagtatttgaccagggttatgcaaccatcatcgcaatctaatttcacaacgttttcatcacgtccccccaaaaaaaccccataccttttagcaatcactccccatttctcccttccccacagcccctgactaccaccaatctactttctgtctctatagatttgcctatgcctatttgggacatttcatataaatggaatcccataatacgtgaccttttgtgtctgactgatttttgtctgagaaacatgtttacaaggttcccccacgctgtagcaggcaggtgacagggtgacagtgcttcatttttttttttttttttgagacagggtctcactcccttgcccaggctggggtgcaacggtgtgatctcagctcactgcaatctccatctcctgggttcaagtgattctcctgcctcagcctcctaagtagctgggattacaggcatgcaccaccacacccggctaattttgtatttttaggagagacgggatttctccatgtcggtcaggctggtctcgaactcccgacctcaggtaatctgcccacctcagccgcccaaagtgctgggattacaggtgtgagccaccgtgcccggcctttttttttttttttttttttttttgagacagggtctcactcccttgcccaggctggagtgcagtgtcacaatctctgctcactgcaaccttcaccttccaggttcaagcaattctcctgcctcagtctccccagtagctgggattacaggtgcgtgccaccacacgcagctaattttgtatttttagtagagacagagtttcaccatgttagccaggctggtctcgaacccctggccgcaagtgatctgcccacctcagcttcccaaagtgctgggattacaggcatgagccactgagcccagccttgaactgtacacttttaaagggtgaacttcattgcttttcatggttaagggatagtccatggtagggaataggccgcactgtgtttccccactcatctgttgatgcatatttgggttgcttccactttcggggctaaaataaataatgctgctgtgaacattcacgtacacatttttctgtgaatgtacatttttgtttcttttgggtatacacgtaggagttcagttgctgggtcatagagtaactgcatgtttaagcatttgaggaaccaccagactgttttccaaagtggctgagccattttactttccctccagcagtaggtgagggtttcagttcctccacatcttccacagcacttttttttttaagctggagttttgctcttgttgcccaggctggggtgcagtggcgcaatctcggctcaccgtaacctccacctccaagattcaaccgattctcctgcctcagcctcctgagtagctgggcttacaggcacccaccaccacgcccagctgatttcttgtatttttagtagagacggggtttcgtcatgttggccaggctggtctcgaactcctgacctcaggtgatccacccacctcggcctcccaaagtgcagggattacagggctgagccactgcgcccggccaacacattttttttttctgagatggagtttcactcttcttgcccaggctggagtgcaatggcgccatctcagctcactcactgcaacctctgcctcccagtttcaaaattctcccgcttcagcctcctgagtagctgggactaaaggcgtgcaccaccacacccagccaattttttgcatttttggcagagacaaggtttcaccatgttggccaggctggtctccaactcctgacctcaagcgatctgcctgcctcggcctcccaaactgctgggattacaggcgtgagccactgtgcccggcccaatgttctctatatattcaggatacaagccccttattgggtatgtgattcgcagacattttctccgattctgtgggttgttagtgtgagctgttatttcttgctcaccttgagcttgtggatgagtagagaatcatatctgctaggaatatgtgcacatttccctgagatgtagagaaagatgagtctttggatggaaaggatgtgtgggaaggaaatcacctcgcccgcctcccgccccacagcctctcacccgtaacttgctgttgaggattttgtcattgatgtcctcgtcaaagcacatctgggggtagacgtcgatgcagtgggtcctcaggttctgctggatctggagatcccacacaggtgacctcagcccaccctgcccactctgccctctgcccccgctgaccccagccctgcccgggcatccagatcaccctgcgcctgaaggcctctcgctcctccatggtcaggctgtcggccctggcaatcacgggcaccacattcacagtccggcacagccgctgcaggaactcaatgtccaggggccgcaggctgccggaggcagggcagtgatgggggtggcggtggtggtgagtgtataaacgacagcagcagggcacgggggtgggggcagccggcagcccatggtggggaccccttctcctcctccctgccccgtgcaggtggtcctcgccttgcaggtgcagccccctcaccagtgcccagtgggtggtacaaagtacacgcagcagtgcacccgggtgtctgggatgtggcgctggcgggtgatgaggatctcctcctgcaggtactgctcgtattgctcgttgatgtagcccaggatggggtcccagctgaggcgggaggtggaccctcccctcagaactgtgctgtgcccagagagccccacccctctcctctgtgtcctctgggcggtcctcccttgggacgacgaatcgtcccggttggcccgggacctgtgggtcaccccggtactttcccccacttccctgcatcatcagagacacacagggagacctcctgccattctcggcttcactgtctgtaaaatggagacaatagtagcacctacgttgcaagtaagggaggggtgagcattaactgtattaaagggccacagctgggcccaaaccaccaaggaatcgcgcctgatggttgcaggggtctccctcctcctcttcgagtcccttcccctcttgggtattgtcaacactgtaagtagccaaacagatccttttaaaaacaggtgtcaggccaggcccgatggctcatgcctgtaatcccagcactttgggaggcggaggcaggaggatcgctcgagcccaggaattcgaggctagcctgggcaacatggggaaacgccaactctacaaaaaatacacaaattagctcggtggggtggcacgtgcctgtggtcacagctactcaggaggctgaggcaggagggtccttgagcttggggaggtcaaggctgcagtgagccatgatctcgccactgcactccagcctgggaaacagactgagacactgtctctaaataaataaataaataaataaataaataaataaataaataaataaaatgaaaccagggccaggtgcggtggcttatgcgtgtaatcccagtgctttgggaggctgaagcaagtggatcacctgaggtcagtagttcgagaccagcctggccaacatggggaaatccccgtctctactaaaaatacaaaaattgggccgggtgcagtggctcacacctgtaatcccagcactttgggagactgaggtgggcggaccacccgaggtcaggagtttgagaccagcctggccaacgtggtgaaaccccgtctctactaaataaattcaaaaaagtagccgagcgtgttggcggatgtctgtaatcccagctacttgggaggctgaggcaggagaattgcttgaaccccgggaggcggaggttgcagtgagcagagattgtgccactgcactctggcctgggtgacaagagcgagtctgtcttaaaaaaaaaaaaaattagccggaaattgcttgaacccaggaggcagaggttgcagtgagccgagattgtgtcactgcactctggcctgggcgacaagagctagattctgtctcaaaaaaaaaaaagatcacacagcctggctgttccaggtctggggtgtttcccaaaggttgaagggggaggggcacggacaggaggggacagccatggcttggcccccacctttgagaacccaccacttgttgcgggcacagtggctcatgcctgtaatcccagcactttgggaggccgaggcgggtggatcatctgaggtcaggagttcaagaccagcctggccaacatggtgaaaccccatctcaactaaaaatacaaaaaaaattagctgggcgtggtggcgggcgcctgtaatcccagctacttcgggaggctgaggcaggagaatcacttgaacctgggaggtggaggttgcagtgagccgagatcatgccattgcactccagcctgggtgacaagagtgaaactctgcctaaaaaaaaaaaaaaagagagagaacctaccagttgtcattgttgatctggtccccgaagccgggcgtgtccgtcaccgtcagcttcagcttcacacccttctcctctatgactgtggagggagagcagagtcgggagagactggacccaggtgggatggggtggggcagggtggggtgaggtgtgggcaggggctcactcaccatgggtcagtgaatgcagctgcagcgtctggggtgtgggcacccccaagcccggtgggtttgacttccacactttggacttgaacagcgtgttcaccatcgtggacttgcccagcccgctttgccctgggagtggcaaccggatgacagcagttagggtgggcgttttaggcagtttttctctaactctttacttttctattttatttttggagacaggttctcactctgtcacccaggctggagtgcaatgatgcaatccccgttcactgcagcctcgaccttcccagactctagtgattctcgcacctcggcctccctagtagctgggactgtaggcacacgccaccatacccagctgatttttgcactgctttttttttttttttttttgagacgcagtctcgctctgtcacccaggctggagcgcgatggtgggatctcggttcactgcaagctccgcctcccagattcacgccattcccctgtctcagcctcccaagtagctgggactacaggcgcccgccaccacgcctggctaatttttttgtatttttagtagagacggggtttcaccatgttagccaggatggtcttgatttcctgacctcatgatccgcctgcctcagcctcccaaagtgctgggattacaggcgtgagccaccacacccggccttgcactgttttttaatttttaagacagggtctcaatctgtcacccagactcaagtgatcgcagctcactgcaacctccaccctcaggttcaaacgatcctcccacctcagccccccaagtagctgggattcaggtgcatgtcaccatgcctggctaatttttaaattttttttgtagagatggggtcttgctgtgttgcctaggctggtcatgaactcctggcctccagggatccttctgcttcagtcttgctctgtcacccaggctggagtacagtggcgcaatctcggctcactacaacatctgcctcccaggttcaagcaattctcctgccttagcctcctaagtagctcctaagtacaggcgcccaccaccacgcctggcaaatttttgtatttttagtagagacggagtttccccatgttggccaggctgttttcgaactcctgacctcaagtgaccctcctgccttggcctttcaaagtgctggaattacaggcttgagccaccatgcccggcctcatttttgtactttttgtagacattaggttttgctagtctcaaactcctgagctcaagtgatccacccacctcagtctcccaaaaccctggattataggtgtgagccaccgctccaggcacatttttgtcttttaatgactcagcatttctcaaattttcaatgacaacatccctgtgaggtgctattatcaggcccacctaagagatggggaggggcgacaggctgccaaaggtgaggccacacgcccaggcacgcgtagcactgtgggtctgtcctgccgtgggccctacctctcactcacccaccaccatgatgttgaactcaaaccccatcttcatagccttgatcttcagctggtccagcacagcctcaatgcccacaggaccaagcatctcgcagggtggggtgctggggctggagggctgcgaggacaggcagggagagggggagcgcctcagggggtccatgggggccaagggttcgagatgcctgtcaccaggtgggtggggagaagggggtcactggggctcagaggagcccacattgacctctcctatctgaacccctatttgagcttggccgttggccaaccccctccacacttcatgcctctggtgtaccctaagtgcctgtagtcccaggggtgtggcaagggtgcctgtggggagctgtttctgcagggtgcctcaacacccatccagagaggctccgctgcccaagggtctgccctgtccccacctacagcccaggcaggggcctctcaggtcgcttcccccagcagagcctggagggccaggcaaagtccaggatgggtgtttgcagccaggctggagtcctggaggggcttcagggagtgtgtatggggtgaagtggctcccgtcccagcaggaaacttgggcagggggctcaggaggaggtgcccccactttccccagggggacacacagcagagttgatagagagcgagaaagacggcacaggcatgaaggtgacggagacagagagagagagaccaaggtcaggcagggaagatggctgggagggagcggtgcgaagagcccacggggggcagagagagagagaagcagcctgctgtgacacctggtggacgtgggtcctggtggagcttccaggagctgccttgtcctggcagggcctggtgtgtgtgatgggggaggggagagggtgacagttaaccgaagaatctgagctccatctgcacttgctgtgacccccacctggaggcttctctgcagcaggagcaggagctgttacccttctaatccccacaatgaccccagcctaataatacaataatccccaagtagaaccaggggcccaaggccccctcgtcagctgggctcccacctccaagctgacgccctcaaccactctgctggggtgagcaaacccaggccccacagctggctagcgggatatccgtgtccacgattggcgccatgtgttttaagttgcagcgtcaaaaacatgaagagattgctttagcaaatatttacccagtcctgactctgcacatggcatcgttctaggagcccaaagatgttaacttgtttaataatcaagccctgtgaagtaagtgctgttactaccccaagctgatagataagagagggtcaggtgaggaggtggcagagtctctgccgctctgagtctgtgtgctcaccctctactgcctttttctggtttacagaaacatctagatttccggtgtatcttagaggttatcaccctgacttgagatgccctctttaaataggccatgtgctttccagactgtggtcctcacccctgccttactgtctctctgataagctgtttctttttttgttgtttgtttttgagacagcctcgctctgttgcccttgctggaatgcagtggcgcgatctcggctcactgcaacctccgcctcctgggttcaagcaattctcttgcctcagcctcccaagtagctggattaccggtgtgcaccaccacgctaattttgtatttttagtagagaaggggtttcaccacattggtcaggctagtcacaagcttctgacctcaagtgatccaccaaccctggtctcccaaagtgttgggattagtgagccaccatgcctggcctttttttttcttttttcctttttttctttttttttttgagacggagtctcgctctgtcacccaggctggagtttagtggcatgatctcggctcactgtaagctctgcctcccgggttcacgccgctctcctgcctcagcctcccgagtagctgggactacaggcgcctgccaccacgcccggctaattttttcctatttttagtagagactggttttccctgtgttagccaggatggtctcgatctcctgatctcgtgatctgccctcctcggcctcccaaagtgctgggattacaggcgttagcccctgcgcccagccctttttaaaatttttttgagacacggtctcactatgttgcccatgctggtctcaaactcctgggttctagtgatcctctcacctcagcctccctaaatgctgagattacagacgtgaaccaccatgcccagcctgataagctgtttcttataccaagtccatctcacacagttaattctttcttgtttcctggtacttgacttcacaaggcttaggcattcctgtgtccttgctattggcaaatgttttctctttcttttttctttcttttctcctttcttttctttcttttttttttttcttttttgggacagggtctcactttgtcacccaagttggagtgcagaggcacaatgacagctcactgcagcctcgacttcctgggttcaagtgatcctcctgccccagcctccctagtagctgggacttcaggtacgtagaccatgctgggctaatttttttactttttgtagagatgaggtctccctatgttgcccaagattgtcttgaactcctggggtcaaggggtccagctgcctcagcctcccaaagcgccaccacactcaggctggcaagtgttttctgtaaagggccagatggtccctattttaggctttgctggtcctaagttctctgttgcaactactatgcaacttttcattgcagtgagaaagtcgccacagacaataggtaaacagatgggcgtggctgtgtctaagtaaaaccgtattcacagaagaaaggtggccgtggttccagctttcctgagccccaggccgacttctgccctttgctgtccactaccttctgccagttcttccttctggggaactcccgctccttcctggaggcttaaccttaaaggcttagaggctaggggtcagccaggtgcgttgactcatgcttgtaatcccagcacttcaggaggccaaggtgggcagatcacttgaggtccggtttgagaccagcctggccaacatggcgaaaccccatctctactaaaaatacaagaattagctgggcttggtggcgggcacctgtagtcgcagctacttgggaggctgaggcagggagaatagcttgaaccgaggaggtggaggttgcagtgagccgagatcgtgccattgcactccagcctgggcgacagagtaagaccctagctcagtaaataaataaataaataaataagtaagtaaataaataaaggcttagaggttaagggtgggccaggcagggcccagggtggcagggacgatggggcacagcctgtcctggaccacagtttgttgtccaaggtgaaatcttgaaaaccacaattccacagcccttgagggattcagcacgggggcctctcccataagcagctgaggatgtggttagtggatgaacaaatggctctggtgatggtgacgtgtggactgcgtttgagcagtagacgtacctctggggatgtcccctaaggaaatgcgcctctgtgcagagaaaacactttctccaggaaaatcctcccatgtgagcgatggtctaattctgaaaatcgtggcggtgaggggaggagcctcactgggtgccagtagggactgcaccatgtaagtgccgtcaaaggagtagtttgcagaaagcatgctgtcatctggaaggtgctcccggtggtgttgactggcaaaagccagggaaaaaacgatctatgcagcgtgactatggtggaagaggacaaaagcctggatggaatcacacgtcaacacggcgataatagcacagggcattcagtgcacgtttctgtgagccttccatcatgcttcgacggctctgacatcgatgatcagttcatttcatcctcacgacactgggaggaggtggatactattaacatacccattttacagatgagtatactgaggcagaagggctcagggaacgttactcaagctcacacattggtgggtcttatggcatgcaatcgaacctgggtccagaagtctgactcaccggaaccactccctgccacagcctcctcctcctgttactgtcctgcctgggactgggcggggctctgtgacttttgtcttttttgttttctgagacacagtctcactctgtcacccaggctggagtgcagtggcgagatcttggctccctgcaacctctgcctcccgggttcaagtgattctcctgcctcagcttcccgagtagctgggattactggcaccaaccaccacgcccggctaatttttgtatttttagtagagacgggtttcgccatgttggccaggatggtctcgaatttctaacctcaggtgatctgcccacctcggcctcccaaagtgcttggattactggtgtgagccaccgcgcctggcctgactttgtcttttaacaacttggtggtttccagatcttctttaagagatagatacgactttcataatagtaacaacaaacattagaaacaaggtacccagagagacaggaagactgagggccagaggggagaggaggggacagtgggcctcctgcccacccagccaggccaagagctggagcaggggccacagttgttcccctgcacttttctttttttttgagacagagtctcgctctgtcgcccaggctggagtgcagtggcgtgatctcggctcactgcaagctccgcctcccgggttcatgccattctcctgcctcagcctcccgagtagctgggactacaggtgcccgccaccacgcccggctaattttttgtatttttagtagagacggggtttcaccgtgttagccaggatggtctcgatctcctgacctcgtgatctgcccccctcggcctcccaaagtgctgggattacaggcatgagccaccgcgcctagcctcccctgcactttttaaatagaagtatgtctgctgggcgcggtggatcatgcctgtaatcccagcactttgggaggctgaggggggcggattgctagagctcaggagttcaagaccagcctgaccaacatggtgaaaccccgtctctactgaaaacacaaaaatcagctgggtgtggtggtgcacgcttgaaatcccagtgattcgggaggccgaggcaggagaatctcttgaacccaggaagcggaggttgcagtgagccgacatcgtgccattgcactccagcctgccagcctgggtgacagcaagactccgtctcaaaaaaaaaaaaaaaaaaaaggccaagcatcgtggctcacacctgtaatcctagcactttgggaggccaaggtgggtgaatcacctgaggtcaggagtttgagaccagcctggccaacatggtgaaacccagtctctactaaaatacaaaagttagctgggcgtggtggcaggtgcctgtaatcccagctactcaggaggctgaggcaggagaatcgctcgaacccgggaggcggagattgcagtgagccgagatggcgccactgcactctagcctcagcaaaaagagcgaaactctgtctcaaaaaaaaaaaaaaaaaaaaagggagggaggaggattagagtcagaggaggagacgtgagcctggaagcagagggtggagggatgggagaccacaagcccaggaatgccaccaccctctagaagctggacaaggcaaaagatggactctgccctagaaccttcaggatgaacacagcctggtcgacccattttagactctgaccttcagaaccatagggcaatacatttgtgttgtttgaagccacagagtttgtggtagtgttacggcagcattgggacatggatacattaggtgtgtgacgggctaatggctaaacttctctaggcctccgtttcctcatctgtaaaatggaaaaagcaataatacccactttaggattgctatgaggaataaaccaggtgacacagcacagtgctcgatgcagagccccacattagctgatattttcaagtagtaaaatagagaaaataaggacagtgaagagtcctagtacagctggccttccgtatccacaggttccacatctgtggcttcagccaaccacagacagaaaatatttggaaacaaatcacatctctattggacatgtacagacttttttgcttactgttccctatacaatgtaacaattatttacctagcatacattatattaaataaatatatgtatacaattttttcttgagatggagtcttgctctgtcacccacgctagagtgcagtggtgccatcttggctcactgcagcctctgcctcctgggttcaagcgattctcctgccttggcctcccgattagctgggattacaggagtatgccaccgcacccagccaatttattttttttgagatagtcttgctctgtcacccaggcgggtgtgcggtgacatgatcttggctcactacaggctccgcctcctgggttcaagcgattctcctgcctcagcctcccaagtagctgggattacaggtgcccgccaccacagcggggtaatttttgtattattattattttttgagatggagtcttgctctgtcacccaggctggagtgcagtggcgagatctcggctcactgcaatctctgcctccagggttcaagcaattctcctgcctcagcctcctgagtagttgggactataggcgcgtgccaccatggccggctaattttttgtatttttagtagagatggggttttaccgtgttacccaggatggtcttgatctcctgaccttgtgatccgcctgcctcggcctcccaaagtgctgggattacaggcatgagccaccacacccgaccaatttttgtatttttatctttttttttttttgagatggagttttgctcttgttgcccaggctggagtgcaatggcgtgatctcggctcaccacaacctctgcctcccgggttcaagtgattctcctgcctcagcctccctagtagctgggattacaggaatgtgccaccacgcctggctaattttgtatttttagtagagacatggtttctccacgttggtcagtcaggctggtctcaaacttctggcctcagctgacccgcctctgcctcccaaagtgctgggattacaggcgtgagccactgcgcccggcccaatttttgtatttttagtagaggtggggtttcgccatgttggccaggacggtctcaagctcctgatctaagtaagtgatctgcccaacttggccttccaaagtggtgggattacaggtgtgagccaccaggccaggccaaatatattaagtattataagtaatccagagatgatttaaagtatagagtatatgcacaggttatatgcaaatactgcctcattttatatcagggagtttatagcatctgtggattttggtacccacggaggtgctggaaccaatcgttgaggattccaaggacaactctatgatgcaggcacacctgtcctagctgctcaagggtcgtgggatgcaggtaggttttctcccccttccccctccctcccacccaccttctctcccatctctctctctttcattcacgaagtcagcagtggccaagcacacaggtgttcccagctgcatatctgggatactgaggaaaggtaagaagtctcaggagtgaagaagccacaggccggcgtcttcctccctgggcctccagcagtggggagccagggagcgcacctgctgggcctgggccctctcccctgggctgggcggcctctgctggccctggggagggcggggctggttgccaaggcctcaggtggtgtggagccggaagcaggaagcagcctgtgctccccaggacctgcctggttgggggaattggaggcttctaggaggtaggtgggggcctgggggctgggctgccagggggagagagaggggagatgacagtggctggggagaaggttgtcagggtaaggaccacagggctgggcaaggagagaagctgggcctggggccgagggagaagtggagtgggagggggtggggaagctggcgctgggccaggagcgggcagtggctgggctgtgggaagcctggatgtggtccccgctgagctgagcccaggatcctgatgcagcctctgggggaccggggcaggtggcacggtgcacgccaagatggctgtgtccacagaggagctggaggccacggttcaggaagtcctggggagactgaagagccaccagtttttccagtccacatgggacactgttgccttcattgttttcctcaccttcatgggtaagtgtggctgtggcctctgggtcctcccagccccctgccctgggctccaggttggggccacacctggacgcctgtcctgtccccaggcaccgtgctgctcctgctgctgctggtcgtcgcccactgctgctgctgcagctcccccgggccccgcagggaaagccccaggaaggtgagcccctggaaggtgagccctgccggcctctgggacctgcacggaactgtactgggggtggaggcggaaggtgaggggagtggcgggaagggtgctcatccccctagggaacaacgagcgaacctgcttggtcccgctgtgcttctcgtgcaggaaagacccaagggagtggataacttggccctggaaccctgaccctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctgggaggggagctggtctcaggccgggcgcggtggctcacacctataatcccagcactttgggaggccgaggtgggcggatcacgaggtcaggagatcgagaacatcctggttaacgtggtgaatccccgtctctactaaaaatacaaaaaattagccgggcgtggtggcgggcacctgtagtcccagctactcgggaggctgaggcaggagaatcacttgaacccgggaggcggagcctgcagtgagccgagatcgcgccactgcactccagcttgggcgatagagcgagactccgtctcaaaaaaaaaaaaaaagactcggtggcccaaagtcccaggtagagctcttgtcgccaccccatgggcttcttggcagcccgagggtcccctctcgacagtaggttctgtgccctgccctggcatggcacagggaacgcggaagccaggctccgggaataggggagacggctggctcctgaagctcatggccactgactaccagagaccccctgcctgggttcccactcagacagacagacaggggctccaggtggagtctgatgatctttatttcttagacagccctggactggggctatgaaacacagtcaccagcactatactcactcctagggtggctctgtctgtggcgttcctcaccatccccgggactcatagctcagtgccaccccccgacaccatgccctccagggggaggggacagcgaaggggagaggagggagagccctgcgcctggccctgtcctgagtccaaagattcccatggtgatcagagggcggtgttgggaatgtgggacacccttggccccgcctccctgacctccccactaccccaccaaaccagccttccttcctcctggcacttccagtgtccattcccggcagtgcaaatgtgttaggtggggtagggggtgggatagggagataaatagcagcctggcgttggcactggctggtgctctgtggtgggtatgagtaggggacggggccgccttcctggagacaagctcctgggtgctgtgatcagaagggtctgtagctccagtagctggagaacacggagatctgcaaggggagagggtgctgtaggttgctgaagggggatggggtagcccaggggagatgtcaaggtcacccaaggacaatatgtcaggacagggcattgctgcctcgcagtgctgtggggtacaccagaccccaaggttggggcgctctgagggtgtggcaaggacccttagaagtccttcccctaatgaaggcgctcggcccgggcccaccttgtccttgagctgctggcagagctgcagggagacggtgaagtagaccagggcgtcgttgagccaggggatcacgcactccactttgtgcacgtggctcacctccaggcgctgagagccccactcgctgtgggcagtgagagggtccctgaggagggtcccggccctccaggtgtggagggatggggtgggcgtgcctggaccccccgcccctgcctacttacaacatggccccagggctatgcagcaccgcgcccccagctgggcggaagttctagggagaacagcaccagacccgtcaggccttgcagggcgtgtgcatggcgggcagtgggccgggcaggggtccctcctcaccttggtggagttgggctgcagggcatgcagctggtacaccgtgaggcagagcttgttgaggttgatgtagacgttgaccagcaggtcggacggcagggcaggggcgaacatccgctgcgggaggcaggtgggatgaggccctcgcaagcccccagcccaggctggatggagcggggctctgcagtcactcatggagtctgcaggggatcccagtccccaccccagagatgctcttctcatcaatgggggcttccagacttttcccaggtgccccaagtatctcctgtgctgtcaggtttgggaaccactaacccgaaacagggttaacgtattttaggggcacaggacggaagccaaggaccccatcccagaaacctgcctagacagaatattccacctataatctgggagtggcacccctccgcgtccatcctgagggcaagctgggacccactgtgggacccctctcctgcagcaggggctggcaggggcactgaccgtgaggccgctggcggcgatctcggggagggtgagggtggcgggggtggtgagccggtttcgggctctggtcagctgcagcatcactgcgtccatcagctgcagggagaggcggggttggctctgcgtcctcccgtgtccccatgcattaaggaacaacagacatggtagctcccactcccacccagcccagtggctactgttcccaggtcccgaaacccggcagcagggacctgttaaagacaggtagttgggctccagctgggtatggaggagggcaggatgtctgcactaatgtcagtcgggatggggctgattcactgcacggggatcctgggtgctggatcaatggggaatggaaggtcctgggaggtcagtcccaggggcacaggctttgtggacaggggtacaggcaacaaaggttggttgtaaagggccagagagggcttcctggaagaggcgatggatgactgggttgaggttttcaggggggtaagccagggtcacggctgatggatggtgggaccacctggagcccattccttccctttgccgtggagcagagccctggcagactcctcagagccccagctttcgtgccattcagccgtggccatgagtaccagggtgatgtggctcccaggaaacacgtaagagctgactgggggtatagggcctgtagcaccctagggtggttacagttctcgaagggatcttagtctatctggttctaagtgtgaggaaacagaggtccagagagggcaggtgaaccaccggaggacacacagcaagtcaggggcagaactcaagcatgaggtcaggtgcccaggtcagctcttcacatgtgccacgcggttaatgtgaaggctttcactgctgctaccggcagtggtgtgtgccgagtgcttactgggggccccgtgacctgaattattatggtgaacagtcactccagcttgcccctgaccccacaggtagaaatggagacacagagtcggcaggtaagtgcttacaggttgcacagctcaacgtggaggccctgggattggaacccaggtgtgattccggatcaagaacgtgggactaggcccaggagtcaggcccgggggcagctcaccttgaggacctcagcgcccgtcttgaactggtagctctggtcccggctggtaagcaggtaaatggcttggctcacatggtttctggcatcctggatctggaagcaggggtcatccagaggggtcacgccagcttccatgcggccaggaggggagagtgggtgctgcctgcctgccccacgtcattccactctccacactgtcatccctgtgccccagagggccaggtccacgccaggtgatgggcatctggcatcacctggggcaggcctggtctctgcccaagctgactgccccctcctttctaagggatggacacacagtaatgcccaagacaagagtctgtgcgagttgcggagggaagcaaacagggcgacaaggcaggggcaagggtgctgagatggagacagtcggggtggagggggcaggggaggaggctggggcccattggtacaggagctgccagggagcatgggcctcatccccagagccatggcaagtccctggaggctctgggcaagggagtgacttttcagagggcttctgaaccatctcatccagccagctgctgtggggactccacagtcccgatgtggccctcggggctctcaggccaggttctctacctccccacatggcgcagcctccagggcttcaggaaacgcctgcccccagctttgctgttaggaaacaccctcccaggcttgctgtggccacagatccccagggctagtccctctccagggaggccccgcggcaggcctgctgccgcctgtccttgtggctgagcactagccaggaggggcggggtcacctgctgcagcttccactgcttgtcctcccggaaggcgaagtgcagcagctggttgttccggggcatcttcaggttcacatcctgacaggcaagagtggggtgagctgggcagtgggggggcacctcctgccacagccactctgagcccttaagcccagggcagaaatggggtgtgtggtggttcaggccttggccgctgtatagggcagagggtctcccaatgccttggccgtttgggggttgaacagggaggtcaggaaacaggaaaccaggcccaagaagagccacaaagaagtgaaatggaaagaggtgaagaaaggggaaggggaagaggaaaggcagcctctgtgaggctctgtgcgaacggggtgcatctagtgtctacaaagggcaacagatggagcccaggaggggggcctccccccacgccttggtgcctggcacagagtcgggtgcagactggagttcaggcattggctgattcaactgtgatgtgtggccagcctaatccaccaatgcccatgtttcactggtccggacgccaggccaggccgtgtgcaaagaacccctctcctgcacctcttactgaatctgcacaccgatcccgggagaaggtgtgagggttgctgtcattttccaaaggagaaaactgaggccagagagatcaagggtcccgcccagagtcgcagggcttgtacagagagaaagtgggagctcccatgctcttccccattggcaggatgggaggggacagggccgggggactcaccgcctggctgagggcatccccctgcagagtcagcacacccttcacctggtctgtgctgtaacatgtggcgtcagagcggtgcctgtggtcacccccccaccacccagccctccctcccggcgggctgcccctcctgtcccatcgcacaaccagctggtctgcaggacagggctatggccatgcctcctaccccccaaggtacccatttccccggtttccgcctagcccaggctcacccacagctgcctaggatgaagttctcttgcttggcgggcccctcagtgccggagcccggcagagtgaagcgcagagaggcctcctgtggaacagagggaaggaggggagctggtagcgcccactcaggcccggcccagtgctccttccagaagcccccctccctccaagtcagcggggggaaggaacaacgtggcctggcctcacctgggttcagctggggtgggaagaccctgcccaagcccccagggcacctaaccgtgagcccgatctctgcttataccacattccctgaacacctcctgtgtgcccgcctcggggaatacaaaacagacaggggcagcctcccagcttggttgagggggaaaggggcaaggggcagagtcagggaacaaggcagtagttatggtaacccgcggtcctgggccacagcaagcactacgccggttacttctgtgagctgcctggctcatttatctacaccccagcctcgcgaagcgggtactgttatctcccttttgccaatgagaaaagggaggcccagggaggttcagtgacttggctgaagtcacactgccaggcagaggcagaattcttcggctcccagattggatgccgctgctcccaaggcggccttccccgacccgaggccgggcgggactcaggcccttgctagcaccctcgtcgggacccgcccctgcccgcacacaggtacttatataatgaggtcggctcgagttcgcggaggcggggccctgcctgaaagccgcggcagccgcacactgtaggcgctcaggacgcagccgcgcggccccaggtggagccagggaaatgaggagggagggccgccacgcccggcggggcagggcgcgggtcgttaccttgaggatgtcctgcagctgcttcaacacagcgtgcacctcgtcgtgcagcagccagcggaactcctcctcctgcgggacagacccggcggtcgcgcccggccccgccgccccgccggcccgcccgctggcccgcgcgccttaccagcaccgcccgctccgccgccgtcgctgccatcacggtggccatggccgcaggccgccgccgagcgccctccccaccggccgctgctcctgtccaccaatctttctgtcctcggtcctccggtcctcccgtccgcccccggcgtctggctccgcccccacccgattggcggagcgggtaccaccccgcccccaggccggctccgtgctcgcgattggctggcgcctgtcggtccgcctcggcccccgaaacctgcgggagccctggaaccagactggcggctgcgggagtgaggctcgctccgcctggccagggacgcggccggcggctgcacgagtcaggcttgctccggctggccagggacgcggccggcaccagcctggggcgcccgcttgggggcggagctcccggggcgcccccaggatatgatagggcgctctgctccactcgcgctcactcattggccggcaggacagtctgtccccgctcctcctccctattggcccgcttggctccattggtcgtggttccaaccctgccgcggacctcgccgccactcccaagtccgtctcaccccggacgcggaggtcccgaaaacccaccccggccccgccgctgccttctcctcccacccatctcgccgaggacgagggaagcaggactcctgcggcacagctgtgttaccaagaagtgttttatttttcttgcagtagctttgttaattgcacaaaatcatgttttgtttttgccatttaaacattatcacacaatcctattctgaaagacaaatgttcattaaaaacaaagcaaaaataaaaattcacaaccttaattacctagatttgtcatttaaaggtttaaagaaaaaagggaggggctttcttacaagctttttcacaagtgtcacattttctccttaaaagggaaggatttcaaaagaaaggtgaaatagcttaaacagaaatattcataaaaaggaactttacagaattgtcaacaatattaagacaaaattgactaaccggtttcattaccgcatcttcccccgcccccacccccagtgtgttccgccaggactagaacaggctttgtgttcagacagaaatgcttcaaaatcccagtgaaatgaactgtgctaaaaacccgacaggcatcttccctgccctccccccactcgtcttctgcaatcctctaacccagtttctaatctctgaaaggggccaaagctgtgaggggggaaggaccccgccctagtgtggccaccctatatataattacatattgcatcgtaaatgctggccttccttctgcaaattatgattttggaaaatccaacccatgcagagggataaaaaactgacatcccttgggtaacttttttttttgcaacattccaagccccccccggtcccctatccaaggacaaatgtagggcctctaggatgtcccagacccacctcggagggccagtcagttcaggtaggtcaggcccagttctcttccctcccgacagaccccgggcccgggaagcaccgaagaccatgatgctggctggagtgaagacactcgtttccgtatcaagagctgagcctaagaaatgctcatcgttggtcaggctgggtctgggccaaagggacagacagaaagaaatactgtctccacgggaggaagagggagaggagggaggatggagagcggtgggcatgcaggggacttggcagggcagggtggagaaggtgggaccactgggaggggaccgaggtaagagtggctcttcagagccaggtgaagagtctgtggcctaacggaaacagaaaggagcgcccccaacccccactcctcttggctcatcactagtggccctgaggactccctcccaagggatggaatgcaaatccaaatactaaaacagcctagggaggagcgagcgcccgctgtggcagtggcatctggggcatggcttcgaggcggtgagggccgggcctccatgctcacctgcaggccggctgcttgctgcactccctggaaagccagggccccatcttctcgggactctgccagtctcttttcagttcacaaaggcgtctatggagcgctgggtgcacactggacgcttagacgtgaacatctttctcagctcatcacctgaggttggagggccccaagggcccctctgtctggagtctgtactggctcatctgggcccaaggcctctccttgtagggaatccagtgggggatggggacatgactacagcctcttcgctctgggggaagctgtgggaaggcttccaactctcgttgctgattctagttccttgactggaaggggtttgagataagacaagctcggaagaaaaaaagccaggcagcagtttctgggcagcttctatcctggggcgagagcctgtgtgtgtgtgtgtgtgtgtgtgtgtgtgtgtgtgtgaacacacagccacctcgtccggggggccagtgcccagctcaagagctttcccacacgccaatcctgctgacacttgtcccctccccaccggcctcaggggaagggtgctgctgtgtgctgtgctgatggcaagtctcaaagtctgtataaaaggaaatggagataggtgggctggtccagaatgaactcccaggcccccgaccccatgtgaggaagagggggtcagaggggggattggaggggtgagggcggggtgtcgacagcttagtgtatgtaggctcggtacacggcggacatatcgttgtcagactggtccagcgccttggctcttttgtacacctggaaaaaaaagagatggctcagtctctggccccagagctgccttcaagacctagacctgattcctggaggcagtggtggatgtggccagcaggcagtgctggagcccaggctgtccggttaggaatcctgtgttgaccttgcatgaagcacctccgtttctctggacctcagccactgtgcttcttgctctgggagaaggaacagtacccgggggatcttgtgagaatgaaatacactatgggatataaaacattcagcattggccgggcactgcggctcatgcctgtaaggccgaggtgggtggatcacctgaagtcaggagttcgagaccagccaggccaaaaaggtgaaacctcatctctactaaaaatacaaaaattagggccaggcgcagtggctcatgcctgtaatcccagcactttaggaggccaaggtgggtgaatcacgaggtcaggagatcaagaccagcctggtgaccgtcgtgaaaccccttctttaaaaaaaaaaaatacaaaaaattagccgggcatggtggcaggtgcctgtaatcccagctactcaggaggttgaggcaggagaatagcttgaacctgggaggcggaggttgcagtgagctgagatcacaccactgcactccagtctgggtgacagagcgagactctgtctcaaaaacaaaaaaagagcaaaactgtctcaaataaataaataaatgaataaaaaataaaacaagggcagatgaaacacccaggacacctatacctcagagtgagagttctcacacctgtggtgcttctgcccccaggggacatctggtaatatctggagacattttctgtcacctgaggaggagctatgtcactggcgtctggtgggtgggctacccaacatcctgcagtgcttggatagcccccccacacagaatggcagcagtgccgaggttgagaaaccctgccttaaaggatgagggagaggaagggggaaagaaatgcttctgtgtggttgcaaagtttttacatttaatgggaaatggtacaagattaactgtcttttttttttttcttgagacagggtcttgctctgttgcccaggctggagtgcagtggtaggatcatggctcattgcagcctcgaactcctgggctcaagcaatcctcctgcctcacctgcctcagcctcccaagtagctaggaatagggtgctcgccaccacgcccagctagttttttatttttttttgtacagatgggggtcttgctatgttgcccaggctggtctcaaactcctgggcttgcttaagcctcgaccctgcctcgaccctgcctcgacctcccaaagtgctaggattacaaggatcacaagtataagccactgtgcctggcaagattaactctatcttaaggatttataccgcaatctgtagagtaaccactaaaaaaagaatgcagaggcaaagtaaaaaagaaaatagataaatgaaactggaattcttttttcttttttttttttttgagatggagtcttgctctgtcgcccagactggagtgcagtggtgtgatctcggctcactgccagctctgctctgcctcccgggttcacgccattctcctgcttcagcctcccgagtagctgggactacaggcgcccgccaccacgcctggctaattttttgtatttttagtagagacagggtttcaccctgttagccaggatggtcttgatctcctgacctcgtgatccacccgcctcggcctcccaaagtgctgggattacaggcgtgagccactgcgcctggccccttttttttttttttttttttttgagacggagtcttggtctgtcgcccaggctggagtgcaatggcacgatctcggctcactgcaacctccgcctcctgggttcaagtgattctcctgtcccagcctccggagtagctggcattaatagtgcccgccactatgcccggctaatttttggtatttttagtagagactgggcttcactatattggccaggctgatctcgaactcctgacctcaggtgatctgcccgcctcagcctcccaaagtgttgagattataggtgtcagccaccgtgcccagctgaaactggaattctaaaaagaaagtaagaaaggaggaacaaacaaaagacaaagacaacgaacagaaatcaaatgataaaatggcagccccaaattgaaccacatatcaatacaactactaaaggtcaatgcaccagttaaccttcagaacctaacctctgaactcctaacagtatagagtctaagctcataccatccaaacgacctgaaagcagcgagctgcattgagaaattaacctaaaaactctgcttccaagccaatgaatcctgtagtcagggtggaggcaacttggaagtcacttcaaagagaagctttcccagcccaagccacatgaaacccttgggaaataactatagtcagaaatgagctttcatcaaaaaagacttataaaatacacaacgaattctactatccagagagaatccactggtagaatgaacaggggggacttgaaatagtaatgtaatctgaaagagtcatgaaataagtactctgaaatgttgaaacagacaagagacagaagacagaatttaggaacaaggctgcatgcggtggctcatgcctgtaatcccagcactttgggaggccaaggcaggcggattacttgaggccaggagttcgagtccagcctggtcaaaatggtaaaaccctgtctctactacaaatacaaaaattagccaagtgtggcggtgcatgcctgcggttccagctacttgggaggctgaggcaggagaatcactttaacccaagaggtgggggctgcagtgaactgagatcatgtcactgcactccagcctgggcaacagagtgagactctgtctcaaaaaaaaaaaaaaaaaaaaatacaattcaggaacagagaattatactatgaaaagccaggtgtcaaaagaacagtactggctgggtgccatggctcacgcctgtaatcccagcacttaggtaggctgaggtgggtggatcacctgaggtcaggagtttgagaccaacctggccaacatggtgaaaccgtatctctactaaaaatacaaaaagttagccaggagtactggcaggcacctgtaatcccagctactgtggaggctgaggcaggagaatcacttgaacccaggaggcagaggttgcagtgagccgagattacaccattgcactccagcttgggcaacaagggtgaaactcggtctctaaaataaaataaaataaaataaaataacataaaataaaagtgtatcagctgatagtactttaaaaatacagctgctgtttcacaaagtgtcatttttattataataatatggtaaagacaaatgtttttcagttgttttttttttagattcaaattctatgaagatgagctaagaaagcggaacttctaccctaaaaagcttttcgaaagtgtatgtgaagttggatacagttgtgcacgcctatagtcccagctactcgggaggctgaggtgggaggattgcttgagcctaggaagtcaaggctgcagtgagctataattgtgccactgcactttacctgggcaagagagtgagactgtgtctcaaatataaaaaaagtgcacgtgttaagtgcttaaaacatcatttgaaaaatgctaatagacatgctaattaaaaggcagatactgtcaaaatggataaaaatccaaaccccaattacatactgtctatcaaagccataatttagacataaataagagaggaaatggatggaaaaatatacataccatgaaaacaataagcctgagaaggctgtagcagctttcgtttttttttttttttttttgcgatggagtctcactctgttgcccaggctggagtgcagtggtgcgatctaggctcactgcaacctcccgcctcccaggttcaagcaattctctgcctcagcctcctgagtagctgagattaaaggtgcctgccaccatgcccagctaattttttgtatttttagtagagataggggtttcaacatcttggtcaggagaatgagaccatcctggctaacacagtggaaccccgtctttactaaaaatacaaaaaattagccaggcatggtggcaggcgcctgcagtcccagctactcaggagggtgaggcaggagaatggagtgaacccgggagacgaagcttgcagtgagccgagatcgtgccactgtactccagcttgggtgacagagcgaaactccgtctcaaaaaaaaaaaaaaaaaaaatcatacaggcagctggttgtggtggttcatgcctgtcatcccagcactttgggaggctgaggtggacggatcacctgaggtcagcagttcaagcccagcctggccaacatggtgaaacctcatctctactaaaaatacaaaaatcagttgtgtatggtggtgtgtgcctgtaatcccagctactcaagaggctgaggcatgagaatcgcttgaacttgggaggcagaggttgcggtgagccgagatcgcgacactgcactccagcctgggcgaaagagcaaaactctgtctccaaaaaaaacaaaaaaacaaaaaacaaaaaaacaaaaaaaacccaatacagggcagggcatgttctttgatcatagagcagtaagttaaaaatcaataatcattagatatctaggaaaacccaaacactagataaacttttaagtaattcatggatcaaagaagaaatcagaaaacaaattaacacggattagtggacatttaaagatttatatactcatgttataaagaaagcaggattaaaataaatgatttaagattccactttaaagggtttgaaaaagaacaaagaggccagacacagtggctcacacctgtaatcccagcactttgagaggctgaggcaggtggctctcctgaggtcaggagttggagaacagcctagccaacatggcaaaaccccatctctactaaaaatacaaaaattagcagggcgggttggggcacgcctgtaatcccaggctacttgggaggctacttgggaggcagaggcacaaaaatctattgaacccaggaggcagaggctgcagtgagctgagatcacaccactgcactccagcctgggcgacagagtgagactctgtctcaaaaaaaagaaaaagaacaaagaaaagctaaactaagtagagggaaggaaacgataaaagaaaaagaaacttggccaggtgtagtggctcacacctgtaatcccagcactttgggaggccgaggcgggcagatcacgaggtcaggagatcgagaccatcctggctaacatggtgaaaccctgtctctactaaaaaaaaaaaaaaaaaaaaaaaaaaaaaaaaaattagccgggcgtggtggcaagagcctgaggcgacagagcaagactctgtctcaaaataaaagaaaaagaaaaagaaaaagaaactgaatggctgggcgtggtagctcatgcctgtaatcccagcactctgggaggcagaggcgggtggatcacctgaggtcaggagttcgagaccagcctgaacaacaaggagaaaccccatctctgctaaaaatacaaaaattagctaggcatggtggtgggcacctataatcccaactactcaggaggctgaggcaggagaattgcttgaaaccaggaggcggaggttgcattgagctgagatcgcaccagtgcactctagcctgggtgacagagtgagactccgttaaaaaaaaaaaaaaaagaaagaaaaagaaactgaagggccttggggcttgggccacatctaccctacctcatttgctgcagctgccatgggagtcggatggttgaccgcatcacccagcgcaatggctaagcggagatccttctgaatgtatttcaggtagaaatcaggcttaaagtttccttgcaggatatctgaggagaaaaagccagtatcagacaaaagccaaggacctgaaactaaaaactacttacggtccaccaggtgtcagtacctaaaacatactcagggctcagttccacatagcctaggcctcttggctcctcactcacccttagacacctgagggctgcagctcccagcctatatccccaaatcccgcccactgtgtttctgaacctcctctggccagggtcagggactgactggggaggggcatctttcacgctcactaaatccctgacctagtaccctgctctaatcaaacaccaaatgcaagaagaggggccaaaaacaactcactttggcacttctggtccaggaagatgctggccaactgtccctgattgaggatgtccaagagtgtctgctgggactggcctgtcacgtgggccagggtcagcccctcggcaatagtggccatgaagctcccttggaccatgttcacgatcagcatcatcttggctgcattgcccacttcacctgcccagggtaaagactcacggtcacagcccaagaatgccacagacagggcttctctgtccaccctcacctctgctcagacccacctctctccaggggaggcccccttcacctgcccccgacagactggctcttcctccttccacgcactgactatgcaggtgaaaggaaaccttccccagggtccccggcagaaaggccgtgtgggactgacgctgtcatcagtgtgaaacagaggagatgtggccccaggctccaggcctgacaggtgcaggcgtgttacctaggaagaaggaggtcttccccatcgcctggaagcagctgctgcagtcctcatataagcccctgtctccagccgctaagatcaccaacatcccgtcattagacagctgctgattccctgagacgggggcttccagaaagcgcccccccctggacacaatcacctggaaagaaaagtcacagcttctggaggcctcccctctcccagcgctctctgggcaggactcaaggagtgttgctgagtggccacggctgctcatcaccttccagagctggaggggacggccacccataccaaggtcctttagctgacacctaaactcaggagctaaccatgtgcaggtcacacaggccgaatcacagcagtgatgagacgctggggtctccacacaggaacccaactgacttggaattttttttttttttttgaggtggagtctcgctgtcgcccaggctggagtgcagtggagcgatctcggatcactgcaagctccgcctcgcgggttcatgccattctcctgcctcagcctcccgagtaactgggactacaggcgtccaccaccacgcctggctaattttttgtatttttagtagagacaggtttcaccatattagccaggattgtcttgatctcctgaccttgtgatccgcccgcctcggcctcccaaagtgcttggattacaggagtgagccaccacgcctggccggaatttttttgttttgtttttttgagacagagtcttgctctgttgcccaggctggagtgcagtggcgcaatctcagctcactgcaaactctgcctcccgggttcatgccattctcctgcatcagcctcctcagtagctgggactacaggcaaccgccaccatgcctggctaatttttttttttttttttgagacggagtcttgctctgttgcccaggctggagtgcagtggcacgatcacagctcactgcaagctccgcctcctgggttcatgccgctctcctgcctcagcctcccaagtagctgggactacaggtgcccgccaccgcgtccggctaatttttttgtatttttagtagagatggggtttcaccgtgttagccaggatggtctcgatctcctgacctcgtgatccgcccacctcggcctcccaaagtgctgggattacaggcgtgagccaccgcgcccggactggaatttcttagagaccaacaactagaaccagatgtgaccatgtcaatggctcggctgaacacacacctcccctgtggatgctgccctcccctcagaacatatgtgggtcccaaagtccccactcccttatttgggccagatgctcggggaggagggatgctttgccagtgtcaaatgcagacagctgctcaaaccccaatgccaggcgggcggcctgggttgcttctcatcataaggctggcagctccaggacttgatgcccatcccagccatgcagcgactgcccatggctgttcagactagctgcggtttgaaggtggagcacgggataggctagtcccaaggctactcgcctctcctcttccctctctggctttggctctagagtaacttaactgcccactcttgtaagcctgggtcttgggctctgatagaaaagatgctggagagccagcccaaggaaggctgctacctgggccagctcagtgacggtgtcagcgtccactgttgacatgtccacgtagcacttcccagggcggatcccttgcagcacaccactggggcccagcaccagctgtggggacacaagggagaagcaatagcccaggctcccgggcagatgctcaggagccctacagacctcagatcagaatcctgctgctgttttggctcatttcctgatttctatcagctgaaaagggaagaacaatgaaataagcaagggatagaaaagtacttcccgcatgctcccatttatctttaaaaagaatctatgtgagtgtgtgcatttctttttatttaaaaaaaaaaaaaaacaaaccccatttaaaagaataaacctcagcatttactttggggacttctttggatttacttggattaggctagtcaccagtttaataagatgactaccacacttgaacttctaaaatatacaaatacagtgacagctaaacatagaagcttggcacctggaccaaaggcacattcagttccaaagcttctagttcaacaagaacacatgaagcctgttcaagacacatttcagcacagacttcaagggccctagtagtgttcattctttgatctgaattaaaggaagtctgtattcaattaatgcaaacacccttcacaatgggagatggcccctgatgggaaattcagccccccacatgtggacactcacttggtgtgcaggggaggaggggaagaggccagccagcaatcctggctgtgacccggagttgctgaggggagggagggggtccttacgtccttggccgccttgggatccgacacgcaggcgaaagtgatgtcgcaggttgagacgacttcagcgggggttcttcccagacgggccccctcctggatgaacaaatcacactgcaaaagtcacagatcctaacgtgagctgcaggcagtgcacaacaaacatgccagccaggccagagaattgctgaccaggcctcctggcggcctaccaaggcaggaggctgaggccgggagcctgggtcatggagataggagcccaacttttggggaagtgcacggggccttttactggccatcttcagtttttgcatgacgagtgcctaggatgatgaactgcttcacaagtgtctgctgaaggtatgctgtttcaagaatggggtatgaacagtagcacctctccccagcccccgctgtgctgtcctggctgtggccctgagctatcaacactctgctgggaatgtggggatgtcgctggaagccttccacctggtggccattcgtttttgggttgtttctcaacactgttgtcaggttaataagacttctggaagtgcctaaaaacactaccattttggctttttttttttgagacaaggttttgctctgtcacccaggctggagcacagtggtgcaatcatggctcactgcagcctcaacctcctggactcaagtgatcctcctgcctcagcctcctgaatagctgggactataggtgcatgccccatgtgtgatttttttttttttctgtagagacagggtttcaccatgttgcccaggctggatgggcctactattttctatcagacttttaatgttgtttatgattcacatttatctatattgttgtctttcataattctggcataattatggtttatagtggttgactatggaaaacttcactgagagatatactgtgatttacctaatggctgacctgtagtttgacacttagcccactttcaattgtaaaatcacatcaccaaacatctttacgtacaaaacttctctatgttttaaattcaggtctccacaaatagaataaaacaggttctaaaagttttaaggctctcaacaaatgtagacagatgacttcccaatgagactatgtcacttcataaagatcaccagcaagctctcctattatgccagtaccaagtatgtaatttaaaaactacaaataagtgcccataaatacatgtaaaattcttcctacctgatcatttaaccagtcaaaaaaggcaactgtttcattttttttttttgagacagagtctcgctgtcgcccaggatggagtgcagtggcacgatctcagctcactgcaagctctgcctcccaggttcacgccattctcctgcctcagcctcccgagtagctgggactacaggcgcccgccactgtgcccggctaatttttcgtatttttagtagagacggggtttcaccgaggtctcgatctcctgacctcgttatcccccagtctctgccttccaaagtgctgggattataggcatgagccaccgcacccggccttgtttgatatattttaattactcctgattaccgaatattttttatgcctttgtttcctcttttgtgagccatttttttgtcctttttcttttctgagacagggtcttgctgctgcctaggtgggaatgcagtggtatgatcacagctcactgcagcctctacctcctgggcccaagagatcttctggcctcagcctcccaagtagctgggactatagtaggcaggtgccacctcactcagctaatattttattttttgtagagatggagtctcatgttgtccaggctggtctcaaattcctggactcaagcaatcctcttccctcagcctcccaaggtgctaggattataggtgtgagcctattcttagatctaaaattattaattagcaccctactaatttttttgtcttaattatcaaactatgtttaataaaagcaacatattacccttcttacgtatttgctacaagtacttctagttggtattcctttgaattttatttttttgttgttggggagtattatcaaaaaaaatcaactgatcttcttgtgtgatttttattagttctagatttacaaagatctatgttagtatttattttcttctggttttcttttaaaaaattacttgtgggccaggcacagtggctcacacccgtaatcccagtattttgggaggccaaggcgggtggatcacctgaggtcagaagttcgagaccagcctggctaacatggtgaaaccccttctctactaaaaatacaaaaaattagccaggtgtggtggcgcgcgcctgtaatcccagctacttgggagtctgaggcaggagaatcacttgaacctgggaggtggaggttgcagtgagccgagattgtgccatttttttttttttttgagacggagtcttgttctgttgccaggctggagtgcagtgacacgatctcagctcactgcaacctctgcctcccacattcaagttattctcctgcctcagcctcctgagtaactgagactacaggtgaacgccaccatacccagctaatttttgtattttctattttttttttttgagacggagtcttgctctgtcgcccaggctggagtgcagtggcgcgatctcggctcactgcaagctctgcctcccgggttcatgccattctcctgcctcagcctctggagcagctgggactacaggtgcccgccaccacgcccggctaattttttgtattttaagtagagacggggtttcaccgtgttagccaggatggtctcgatctcctgacctcatgatccgcccgcctcagcctcccaaagtgctgggattacaggagtgagccaccgcgccaggcaaatgtttaggttttataataacatcctaagtttaggcatctacatctctacctgcctggactaaaagcttggcttctattctattgcacgcagaacgctgagacaacagggggagatgtccactcttagggttaccccagactccaccgatccaacaggcaccacccctgaatgcttactttctctgcagtgcggttccagacagtcactgtgtgacccatttttagcaagttggagacgattccacttcccatgagaccaaggcccaaaaatcctatcctgaaacagagagagactgatgagttcagggtggaaagggagggtcacggtgatgatgattccatgcagcacaaggctcgctcccttatacagcttggggtaggggaattcagactgccagaaacagcagtggccaatctacctgcagagccaggggcgtcatgcacatgggtcttctcttatgccatggtctaaagctgtcccaggatgtaaacaggcattttgaaacccctgactgtcacagaaaaaagtatgatgtgtatggttcagggccagtctcccagggcaaagtccccttgctgcccttttttttttttttgagacagtcttgctctgttccaggctggagtgcaatggcgcgagctcagctcactgcaacctctgcatcctgggttcaagcgattctcctgcctcagctttctgagtagctgggattacaggcgcacgccaccatgcccagctaatttttgtatttttagtagagacagggtttcaccatgttggccaggctggtctcaaactcctgacctcgtgatctgcccacctcggcctcccaaagtgctcggattacaggcgtgagccaccatgcccggcctcacactttacttattttttgagatagtgtcttgttctgttgcccaggctgcagtgtagtggtgcaatcatggctcactgcagcctcgacctcctgggctcaagtaatccttccccctcagcctcctgggtagctgagactacaggcatctgtcagcacacctaattttttgtggagatgggcttttgccatgttacccaggctggtcttggactcctgggcttaagggatccgcccacctcagcctcccaaagtgctggggttgcaggtgtgaaccactgcacccggctctggatactactttaaagcccaacagaatccaccacaagtcactgaagcactgtgtttagagccaggcaacttccttgactgcatgaaccaggacggcaattttcacctctctttcccaacttcaattctctacccacaccctacctttcccgtcttcccgttatcaacagaatgggccttgcctctcctctccaaagctaagtccttcacctgagcttggaacccaatctttcccagtccacaaatccttctccccatgcctgccttcccccaaacctctcactgttcccccagcccttccttccacaggtccttcccaatccttgtgacagaagcactcattggccagtctcctccacacacattcacatactccgcctgctccttcctgcaaccctgagagctgggggctggatgccactgctgctatttcaacatgcttttacggatgacttttagcttgccaaagtgtcttttcttgattcttgtacttcttcacctctctttgcaagtgacaatggtgcaaaagaatgcctttcctcatttctgatcatatcatgttcttgtttttatagtttttaatttttatttatttatttatttaaaaagagagatgggggggtcttgctatgttggctaggctggtctcgaacttttggtatcaggcaatcctctcacctcagcctcccaaagtgttaggattatgggcgtgagccactgcacccagccttttttctttttttagtgacagcattatgctgtctcccaggctggagtgcaggggggtgatcatagctcaccgcagcctcaaactcctgggctcaagtgatccttccacctcagtccacctgagcagctaggactataggtgcatgccaccatgtctggctaagttttaaaatttttttgtagagacggggtcttgctgtatttcctaggctggtcatgaactcctggcctcaagggatccttctgctttggtctcccaaagtgtggggattacaaggatgagctactgcgcttggccatgttttcaattcagaaattctctgactgctggatgtccccggcagctcctccactttgaccctgtcattctttccatagttttggtcttctggaaccatctctacaaatggacccctaatctcagctggaatatcagctgctcacattctccctgtcccagcctgtattaagtaatttgaatcacatgttgaaaatggaacccaccaactttctcaccaaaatagacctccttgctaactgcttcaagttgtggcttaaaaacaaggaggtacctttttgtcactcattatttgggtagtacaatattcccccatgattctaaatcatgacaggcgaattccctttcctttcttggtgttctaggaagtccagtagacctgggataaagcttctggatttttttgagacacagtctcgttctgttgcccaggctggagtgcagtggtgcgatcttggctcactgcaacctccacctcccgggttcaagcgattctcccacctcagcctcccaagtagctgggattaaaggcacccaccatcatgcctggctaatttttgtagagacagggtttcaccatgttggccaggctggtcttgaactcctgacctcaggtaatccgcccaccttggcctcccaaagtgctgggataacagccatgagccaccatgcccaggtcaaggttctggatttttaatatggcaactgagagtccttcacactgtgtctcagacaaaatggaaatgtggattaaggtgggttgggcaacaacaaaactggttggttttgatgctggcttcatactcttttattaaaagtttgactaatgggccaataaatgtgttgggtaaaaacatcaggactctgtcctcaccctatcctgatcatttttttatttttatttttttaacacaatcctcctcccctttgtttgcacctaatatgcccttatctcctccactctacagagacaagttcaccaaaaataactggtagcattagtgatttaaacagtacaaaaatatcatgtaaaagatgcactgtttttagtctggggaagaccatgtgaaaggtacaaactggaaactgactttagctaacttgctccagagaacgtgttttcctagaaaaggtatctttttgccaacaagactctgcggaggagacatgcctacagagcaggcacagaggcaaggctgggcgcaagttgggtctgggagcatgtccaggatcgccccacccacaccgggcagggtgcaggacagccagcaagtgctcagtgaggatccccaagcactttcatctcccttcccccacctgccccaccatggccaattttggggcctcatcatgattctactcagccagtggttctcacagcgtagctctgaccagcagcagcagtatacctgggaactggttaaaaatacaaattcttgggccccacccggacatattgactgagaagccaccttccaggtgactgtcaggcacaggaaagtctgagaaccactgagccaagtgctccttgctcttgagttctggagccaaaaaaatccctcagcttatgcccaagggagacccgaccacagatttacacagcttttgactcctgtctttatcgataagagttacaacatccccccaccttttccattcaatgccagcaatggctgggacacaacccttaaagaacccccctggggtcaccttctccccaccctcagcagaaccagagccactggaggccttttcatcaaaggtcctactttttgtctgtgggtgtgatgctgccattcacggctgtgctgtcagctgcctggatggaggtggagccagtttcctacggacaggaagcacacatcatcaagtcagtctgcctgcagtttaaggccccaggtgaaaattaaaatggggaggcatggagcctacatacctcttcacatattttcaacttcttcgtgattgcctggtaacagacagctggctaatgaaggaggaggaaagagactacttgtgctactgcaggcttaaccagtcttcataataatcccctcaaaggttagacccaaagtgggaagttaacatcaactatttgttttatactttagtgaactccaaattttacactagaaagttcatacacattacctcattcaagtccccatgcaattctaccaggtctttttgctgaccatggtgttgagaataagagtcataagcttggaacccacatctatccaactccaaagccacaaactctcatgagatcctagcacggctcaggccaccccataaccttgcagaccttgggaggacctccctctgcatccgcaggacttggagactacctcttggagtgagcttgaagatgtgtctgccatgcaatttcatggggtgctgacagcttacgatgtttggtttctgccctaaactctaaaggtcactgtgacagtctcaactacacagctggctgagttttaaatgctcttctgagatagagtctcgctctgtcgcccaggctggagtgcagtggcaccatctcggcttgctgcaacctttacctcctgggttcaagcgattctactgcctcagactcccaagtagctgggattacaggaatgcaccaccatgcccagctaatttttgtattttcagtagagatggggtttcaccatgttggccaggctggtcttgaactcctgacctcaggtgatccacccgccttggcctcccaaagtgctgggattataggcatgagccaccatgcccggcctttgggtttatttatcttttttgagacagagtcttacgctgttgcccagtctggagtgcagcgacgcaatcttggctcactgcaacctctgcctcccgggttcaagcaattctcctgcctcagcctcctgagtagctgggattacaggcacgcgccaccatgcccagctaatttttctatttttagtagagatgaggtttcaccatgttggtcagactggtcttgaatccctaacctcatgatccacctgcctcagcctcccaaagtactgggatgacaggtgtgagccaccgcgcccggcctggatttacttttaatcttaacaatgcttggctcattagcgggcccatatgggggcttctgggctagttgctctgggcaatacaccggcagagcctaacttttcagatggccaggccaggacccagtggaggagcactccttggccagcccctgaccaagggccaagagcctcaaaggcaactcaccttctctgtttggcttagcaggaaatgatggaaatgaggatctgcatctttaacaggctgaaaccagaaaacagtgaaataaaaccagttatctgccaccaaaggtcacttccttctccctggtaactggactctcctctggctgcaacacctctggattctggtctctttttcacaattgtctggaaactcttttcccattttggcctaagcctttttataaaaacaagccccattccagctagaggaaaactggctttaaagtgtaaaagaatagatgattctgctaggttggtacacaaattattccaatgagcctgtgggaaaatattaacaagcatacctgtgctttataaattcggtactcatcaggcacagcagataacccagcaaactaagtcacatctattctggaatttcagggttttggcctacttgtgtctggtaccaagcccttggcgatctcatcttactgagcatattaacagaaacagagtagccacgacagtggaccttcatgggctttccataattatgcccagcaacaggtgtagccgcaccaaggataataaaactaaacataaaagttgtatttatggacaataagagggtgtttataaaatattaggggaaaaaaacttgtggaatcatcccacttttgtgaaaaagaaccctgcccaaaataaaaaaaactagacataggtctataatcatgtaaatgaatgctaagtgggcatcccaaaggactgaaatccgtcacctcgagcctcacagtgctcaccctagagggaaatttttaattttttatttcatagacttctgtactgttttgtaataataaattaagcctcacacacaagaaagggacaaaaaaaaaaaaaaaaaggatcacacaggaacctcgccctaagccacagcttgtcctgcctgcaggagagctccttacctcgcttgcggttggctgccatttaaacgcggccatcggtccggccatcatccccttcacggtactagactccgggatggtgagatcctatagagggaggggcagggcattttaaaatcacattcaaaccccaacaaaaccccttgcaagctccacagtctaagggaaagttcaagccaatccccaaccactgttctgatgaccgtccctcgggagaaacaagccagttcttcccattaacacaaagtgagtctttcttctcaattctggaaataataaaatgtgtacttatgtctaaatttcacaaagatggaggtaattagaaagcccaagtacgatctgcagtactgtctgcaaagtttcagagtaaatgccttatggtgaataccaaacattaagaaacagttgtggtggctgggcgtggtggctcatgtctgtaatcccagcactttgggaggccgaggcaggcagatcatgaggtcaagagatcgagaccagcctggccaacacggtgaaaccccgtctctactaaaaaatacaaaaattagctgcacctgtactcccagctactccagaggttgaggcagaagaatcgcttgaaccggggaggtggaagttgcagtgagccgagattgcaccaccgcactccagcctggagacagagcaagactccatctcaaaaaaaaaaaaaaaaagaaaaaaaagaaacagtagtggcttcagaaggaatccgccatatttcaaagaaacgaataaaaccacatggggctgatgagatctgcccacattttacagctatcatgacaaaggcagaattaaactccagggtggccagagcccaagagcctgagttctcctgagacggacacaggaggacatggtgagatgagaagctcctcttcatcgatggcccggctcaccttcttcctgggcaaagggtcctctttccagttttaacactggtctggtccctctcgactgctctgatgttaccttgcactccctttccccagtcactcccttccagccacagtggccctcttgacaccccctgcctaaactactcctgaggttttctcagtcttagaaaacgcctgctccattctactaggccgatatctttagagcccttcttgacccctctcttctctaatccactgacaatgaatggggctttacagttggcgatctgcccaaccccttcttctcaccatccctgctactaatacctaagctcaggccacctggacaattgcaaaaataaatctccctgcttccactcacagtctagtctctacacagcagccagagtcagctaccaaaagggccaatcagattatgatgcttctttgccttaaactgccttccagtctcacatagtaaagctacgggcttcatgagcatggtctacagggagggtcttgcaagttctgccgtctcccacccatcccacgccaatctccaacctcaagtcctatttcttcccccgtcactgctctctagctcgttagcaccctgctggctttcccccccgcaccaaacacaccaagcatgtgcctgccctggcacccttgtgctacttggaacgttcttctgacagttatctccttggctcaggctcgctttgggactctgctgaaatgtcaccttatcagagtggcttcacctgacctctttttatgtttgcccatagaacatgatgctgatgtggattataatgagaacaaatgccttcatagggcttactatgtgctagacatcacaataagtcctattttatacatacattctcatgtaattcttgccccttcatgaaacagaattattatcatcttctttttttttttttgagacggagtcttgctctgtagcccaggctgcagtgcagtggcacaatcttggctcactgcaacctctgtctcctgggttccagcgattctcctgcctcagcctcctgagtagctgggaccacaggcgcgcggccaccatgcccagctaattttttgtatttttagtagagacggggtttcaccatgttagccaggatggtctcgatctcctgacctcgtgatccgcccgcctcggcctcccaaagtgctgggattacaggcgtgagccactgcacccagccctattataatcttcttttacagaatagaaaactaaggcacacagagcttaagtaaccttgcttaaggtcaccgagtcagtcactggtgtggtagacacaacttatttatttatttggaggcatagtctagctgtcacccaggctggagtgcagtgactcaattatggctcactgcagcctcaaccacttgagctcaagtgatcttcccacctcagcctcctgggtagctgggactacaggtgtgtgccactacgcccagctaattttttatttttattttttgtagatgtattatttatttgcaattatttgttttctgtaatttctaattttttgtttttatagggtcttgctatgttggccagactggtctctaacttctggcctcaagtggtcctcctacctcggccttccaaagtgctgggattatgggagtgagccactgtgcctagcagactgacagaatttggctccagggtctgtcatattagaagcacatcctagaaaagcaagaactctgccagtctggcctactctacaacccatgctgccatacagtccaggttcaattcttactgaaggagcctcgtctgacttttatgctgctttctctccaggcatttggcctataggagaattactcaataaacatttgttgaatgcagaggtttttgggggaaaagaaaaggcccagcccagagctgcccaaaagaatattctgcaatgatgggcgtgtactccatctgcactgtgtgatagagcaggcgccagtcaagcgtcactgtggagcatctcacacaatagggtgatggagaagctgcattttaatgtgcatttaatttcaatttaaatggccaattgtggctggggcagcacagctgtcttgggtggtgcagccctaggactcacctaaggccacaatgacccaatggaaacaaggaggaggcagcttgtaactctcagtttggcactaaggaagggccccaactcctaaacttctgctcctcgtgtgagtatgggattttgggagagtcacagaactaacagcgctactttgatctgggtgggctgtgcccagagttcatccccagaaagagggtaggtgggcgctgctggggtgcagctcttacatgcaggtccagacgcaaacccagcctttccctgcctgcctccgccatcaaggtcagctttttccattaatcctcacggggcaggagattatgtcccggaatggcactcagctgggctttgcccagttatcagcctatgtgactgctcagtgtttctgagaggagctcgccagccaaatgacaattactatagcaacacacacacaaacaccctcctctgagactacgggatgtatcgcatttaaaacacaccaaaattccaaagcccaggcaccgattccctacctgtctgaaggtgctgaactgaaacggctatctgtcctgtaccacatgccagctctgtcctctcctgctcatacgtcctttcactatgggccaggtgaagcacaaagaacaggcaggaaggacacctcgaagggtcaatagcagctagagctcctggaccacagacacacctcgttttattatgcgttgttttattgtgctttgtaggtgttgcacttaaaaaaacaaacaaacaaacaaacaaaaaaaacgggccaggcacggtggctcacgcctgtcatcccagcactttgggaggccgaggcaggtggatcatgaggtcaggagatcgacaccatcctggctaacatgatgaaaccccgtctctactaaaaacacaaaaaattagccgggcgtggtggcgggcacctgtagtcccagctgctccagaggctgaggcaggagaatggcattaacccaggaggcggagcttgcagtgagccgagattgcgccactgcaccgcagcctgggcgacagcacgagactccgtctcaaaaaaaacaaaccaaaaaaccaaaaaaccaaaaaacgaattgaaggtttgtggcaacccagtatcaatcaaatctatgggggacattttcccaacagcatgtgttcactttgtgtctctgtcagcatttttttttttaagcaatgaagtatttttaacttaaggcatgtatatatatatatttttttgagatggagtctcgctctgtcacccaggctggggtgcagtggcgtgatctcggctcacttcaagctccgcctcccgggttcacgccattctcctacctcagcctcctgagtagctgggactataggcgcccaccaccatgcccggctaatttttcgtatttttagtagagacggggtttcaccgtgttagccaggatggtctccatctcctgacctcatgatccgcccgcctcggcctcccaaagcgctgggattacaggcgtgagccaccgcgcccggcaaaggtatgtacattttaaaaagacatattgctattgtaccacttaatagactacagtataaacctaactttaacatgcaatgggaaaccaagacgtttgtgtgacctgcaatgatctggaatcgaacctgcagtatctccaacgtatgctacactactccccagattaataattcagacccaagggctgtctgcagtttattgggagctcgtgagacgagttcctgtaagcctgggcagtggcctctggggttctcactgtacaaacggccagtgtctgcgaaacaaacctaaagaactgatcaaatgccttgtacacaggcactgttctaagtgctgtgtccatgtcactcatttaactaacacagtgaacctaggaggcacgtactgttgtaattcctaacgatgagacaaggaaactggggcaaaggtgctttgctaaggtcctatatacgtgattcaaactccaggccctcgtcataacctctcctttgtacttccctttatccaacgagaaggtatttctttccagggtggcacaggcaccggtgagatgcatggcttcacataccagacaatatcaatttgggaaatagcataaaatctgacagcccagattccttttggattccaggaaataaactcagaagtcacattacattttttgtgggtcaatttagatcatgttccctataaagttctctctgcactgcagctggcagcttttccaaaccttgggctgacggtatgcagggacagcactgccacccttgctctcaccactccctcagcctgaggtcatctaacagtgagaagggctgtctctcaccagaggcctcacactggcagcccacagagatgtttctatggccccaagacatatttttgaactaagcacatttaaaattgggatatttcacataaaaacctgtatttccagcttctctctttttttggagatagggtctcacactgttgcccaggctggagtgcagtggtggaattgtaggtcactacagccttgacctcctgggctcaagtgatcctcccaccccagcttcccaagtaggtgggactacaggtgtgtaccactatgcccaactagtactttttgtttctttttttgttgttttttttgagacagggtctcgctgtgtcacccagactaaagtgcagtggcataatcttggctcactgtaacctccacctcctgggttcaagtgatcttctcatctcagctttctgagtaggggggactacaggcacacaccaccaaccccagctaatttttaattcatttatattaaatttttttttttctttgagacggagtctcactctgtcgcccaggctggagtgcagtggcgcaatctcggctcactgcaacctctgcctcctgggttcacgtgattctcctgcctcatcctcccgagtagttggaattacaggagcgtgccaccacactcgggtaatttttgtatttttagtagagacggggtttctccatgttggtcaggctggtctcgaactcccgacctgaggtgaaccacctgcctcggcctcccaaagtgctgggattacaggtgtgagccactgcacccagcaaaaaaaattttaatagagatggggtttccctatgttgcccaggctggtctagaactcctgggctcaggggatcctcctgcactggcctcccaaagtgctaggattacaggtgtgagctaccatgcctggccaattttttagtttttgtagagctagtcttcaactcctaagctcaagcaatctgctcacctcagcctccgaaaatgctgggattacaggcataagccactgcacctggccaactttgtcttttttttttttttttttttaagggaaaggctcttactatgcttctcagcctggtcttgaactcctgggctcatgtgatcttcctgcctcagcctcccaaagtgctatgattgcaggtatgagacaccacaactggccttcccagcttctcttgagaaaaaacagacaatttggcagaagctggctagaaccctgtggacagagcatgacctccccagactccctgaccatggccagccctgctgctctgagcaccaaggcaggtcagctggggtgcctggcacccgtgccactgcttcttaggtccagtcagctacagttgcttccattacctgcctgggctcgctggtgtctgaatttttgagccttgatccaaggtctaatgttccatcatggcctcgtcacccaactgttgctgccagccatctggcttctgttctctttatcctgctgttgacaatcctaccgcgttcctgacacagtccccttcactttgaaattcttctctgtggccttgtaagaccggccccaaatcttgtcagcaagaaggcgagagaggcactctcactgctttatctcatcttgctagctcctcctgctccttcctgccccaagcacggcattcttgtggcaatgcaggcctccgcgcttccctcttctccctctcttcctgaaacaaacccattccactgcccggactcaactacccttttacaaattcacctcccaaatctacatttctagtcctgaggtcacaccaagctcccaggctgtctaggccttgcctcaagttcttgacattccaaacagaactggtactctttctccacaagccacctctacatccccagtcctctacttttaagaaagtgatgaccactttcccaggaatgaagatggaaatcctcttttcctttttctcattcatcctctatataaccaattatggaatcttaagaactcttcctctgaagtgcctctcacctctttgcttgcaacatttgcaattacccccttatgaatgcacgcctagacttacctcctaattggctctgagactttcccctctgcactcggtgactactggtgcacacacgggaggcacacactgccactggctcagtcaccttcccgggcccccactgactccaagacgctttagtaccacgctgcttcagtagaccttcaggccctccacgatccagggacaagcttcctttttctcggctttcctcactatcctctccctgttcgagagtatctccaccagcaccgagcctcacacgggctgtgccctccatctttggaatgcctacccttctttcttgctaagcccctcccagggccagcccttgtgcaccggctcaagtggactgctctcctgcctcgcgctcctactttacacctgcatccaggccgtgtctctcacctggtctatgggattctttattttttaattttttaaataagattcggggtctcactccatcacccaggctagaatgcagtggtgcaatcggctcaatgcaactttgagctccaaggctcaagccatcttcctgactcagcctcctgagttgctgggataaagcatgagccaccgcacctgccctgcaggattcttgagcacagaattctgctcccactccatgagcagagtatagataagcatactacataagcatactgtagagcttaactctaccttgtactaaaaggacatcactaatcccggaagctgcagagagaaaacaaaccttctcatcctttgggggccgaccccgcttccggggactttgctcttgggctcttttcagaggggatttggagcctctctctgaagagcctgaagacaccctcttctttccttctcccatgttcttcttcaccttcccttcagacaggctaagtttgcgcttctcatcacctgagtttggcctacttctctcctcactggaattacgtcgattcttgtcatcagaagaattgtgggatgacgtctgaaagtttaataataataatgataactaccaccacagctgctgccgccatcgccaccatcatttacaggtgccatgtgctgctacaggcactctgtgtggtctcctcacaatgaccctagaaatagattctgctgtcgtcccagacattgggagaagcagatttaaaaaatatatatatcaaaagtcactttccctatgtcccaaaactagaagaaaggatttaaatctaggcagtatatgtatttcagaggctatgctcctaatctgtgtgctatgaaaggaagaaatggcctgtgctagactcaaatgctgagatatttctcctgggtccaagcaattttcctaaaagcaacaacctactccagaaaggttagctgcatggagtttcaaactgataagcaaaacgctgacaccttagaactgaagtagctttctccagtagcatttcagaagaacaaaggtttgcgtttgggtgacatttaatctgttagttgctatgcaaaaatcaccagtctggcattggtagaaagtgaacattgtgtctctcacctggtctttccctttggctctcctgaggaactcttcgacagcatctaccgcttgctggaatcgtttacccttgttaatttttatcatttcctctttatgagcatgatatggcttcagctgttccactttgatccaggcactagcagaaaacaaacacaaaaagggtgtgaaccatatagcatatgccctaaagtatcaacaacctcactatggcacggtgtaaatatccatttggtttaactggactttgcaataggccttgccatttctttcaaaacatgctatcaaccatctcagagtcttatgtctaaagtatattttcttgaaacaagtcaagcagaacaaccatcaccaccactgcagcaaccacaaatcaagttcctccagtgaaagcactgtgttgcagattatttatttccacaatcgtctatcagcctccaatgcccaaccacatatacgctgccacttgctcagggcagaaagaaatctggagaccctttcccattctcaccaggcagcacaaatggccacacacagatccctgggaatcagggtacctggaaatgtgatagatgatagcagcattactatgcaggaaaatgcctgctgcctgtcaacaatgggaaccagatttatgatctgttgatccacagagagtcagggatgttacagagctgaagaaatgcaacatcttctaaaatttgtggttcctatggatattcacagccactgagcctatatttgttcataaatgatggtaaccatggctactaaaccacacaaaacacggaacacatggtttggaataagggcagcagttacaaaaggaggcatttaaaaacaagatggcatgctgttttatgatgtctcaaaaaaaaaaaaaaatagaaacaagatgcttgagattaaaggtagaagaacatacacctccgatatgtaatttttaatttcaaccatcaatgtgtaacacatgaaagtgaaagtagtcagctgtcaattctggggtttctgatctgtcacactaacctgaacaaatctgctgcagctggctttctatggcttccctgaatggcatgcagcttatagaatccaagcacaaaataattttataggctttacaaggtatcagttagtttacatgttttagcctgtgatacaggtttcacagcataaccttcagaaaaagtaggtcaggttaaggatacagaaacccagctatctcacaagcttcaggttgttttcttcatagaaagctagagaatattcactaacagcaagtgttaacctttgcacataaaaataatgttactaaccctccaccagctacctggactttgagtgtgctgctggtagttgtgataatggggtctgtgcaaaaacacagacctgggatcatcggcctgcagatgtcaggcagcgaaccactatcaggcatgccaccatggctaagtgagatgatgaatggagatacagaagctggtctccctggcacagctccaactagaggagttaggcaaattccttttttttttttttttttttttgagacggagtttcactcttgttgcccaggctggagtgcaatggggcgatgttggctcacggcaacctcgcctcctaggttcaagtgattctcctgcctcagcctcccaagtgctgggattacaggcgtgagccaccacacctggccttttttttttcctttttgagacagagtctcattttgtcacctaggatgaagtgcagtggcacgatcttagctaactgcgacctccgcctccacctcccaggttcaagcaattctgcctctatctcccgagttgctgggactacaggtatgcaccaccacacccagctaatttttatgtttctagtagagacggggtttccctgtgttggccaggctggtcttgaacttctggcctccagtgatccacctgccttggcctcccaaagtgctgggattacaggtgtgagccagcaaactcctttccagtgaccaactcatcttaaagtttgaaattcaacatgagagcgccaatgagtccaatctgctgggaggaaaagtggaaggagatttcgaccccagattttctggcaagaatatccctgaactgactccgttccctctccttacagggatgctaatgacaggccagagcaatcagatgcaaagtcagacccagccccaaaagccagtgaagctaccatactaacccgtgggtctgagatgacacaaccagtatcaaggatgaagcttaaggagtcgtgaccagccagttcttcctaggagcttctggtcagaagctgagaaccacacaagttcccaatataggaccaaaaaggtgatttttatggaaccccttgagatgggacaacagactccgagacttgctaatcccacccacgccatcctgctacctccatccctgcctcccactacccagcctcacaggaacccgattctgagggaacagaaaggtgaggatgtctgtgaagtgccaaggaatcaaccccattttttgttgaagcatcttacaaggtttactgatttctgctagaaggaactgtacagtcaaaattccactcactttaaagcatttgagatactaaaattttcctctttacaaccatcttcgaaacattaaaatggctaaatgaactgacagtatgaataggatggtaaatccaagaaatgttaatctatttaaggaatcaacttattgctggagaagcatcctgttacatcaaaaaacagccataaaaaaccagcttggctgggcacggtggctcacacctgtaatcctagcactttgggaggccgaggcaggcagatcacctgaggttaggagtttgagaccagcctggccaacatggtgaaatctcgtctctactgaaaatataaaaattagctgggtgtagtggcacgcagctgtaatcccagctactcggaaggctgagacaggagaaacacttgaacccaggaggcggaggttgcagtgagccagtattgtgccactgcactccagcctgggcaacagagtgagactccacctcaaaaacagtaacaacaaaaaaacccagcttaccagagctctatggggattacctcttgaaagcaaaccaaacttaaatcactttggctatctgaatacaattttttctctaaaggttacacttctttcatcttttttaaatttattttttatagagatggggttcaccatgttgcccaggttggtctcgaactcctgaactcaagtaatctgcccacttcagccacccaaagtgctgggattacaggtatgagccactgcaactggcctacctctgtctttttaatgagaatatgcttttcagttggcgcctcaacaatgcaccactgtctaattcacggaggcacatcagccgggcctggcacaccactggtcctcaataaataatcactgggtaaatgattccttcccagatgttcaggaggatgtactgctcaccagtgagttaaaaggtgctacaatgctccagtgcgtaaggctttagtgtttttgttgttgctactgttggttttttaagtgactgtttctttccttgatagaagctgtaacttttgattttcctatcatcctcccaagacttagatggagctatatctttcagcccaattgtggctgggaagtcagaaaaatcaagcttattcaagctgtatttaaagtaggagactttgctttttatgtacagtagaatgaatgacacattgtgatagtaaatagctgaaaacaggcaaggtcattacagagaaggaaagcggatgtctcgtaagatatctggctacgtggagatgagcaagataaaaagcaatgcatgttatgtgctaccactcgtgcaaagacaaggaaaatggactgaccacgcactgatatctctggagggacacatcatcagaaactggtctaactgggtggctgtgggatggggatgaatgcaactgtttcaatgttgacaagtttttgtttttgaatggtgaacacatattatattggaaaaaaaaaaaaaaaacaaaacaaatcaatactaaaggcctctgccctagaacacaggctatgccgactgcccagagggtttcctccatgacttcctggtttgcaggtttgctctggtgggttgctgctgcctggctgctggcataactgcacctgtaacacagccaatttaccctggtgacctgacactcttcctataaaaagtctcttcatctatgaatacagaaccgccactaaggcactctcagattactccaatcaaaatgaattaaaatctggtattttcaaaaacttgcacacttctgatttgctttcctcttaaatgaaaatcatacatgtagggcccggtgcggtggctcatgcctgaatcccagcaccttgggagaccgaggcaggtggattgaggccaggaattcgacaccagcctggccaacatggcgaaaccccatctctaccagaaaacacaaaaattagccagttgtggtagcacacgtctgtaatcccagctacttaggaggctgcggcaggaactgcttgaacccgggaggtggaggttgtagtgagtgcagatcgtgctactgcactccagcatgggcgacagagcaagacttggtctttaaaaaaaaaaaaagaaaatcatacatgtagatactgtatattaaagatgtcagcctatgactaatcttgaacgctgtcacatgtgtttcagccttcacatagacaggtgacccggggtgaagccgtgaagctaagagaaagagaaaaggagaaaggacggggagaagatggcagggggagggagacagacagagaaaaagcacacacacacaagcatagagtataaaggtgagaacaagccggcacggtagctcacgcctataatcctagcactttgggaggccgaggtcaagagattgagaccaccctggccaacacggtgaaaccctgtctctactaaaaatacaaaattagctaggtgcggtggcatgcgcctgtaatcccagctactccggaggctgaggcaggataatcgcttgaacccaggaggcggaggttgcagtgagccaagatcgtgccactgcattccagcctggcgacagagcgagactccatctcaaaaaataaataaataaataaataaataaataaataaataaataaagataagaataaaaatacaggtgagaacaaagatggggccagaaggtgtgggtttgcttctccatttggatttggtgaatacttagtaaacaatttctatgggtgcctttttaaaaaaaatccatccaaaggggctgaagattactgaggtgttacaggccaagttcttcagaaataaaggcaccagaaaaaaacacacacaaatcaggtgccaggtgaaacgaaaaagggatgcttccaagctgctatgcttctaattattaaccacatattcttctagagcagctactttcagtactgactcagacacctcacatccagcgagaccggtccaccttagatgtggcttggtggaaaaggaccactggtctctcagtttcctcatctgtgaaaaaataagaaccagaaagatgaccctgtgcacttcctgaaagggctgctgtgaggactggaggggaagactgctatggaaactcgcaggtaggcacttgcagcttctccactgtttgtccacaatctgttgaaccggttggtttctggtggcttctaagcacctgtaatttaaatgaacactccctccattccatcatcatccacagccactgatgaaacttttctttttttttttttgagacagagtctcactctgttgcccaggctggagtgcagtggcgcgatctcgacttacggcaagctctgcctctggggttcacgccattctcctgcctcagccacccgagtagctgggactacaggtgcccgccaccacgcccagctaatttttttgtatttttaggagagacggggtttcaccatgttagccagcatggtcttgatctcctgacctcgtgatccgcctgacttgccctttgaaagttctgggattacagatgtgagccaccgtgcctggccaaaactcttcttttttaaaagacagggtcctgctctgtcacccaggctggaatacagtgcctcaatcacagttcactgtagccttgacctcccaggctcaagcgatccttctgcttcagtctcccaagtagctgagactacaggtacatgctactacgcatgaaccctctcacctgtgtttcagccttcggatagacaggtgacctgggctgaagccgtgaagctaagagaaagagaaaaggagaaagggcggggagaagatggcagggggagggagacagacagagaaaaagcacacacacacacacaaacacacacacaagcatagagtataaaggtgagaacaagccggcatggtagctttaaattttttatttttaaattttttgtagagatgggtcttgccatgttacccaggctggccttgaactcttaggcttgagtgatgcttctgcctctgcctcttgaagtgttgggattacgggtgtgagccatcacgcctggccccgatgaaacttttaaaccgtgagctctgtctctactctgatgggggggtcaccactaatcagacctgtcagagagggaccctcgtgcacttgacacataatctttggttgtagtcaccaagtgaagctggcagggttttgctgaaattatatccccttcgtatttccatgaaaatacaaaaattacgtgggcagttttgtcttggccatctcgctcagggagccgaatccgtataaagaagtcctcctctcaccaggacacctgattaggaaggtctggccctctcctaacagtgggatgtcaacacaatttgttagatattttggcagagatgtggagagagaaaaatcaggtttctaaaagattgtaatcactgattatcttgtcataaggagccgttctttctgctctttaataaaagaccttgcaaatattaaaaaagtataactacacttttttttgcctaagtagtgtgtcaattttgaaactgaacatctttgaccaaatcctgtatttctcaggaacggaggacactccactgggtcagaccctatccacctgggccagggtccagtaaccaatggtgcccccacccaggatgtgcctggaccacatgccccctccctgatgtcaagtgttaaaggcgaggtgcagtccagcttctacaggagccacttatggctttgtcttcacaagttagttctcatccctaaaaaatccccttgcaatacctgtttacaccacctcttaaacgccccttttatgcagtgctcctcaccctggtcctaacacagtcataccacaatccacttgcagtgcccatcgccaaactcctctaggccattcgctgtttcctacctcctgatcccgtgattccttcagtctttgcttttccacattgaagagtcctgctcttttgtctgactcagttcccttttctggatcttggccaattctaagagatccctttgaaagcatgatctgaagtccatagagtattcctgatgaggcgcatacagttttacataaaggtggaatgatgcatggttttgtactcaaagcctttttggtaaaaagagcaaacctggctgacatcctttaggaacttccaactctcatattcctttcttttcaaacaaacacacacacacacactctctctctctcccatagggagagtctccatctctctcagttttccatacttaaaggcatcctggaccaatgtgtgctaatacctgctgtatggcaagccacactctacacaagagatactacttttccttcctaactatgaggtagggggtatcatccccttatgtagaggacacagaggctcagaaaggtgaaatagcttgcccaaatcagggagcaaggtggaaccggtacctgaatgcacattaggctggtaaccaatccagagctctttccccaaagtaatctgctgccaccagccaatctggagatcttaccttcatagaaaaacacaaaataaaatctgccccagcactgatcactaaggaagtgttccttctttagagaagtactgtacatctttaccctttatttcctttctctaagttaactgcctacccacaaaaagataacacattagtaccacagtgacttcatttttatagtttaaaatgtagaactctagcaaaggagtttaaaaagttaaaaatattgcatttagcagttgctttgtatcccacttgtttacaaccctccaaagaaccttcgtcagttagaaattatatcatcaccaccaccatccaggctatttttgtcttgagcaagcacatcaccactggcttcacctgtttgcctggttaagctctgaaattaactcaactccaattttctgtgtcctatttctagcacttgttataaacaaggatcacagtttattaatctagtcttttagcattaaaaaaaaaatcggggctcggcgctgtggctcatgcccataatgccagtacttcgggaggccgaggtgggaggatcacttgagcccaggagtttgcgaccagcctgggaaacatggcgagaacttgtctctacaaaaaaaaaaaaaaaaaaaaaaaaaaaaagtaaaaaatttagcagggcatggtggcacacaactgtggtcccagctactcggactgctgaggtgggaggattacctgagcctgggaagtcaaggatgcagtaagccatgtccgtgatactgcactccaaccctttctcaaaaaaaaatcaagaaaccaaacaagaacaacaacaacaacaacaacaacaaaaaacataaggaaacaatggctttcaggctccttatgagactgagttcccatttttgtttcagacttgtgtaattattcatttagctaatgaagtttgggccaaccatattgcctctgttattcctaagcacaagttacctcaggcagggagcctcttcctttccataacacccagcttaatgccaattgttcatggtatccccactgtctgaaatgcccctatagtccccatccatccagattctatgtatcttccagagctggattcaaatcccatctctggctgagtgcgatggctcacgcctgtaatcccagcactttgggaggccgaggcgggcagatcacgaggtcaggagatcaagaccatcttggctaacatggtgaaaccctgcctctactgaaaaatacaacaaaaattagctgggcatggtggtgtgcgcctgtagtcccagctactcgggaggctgaggcaggagaatggcatgaacccgggaggtggagcttgtagtgagccaagatcgcgccactgcactccagcctgggcgacagagcgagactccgtttcaaaaaaaaaaaaacaacaacaaaaaaaaacaaacagaaaaacaaatcccatctcttcagtcagtcttcttggttctcatggctctccactgagctctccctcttctagaattctttttctttttaagacagggtctagctctgtcacccagactggagtgcaatattgtgatcatggctcactgcagttttgacctcctgggctcaagcaatcctcctgccttagccttctgcatacctgggactacacttgtgtgccaccatgcctggctattgaaaaaaaaaatttatttttttaagtagagacaaggtcttgctatgttgtccaggctggtctccggctcctgggctcaagcaatcctcctgtcttggcctcccaaagtgctgggattacaggcatgagccactgtgcccagcctagaattaacaattatctgccatcattcattctgcacataatctttatttattttttgagacagagtctcgctctgtcacccagactggagtgcagtggcgcgatctcagctcactgcaacctccgcatcccaggttcaaccaattctactgcctcagcttcctgagtagctgggattataggtgtgcaccaccacacccgactaatttttgtatttttagtagagacagggtttcaccatgttggccaggctgttctcaaattcctggcgttaagcaatctgcctgccccggcctcccaaagtgctggggttacaggcatgagccaccatgcccgaccatcattgtgcacatcatcttatctgaaatgtttacaacttgtcacttgactgagcatctggaaggtgggaactataatacttgctttcttataaattccctcagtgtcaagcaattcagaaagtggacacataacactgatgttatgcatgaggacaatctttcctgtttttctttttcttttctgagacatagtctcagtctgtcacccatgctggagtgcagggtctcgaacaatctctgcctcctgggttcaggcaattctcgagcctcagcctcccaagtagctgggattacaggtagacgccaacactcctggctaatttttgtattttttgtagagacggggttttgccatgttggccaggatggtctcgaactcatgacctccagtgatccacccaccttggcctcccaaagtactgggattgcaggcctgaggcaccatgcccggccaaatcttctttttaaatccatggagttctaagaacattccctcttccagaagctctggctccacagctccaggccagcgatctccttgaaatactgccaccacaggctgctaagctggcttgtgatagagaaatggggctgggtctatctgtaaacatgaaaccaggaagagcatctgacatataaactcctggatgagtgaagaatactgtttataatatatcgctttctaagtagaaatactttaaccgtcagaattagatttaccagagaagccacagacatttttttcaaatctaaggctgtattttcctataagaataataaatagaaatacaactacttaaagaaatcaaaccggctgggcatggtggctcttgcctgtaatcccagcactttgggaggctgagggggttgggggggggaggggcagatgacttgaggtcaggagtttgagaccagcctggccaacatggtgaaaccccgtctctactaaaaaatataaaacaattagccgggtgtggtggtgtgcgcctgtagtcccagctactcgggaggctcaggcaccagaatcacttgtacccgagaggtggaggttgcagtgagctgagatcatgccactgcactccagcctgggtgacagagtgaaactccatctcaaaaaaaaaaaaaaaaaaaaatcaaaccatctagctagacccaggtaagccacttgacatagtgataaaaagctaaacaaatcactagcaactcaagttaatacaggttcttcacgttcttcccgtcactgtaacatgttatatggtcagagtctcagattaatggtcctggtttccccaacttaggacagatctggtaaaaagacttactataacaatgtcaaagcaaatcacttagttttacacatgagaacatgattgaacaattacttttattaacataaataaaagtttccactgtataccccaagcatgaaccataatgatatatggcattaaaagagaactgaacatggcttttataaaaataattgccagctgggcgcagtggctcacgcctataatccagcactttgggaggccaaggcaggtggattgcttgagtccaggagttcaagaacatcctgggcaacatggtaaaaccccctctacaaaaaattagctgggcatggtggtgcacacctgtggtcccagctactcgggaggctgaggtgagagaaccgcttgagtcagtgaggcagaggttgcggtgaactgagactgcctctgcactccaggctgggtgacagactaagtctctgtctcaaaaacaaacaaaaaggaactgcctttggagttgggtaaagaaacatgtgagaaactgtttcaatgtgattgttatagttagaaggtaaatgaacctagttcttgcctgacttagttatagacctaggacagttgtctagggcaatttctgcaagaaattgcacctttatttaggtatgaaggcagaatgagatgccagtattacacattataagaagactgaactaaggatccttagaatattttcaaagcagctcagactccaggtaacacagaaagaaaggcgaagggagactcctggtgagtactactcactgatcttctgttccaaaaaatttcacaaagaagcatttctttccgcgaggtttcttcaagtcctttggtggattaacaatctggaggataaaaggggggaaaaaggttggctggcaacacagcagcccactttctagtggctccacattgctctacagttctacgttgctaagaaaaaagtaaattaaaaggacttacttacaaataaatttatttatatacaaaacagaacccaaggcctagtacttgtctaaatctcccatttttctattgaggtgtatggaaatgtgtagatattctagaagttcccaatatttaacatgtagcacagtgctcagtagacacaatatcccttttactgcagtggccctgttttacaagcagttaaaactaagatcaacagcatcccctgccccccaccaccccacccctgctccaatgtgaccccattattactgaaaaaatgcagacgacactctttgaaatacttcctgtgcaggaagggttgacacaggacatagtgaaaacaaaggacaaccgaggcacagaaaacaccatattgcaaagagaccatctaaagacacctcccgggctccaagcaagaatataaaaacacaacatttggaaagcaatgatggatcacctcatgcaaaatctggaatgccaacttctgcaaagaggcactggagtagcacatatggtaacatggaaagaagatttaaacttagttgggacaaaaatactttggcttttcactaacctacatttagactttcttcctggataatttatattttcttctccttttgttacatttaagcataaagctaaattcagactagaattatttccggggttaaaaaagaaacttcataaacctcctctaaatccagaaataagggtttagagaagatttaatgatctggtgtatactgcattgccttttaaaaaataaccgatactaggggaaaaaaaattctaagtgccatctgaatgagcccaatttaactcaatactagaaactgagaggaatgcatcttacattctccacctcttcaaacccaacttcagatctcttcctttagtagcaagacactcacctttcctggccaaggaggatatcggccgagtttccccctagagaaaacacaaagagtcaacacttgccctgcaaaagccagtccatctccttcaacccactcaatacgcaatttattttcctaaatctctgctggcatcctcaaatgccgaaacaaaagctttcatagctgggcccaacaccctcagaagtaaaatgcaaaattgtatacttatgtgcacaacgcatatccattcttctgttgacaaggaatacagaacaacacaactgtcaaaagtcacttgtctagagcttcttaatgacgggggtgggaggacagcttcctctgtaaacacagactttccctccctaagtctggtttaattcaacaggagacctgcctggctttgacaaatgctaatggaagccttcctctgggtggagaaacaagctacgcagctcgagggaggcggcgacaaagtcttggttcgggcggttgtctgggacacagaagcagaccgcgggaggcacccaagcgtgcactggtcactgccaagccatcggttgtaaaggagaagtccccccgccgtttcttcgcggggcaacgccagcagtccggtttagacaaccccggctgagccggccgcacaggtcggctgcatcgcaacctgggctttgaccgaatggcaccggccagatctcgcaggtccggtccccggcgcttctgctttctgggaagccccaacaagaccccggggaccggtcgtccggggaagcctcgcggcaccggcggctcccttcacgggggccgccagtatctgggccccgagtgcagaccccacccggccggcctcggggatcaaagccggtgcccgacgtggccaccctcggcctcggtcccccgggactggactgccccttccgcctggcgccgctcgcaagcgccggcaccttctcttcccctctctccgcgacctggagcgcataaaaaggcagctccagggccggcagcgaaccccgcgcccaggcgggtagctccccggcgcgtctcggttggcccggccgctcggactcaccacaccaagtcgccgagccgcagactcacagccgccatcttaccacccaaccaccgccgacgcacgggccgccgggaacagcaagtcgccccggcgccgcccattggagtgggcccgaccacgtgacgggggccggctgtcactggccacgccgctactctgacgtcaccgcgcccgccggggatcattggtcgaccgaggggcacgtgacgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaaggtgcgtgtcgttgtcgggtccgggctctctcgttagccttgccctagttttgcacttttgaaaaagttgtgacaacaggaagacagatgccgggcgtagtttggacactttaaaactgaaccatgaactgggaagtgttaactgcagttgagcgcagcgtcggcccaaacttcagcagaccaggtagaatcacaattttgcaaaagatcccagtcccgatcacagactccacagtgttaaggattgacttagacttggtgtcgggctcttgttgagtcactgccagctggcaaaggtggcgagtcgacacgcatttccccaaggcattgtggtggttagagatttcggttgcaagtcggtgtttagcgtactgggtcgtcccgcagcctgatttttcttgggagatcagtttccctgaagtaccaagaattagctgcacggactgtcatttactgcgtgtgtatttttaagacaaagtgatctttaaagcgtatttaagattccagggaataatttgataaaaatttaacataagttcctgtttaaaaattctgaatttgtgaggaattgaatgagattttaataacttaaataaaaacatgaatcttggccgggcagggtggtataagcctgtaatcccagcattttgggatgccgaggcgggtggaccacctgagatcaggagttcgagaccagcctggccaacacggtcaaacccagtactctactaaaaatacaaaattagccgggcgtggtggcgcatgcctgtagtcccagctacttgggaggctgaggcaggagaatcgcttaacccgggaagcggaggttgccgtgagccgagattatgtcactgcactccagctaggcgacagagcgagcgagactcgtccccccgccaaaaagaaaaaagaaaaaaaaatctcaaatgaacattgcaccaaaacctagaggcattccccttaacatcagaaacatggtacatttctaccactattagataataagaatatattgcctaaaacctgaaagttctagccagtgcagtaagacaggaaacaaaaataagaaatgcaatttttggaaaagggaagacagaattctcatttccgtggatgataggtctgcctattttgaaaacaaaaacaaaaaccaaaaaacccattaaaataagaattcaggaagggtactcattataagttggaatgcacaatttagtttttctgtttcatcaataaccagtttgaaaatacaatgtttagaaggagatatatatatatatagtaagaaaaaattaaaaattgctgaggataaccaagggacaaggaaggctagtattttctcagtaacaccaactgaggtttttaaagggggatctttgtttttttcttttttttgtttgagacggagtttcactcttgtcgcccaggctggagtgcagtggcaggatcacggctcactgcagcctggaccttcccagtctaaagccatcctcccacctcagcctccttagtagccaagactacaggggtgtgccaccatacctggctaatttaaaaaaaatttttttgtgcagatgaagtctcatcatgttgtccaggctggtcttaaactcctaggctccagcgatcatcctgccttagcctcccaaagtgctgggtccgggaagttgaggctgcagtgagctctcatggtgccactgcactccagcctgggcaacaggagtgaggcaactgtctcacaaaaaaaaaaaaaaaaaccacaaaaaaagctaaaatctttccaaggacttaggcaactctcgtaagtctaatagataaatgtaagttttttttaagcattcaaacatgtttgaacttaattatattttcttaagcattttgaattatgattgtaagtctaacgtaccattgttaaatatattggattctcttaaatgtttcaaatggcttagtaacagcagaacattataatgattataaaacaaccccaaatctaagtggtaatagagtacagatttgactcactttatcctgtagtcctattttttaccttcttgggcctggagagtcacttaagcaactgaaaggagcagttttgccatctaggattgaagctgcagtctctcagacttggactgagataaggttatgtgtttactgcctggacagggggagtaggacctggttgccaattcaaggatgaccttcctgcatcccattggttaacttgctgattcccttcttatagtgagactgttccggttctatcagtgggggaatctgtaagccttcagctgggatttatttccacaacccagcgcatcacaaatatcctgagggccttggagatttcttttagggaaatctcctttaacatcttagtacgtgttgggagatggtcttttgcagcgccagcctgttacactgctaatcgttttgccgcctgattagaattattttaactcttcatttgtagatattttgttcccttatgtgatgttataagttgattttgtgatcataattcgacaaatgaatattggatatatacaaatacgtctacatgtatgtggatatatacgatatatgctaattttcctgaattaactcacatttgtgattgatttacaaccaaaatacagtgagtttttttgaaacctgccaaaataatacataggctggaatggcaaagtattatttataaagaaggataataaacatgagctttaactttgcaacattaaagtatgaaactttacaaaacagtgcaatactgattaaagaatctctaaataccgtattaatatgacacatggacttcagaaacaggccttagatatctgtgatgttgctttgcaatatatgccaaatcagcagaggaaggaaggattgtttagtgattgatgctggaagaaaccaagttacagcctctcctcatactttatagcatagcaaattcatctggggttaatgaagtaaatgtgaaaaaatatctataaatgaccatataggctgggctcagtggctcacacctgtaatcccagcaggagttcaaaaccagtctgggcaacatggcaaaacaacgtccctacaaaaaatacaaaaattagcacgcctgtagttccaactactagggaggctgaggtaggaggatcgctttagcttgggaggttgaggcctcagtgagctgagattgagtcactttattccagcctgggcaacagagtgagaccttgtctcaaaaaacaaaaaacctatatacacaagttcttctataagatctggttggagacgaacattctaggcataaaagaaatgggaggagtctcaaaggaaaagagcctagttttaactgcatacaaagttataatttccttggaaggagggtcgcttgaggttgtgagcttaagaccagcctgggcaacatagtgggtcagcatctctacaaaaaatagaaaaaattagccaggcatggtgggatatacctgtagtctcagctcctcgagaggttgaagtggtgagaggtttgcttgagcctgggaggttgaggctgaagtggctgtgattgggccactgctctctagcctggatataacagcgagaccctagctcaaaaaaaaaagaaaaaagttaacatttctttcatcatacctcactctaagcaacactaaacagcaaataacaaaacaagaagaagtacttataagagatatgacagattttgtatatctataatgtataataatttatgtataatatcaagagcgcttacaagtcaataagaaagtcacaatttattcaaccattccctgattgattgtcatttgattgtcattttggttgcttccatcatttttcttgtataaacaaggctgcaatgaatatctttatttattggtatggtagaaagttcacactagaatatgaactcttttaaaaagcaggacacaaaattgtatacgaagtaagcagaaaacatgtatggcatgtattagcatattcatattctgtgaacatttggaattctgtattcaaaatctattttgaccattcccaagtgattttgaaggtctttggcatgtcataatttgttattttgtcaaggccagtgtttgggtgtgagagtggtgcacagggcaggagtgtgtaactttgttaggaagtgagcctagccacaccctcctgagtcactggttctttactatcctggggtaggcaatatcttttgttcagctgataaaagctttgtcattgtgaagattggctcccaatgataggaaactgctggtgatgaaaataaaggggtcttaaagattattctcagccagaaaaaataagtgttagacaaattaaatggaaaataattaatattttagtagtctttacaatttggaggtctaaggctctgtcagcatgggttctttaaggtcaaggatctaggatacacatgcacaggaaaaaagactggaagtatgctaagcagtgactatctctgaatgattgtgaaaaaattttaggatgaataagcagaaaaaaacaataaatgacaaaatataacaatggagttttcttgacaatgaaattctcttaaacttaaatctctttaattaggcaggtaaactattttatcatcttcgtttgacctggcccttcttttcaatgttaacagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataaggtacacccctttgttcccagaggcgctgcaggtttaacgcacaggggtcagtgcatgcatgtggggcttccgtagcggggaagcaagacttaactgaggttttggctgccccaagatcctgtcactcactcaaggcaagcacaagatttgcttctcttacctctgtgcgcaaagggagaggccaatttgaattatgactaattaacataaattttaaaaacaatacatttttctctgccaaggttataaacgttatgtgtaaatgaaaccagtccctgacagttccagtgttagaatttcatgctggacattttcctcttccaacagaatcttgctgtctacctagtataggggcagacaaaaaaacacgtagactgcctttttttttttctttctttttttttttttcgagaccgagtctcgccctgtcgtccaggctggaatgcaatggggcgatctcggctcactgtaacctccgcctcccgagttcaagtgattctcctgcctcaacctcccgagtacctgggactgactacaggtgcacgccaccacacccagctaatttctgtgtttttagtagagatggcgtttcactgtgttggccaggctggtctcaaactcctggcctcaagtgatctgcctgccttggcttcccaaagtgctgggattacaaacatgagccactgcacctagccacaacttgatggattttcatgaactcagtacccccatgtaacctgcacgtaggtcacaaaatatatttatcaggaccccagaaaccctccttctgccctgccagaagactacctcaatacttatgggcaaccactgccctgatttctaacagcttagatctgcttagatttgtggggtttttttgtttttgaggcagagtcttactctgtcgcccaggctggagtgcagtggcaccatcttgtctcagtgcaacctctgcctcccgggttcacgccattctcctgcctcagcctcccgagtagctgggagtgcaggcgtccgccaccacgcccggcaaattttttgtatttttagtagagacagcgtttcaatgtgttagtcagggtggtctcgatctcctgaccttgtgatccacccaccttggcctctcaaagtgctgggattacaggcatgagccacagcacctggcctctcttttttgttgttgttgttgttttttgagaccaagtctcactctgtcacccaggctggagtgcggtgatgcaatcttggctcactgcaacttccgcctcccaggttcaaatgtttctcctgcctcagcctcccgagtagctaggattacgggtgccagccaccacgcctggctaattttttttttttttttttgtatttttagtagagatggggttttaccattttaaccatgtaggccatgctggtctccaactcctgacctcaagtgatccacccacctccgcctcccaaagtgttaggattataggcgtgagtcaccgcacctggccgtgtttttgtattttatgtagatggaattgtatggtatttgagtaccgcctaggtgaaaagctgtttttttttttgagacagagtctcgctctgtcgcccaggctggcatgcagtggtgcaatcttggctcactgcaagctccgcctcctcggttcatgccgttttcctgtctcagcctctcgagtagctgggactacaggcgcccgccaccacgtctggttaattttttgtatttttagtagagacagggttccaccgtgttagccaggatggtctcgatctcctgacctcgtgatccgcccgtctctgcctcccaaagtgctgggattacaggcgtgagccaccgtgcctggcccgtgaaaagcatttttaagcacctgtgtctgcctttgcactgtgctaggctctgaggaaaaggtaagtgggccccacactcgcagcattgtggtctctagcatgtctcttagtgaaatggggatgaggctggtaattggttcacagttgtctgagtgtggaacgagaatgaaatcatgttgtgaattttctagcagtatgcctcagtgccaagtgatcagtcggtcttattcacaggtgtgctgttcggagggtatttttggttagaaggattaatctttttttcctgagattaaaaaaatgtgttttcttggcctggcatagtggctcacacctgtaatcccagcactttgggagtctgagacatgaggatcacttgaccacaggagttcaagactagcctgggcaacatagtgaaactccatctgtgcaaaataatacagaaattagctgggcatgatggtgcatgcctgaagttccagctactcagaaagctgaggtgggaggattgcttgagcctgggaggtcaaggttgcagtgagccgtgatcacaccaccgcactgggtgaaagcaagaccctgtgtcaaaaaaaaaaaaaaaaaaaaaaggctggaaggcctggcgcagtgactcatgcctgtaatccccacactttgggtggccgaggcaggcggatcacttgatgtcaggagtttgataccagcctgatcaacatggcaaaaacccatctctactaaaaatacaaaaattagccgggtgtggtagtgcatgcatgtaatcccagctactcggtaggctgaggcaggataattgcttgaacccaggaggcagagattgcagtgagctgagatcatgccactgtactccagcctgggtgatggcgactccatctccccctaccaaaaaacaccaaaccaaaaaagaaaaagtgtttccttgattgagatctgattgcctgattgccagaatggaggcctgtgagtctgtaccaagggtcagcctgttgcatgagcaccactgggcagaatgacagaaagtaatttcaaatccctttataattcctgtttcaggaaaatggtatcttcttcctttagaggaagagacaggagcaggagttggttaatgtgtttattcatgggttcaaaccaaatcagcaggtcaactgaaattagaactccagtgctctgatgtcacctttttggggactacagatgcccttcaccattgcagaaaaatgcatggaggatacacagagaattttgatccaattcagaggattcagtcctggacttcgggttcagaactcctaaatcgtcgtgggtctactctgcagtgttaaaaatacaataaaatcaggcacatttgtgcagcagttcttttagtgtatagtccttaatagtatgaaggcattgtgctagactcagaggactatagaaagttagagaaaacactgtaccagcctcaaaacaaacatcctatagatgttttgagagaatggtaccaccgcaggtaacagaaattacaatatggtcattgtttaagtctggtacgacacaggccctggaggtcttagaaagaagagagcttatttcctgattagtgttgggacagagctggaccttccgtcatacagtcaggaaatggtagttattggaagactgctgttggcaaggcgttcagtagtatacatagaatccagtgctgctcaaggttggtgggatttcttacagttacataaccactcaagttatatgcgatcattgtagaaaaattagaagatccagataagcatgtttgaaagactccccatttgaggtatgatcgttagatgtatgctctataatatcccattgtatgtgtacaccacaaatcatttaactgatcctttgcaggtggtatttcagtaggcagagatgggagggtgagataagaaagtttgtttgaaacaggcatacagtctttagtgttttctgtctaccttgaagtcttaaacatacttcgtacaggagtcttattaaaattaggattcctggctcctggctgggtgtggtggctctcgcctgtaatcccagcactttgggaggctgagatgggcagatcatttgagcccaggagcttgagaccagcctgggcaacatgatgaaaccctatctatacaaaaaacttaaaaaaaaaaaatttagctaggcatagtgttgtatgcctatagtcccagctattcaggaggctgaggcaggaggatcacccgagcctggggaggttgaggctacagtgagtcatgattgtgccactgcactgcagcctgagtgacagagtgagactcttatctcaaaaaaaaaaaaaaaaaatttttttttttggattccttgctcacaaagcttaaggcttatctgtggaaaatttgcttgatgagaaaagaataagcttataaaatggaaataagccttggaagcctgagtttaactttggtagcaccgagagaagtgcaaattcagacctttctaaacagtatggcagaacggctctcaagaacttgcaccacattcagtgggattttcacgtttttgagcccttgactattttggaagtcaatggactctttcttagaatgtttttaaatgcctgaagaaaattttaagagttacaaaggaagtccactttattgaacgtggttgtgtagcgactgggcatctccttctaaaggccctttgctgtctttgagtcctgcagcccctcatgctgtggtggatgattgtaggcattcaatcaagttttattaacctacattaagggaaattttactttcttaattaagataaacattgatgagatggtagcatgttttctaccttgcccttttctggaaaacattgtttttatagaggtattgagtaatcagtgaagtttctatgaataagaacatgggaatattttctgacttattttttgtggaacgatctctttacagaagaaagatctgtcagatcctttcaatgacgaagaaaaggaaaggcataaagtagaggcccttgcccgaaaatttgaagaaaaatacgtaagatttctctcttgaataacaaaacaacctcattgggtgggagacgtttccacactgtattcctttagtggatcatcatgtaataaacactgatctggaagtaagccttaagcatggagagaagagaagcagttattaaacctaacgcattaaggtacagaaaaggggcatggcagagctagtgtgaagagctaactggacaaataaccgagaagggcctgtggtcgccttagaagaaatattttggtacaaagcataagaagccatttagttcatttttctgtcctaggacattttatacaggtacaaatatgttctatgttaaaaggttttcaggaaaggaggttttggggtttgtgtgtatgtgagagagtgactgttttagttagtgcattacctctttgagtcatagctgatgaagttcaaggccacagttaattctgtgtgtttattcaaaaagcatgtaatctattgctttcacattttagggtggaaagaaacgtagaaaagaccgaatacaggacttgatcgatatggggtatggttatgatgaatccgactccttcatcgataactctgaggcggtaagtagttactgaaaatgccgtgtcagacccactgtacctgtagctcctcctgatactgaccaggaagctgggggtggggtcagagcagtcgtgccctcttcccagcatgaggcagtagcagcactgatgagagacgaaatgacattctttatccgggtcttagttccctcttcagaaagtgatgaccagatctgtccaaaacaccttgtagctcagacattcatgtttgaccagaggatgttttagcatgctcttggaagtggcagaggagcacagtcacatctctctcgagacccactttgcaccttcggactgcagaagcagaacttggagctgacagtttgtttcccatcttcagtatgatgagcttgttcctgcttctttgactacgaagtatggaggattttacattaactcgggaaccctgcagtttagacaagcatcagagtctgaagatgacttcattaaagaaaagaagaaaaaatctccaaaggttagaatgtgcttgcttttggatttcagaaatgctttttgacgtgaccctatcagatcagtaggtgacttgccagaatacgtggcgcttggccggctcaggaggatggtggaaaggcagagccgtgccaggttgatggctcgcctcttacacgtgtgccctaatgaggacacgtgcccgtgggggctctgttcagcacttggtcattatgtccatgtcacatgacatcccagcaggctcagcaggggtcgtttctggaggtggcctcagggtgggaaggctgtggaatgagggaatgtgtaccactcttgctgaccctcttctgtggacatgtagaggacttcagtttcagggctgccatcccactgaaaaccagtcagccttaggatcagtgtgtttaaaaacctgtctaccactgcctatgtgtttaagatgagaggtagggcccacttgtaactttcaaactacaaaggtttcaggctccagaatggtcactgttgtctcagccctgggtgtttccaggagacaccgtcggtgggaatgctgtgggtttgtggtccagggactgatctgagagcttttgttcatgaaggaaatgagacaggtctcaggatgtgccccgggcggagcaaggccagtgccgtgtagtgcacttgctccctgagttagggagccgtgtaactgtgccttgtctttaattctcagaagcggaagttgaaggaaggtggtgagaagataaagaagaagaaaaaagatgacacttatgacaaggagaagaaatcgaaaaagtccaagttttccaaagccgggtgagaggcagcagcttctttgctaggataaagcctgaactgttagggcaggacgactgggagctgactcacctcctccccacagcttcggaagaggcagcagggcctggccttcctgtcctcccgcacgcctcccgcagtgccattctgggcatagacgctcacctctcagtgtgtcagatagttccactgtcagtgttggcagctattgttgtcactgtgtgactgctgatgtttctcgtcctctggggtgctcctctctgccccagttctccttctgtctccgctgttttcccttgttgtctatggtcatgcttccttctcctcacttggtctcaccccagcttctcttcaagttgctgctgttctctgctgctcctgctttctccctctaaatacttttcttgctctccctgcccctttttgcaaccttttatttcagcctggcagtggtttctaaaaacccgtcggaaatttagcatatgtgacactgtgttgctaacctgtattaactctcaagctttggtctcagcaagaacgagctccatatgccaagaggagggaggaggaatgacagggtggactgtgacaggttctcctggagaccatgaccctgggagcaggggtgaaggcctctggagttccctttggaggtgtcctatagtctgagtgaccagtttccctcttgcttgcagcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggtatggtggcacagtgcggctgggctttcctggaagcagtttgggcagattgctgttggttctgcactgcgtgaagcttgcccagagaaactcttagtgagttggcagttaaggtgtcagctttttccaaaccctattctcatcctgagggagaaaacagtgtaagccttgcccgtcaggcatcattttaggcctttcttggtttcttcatttctggaaaatttgctttcttctggggagattgttctctttctgttttctgtcagtttgttttccacacggcatcttttccttcatgtgatagacggatgatgttggcagcaggcagctgaggcagagattaatcttagaattcttacgaaggttttgcaaattcacaaaagtttgtaaacatacaagttacacgtagagtagatgcttcgttgccactaggtttcagtcgctcccttgcgttgtgtatccagtgttaggtagtgattacaggaatgcctcaaatgtgatgaatgaaaagcagcttaattttaaatgctgtccatgtcccattaaaacccaccatcggcagggtgcagtggctcacgcctgtaatcccagcactttgggaggccgaggtgggcggatcacctgaggtcaggagttcgagaccagcctggccaacatggtgaaaccctgtttctactaaaaatacaaaaaattagctgggcctggtggcgctcgccgtaatcccggctacttgggaggctgaggcagcagaatcgcttgaacccaggaggcggaggttgtggtgagtggagattgcgccagtgcactctagcctgggccacagagcaagattccattaaaaaacaaaccaaccaccattaccacctttaggatctagcagctcttgctgttttactccagtgattgggaattaagcactgagaattgtctgttcaagtaacacatttctaactgtaaactaggcatggatcattggttgtaatatcatttacctttaagttaaaataacattttaccttaagcatcaggacttgtgatgcagctctagtggcagtcataatctacagctgtaggttttaaatcagtgattcttacagtatttcagaagcattgttacctataatatcctttgtgttttagggcagggtaaattgtcagctactgctaaaatgattttctcacttccaaaaaatatttgaacaccatatacaaagcaaataaagtatctattcaaagctctacctcatctttgtcagcttgtgtccagcattggaaattcaagtattgtatttgaatgtaatgatttaagtgaattgtaccatgttggggtttggagtatctcttagtatgacattgaggtggaagtagctgaatctgaacttggtgtttttgagcctgctgtcctatatttgctctcagaattcatgttaaccaaacattactccttgttctttttaatcctctggttcgtaatcaaattgtttcttagcttctgaaagtcttgttaaatcatttaaggtctatgtgacgatagatggtcgttagagaaaagtcaaaaccagattcttggctgtgtccccactcgtgccataggttgtgttctagtgtgaaaacttactgtttcactttcttgggaaagatggggacagatttagtggcaacagaatgacataaccggaaacaatgttgggctgtggtgcaagaaagcggagctgagtaaacaccttgttaggcaagctgcccctcctcagtgattgccaagtgtcagttagctcttgggcataacaaacacagggttcaggatcccatagtcaaggtgggcctgggtcccagtggggagctggtgaccaggagaggctgatgttctggttggaaaatacagtattcaagtgtgaagttgatattcgagtcttcacattgcccttctcctataacagcattaagaaactttgaaaaatggggtggaaggtgtatggaaattatccatccggccaatataaaaacaatttctagttggatattcttttctagcctctgtgtatatgtttttatgcagctgtaattatagttgtgaataactgttttctgcctttttacgtaatattataaagccctcatgactttttatggttgcattaaaaaggtggcttattttaaaaagatgcttaatgctactccgaagggtcctcaggtgcgctcttctgaccagggccctgcacttggggcacttggagtccctgcatgtgtgtgcaaatgctcaggacccctgatcccactgagaatctgctgggaaagatagtcttcccagggaaggaatgcactggtatactcaaattgcttatgattccaaaagccacatgtggatatttgatatttggatccttaataaggggtccatcctagatcttgaaatggacatcgcatttttaaaatttaaagtaaacctgatgtatgtaactgggacattagcagtgttacgtgtttctcactttattttttatacccctaattttcccccccttttccctctattataagattgggtagactttacatcttggccctaggtgacacacaaatcagtttctatcactgtctgcaaaacaccccccaaaatttgccttgtcatagcagttcgtttctcctgactctgggccaacgctcatggctgcattcagctggcaagttggccaggtgctggcagggcttttctttcctggcctttcatcctgccttcttcagggcttggtggtctcagggcaacatctcaagaggggaaaggtggaagctgcagggcccttgagagctagccttagaggctatgtgtatcacatgacttccagcacacttttggtcagagcaaatcacaagagccgcccagatccaaggattagggagctagggtgcacctctttgggaggagaatttctttgtgggaggaatctgtgatcctggtttgttgttgttgttgcctttttttttttttttttttttttgagacagagtctgactccatcacccaggctggagtgcagtggtgcaatctcagctcactgcaacatccacctccgccttctgggttcaagtgattcttgtgcctcagcctcccgagtagctgggattacaggcgtgagccactgcgcctggcctgtgttcctgttttgtattctgccacagtacatagcagattcttatcccatgtgtattgatcccttaggggaaaaaactctgggaagcaaaattagatatatcttctaactaaatatggtacttaaaactttaaaaaatgtctttgaaaacttgtgtatgttaaagaggtcctctgagagggaaccttggtgatgcctctgccacgttcactacattctcacatcagcctgttttttgttactgatttgtattgtacatttgtataggccccagggaatccagtgatttgatggccttaccctgccctctgttaatatgcattgatggtgtcttttgtcttggttgttggcaggtacaggtgctgacaaagctcaggtttgatgctcctttgggttattgtcttgaggtagtttgacagctactcagccttgggctggacaaataacccagatctattttggttctctttagtcaagcataacatagagacaatactaagagcaggaatcaaagagaccccatgtcacccattctgctctgccctctatagaattagaacccctcatcacaagaagtgcagggagagatggatccaaagagaataacgtagggggaaaaaaaacgaaaacaacttgtttgatctttttaaaaaaaatcatgcccgattttctcctactcagcaaaaacagatacagtatataagattttgagctgggtgctaaaaggctacaggtgacttttcttagaataaataaaacagctcattaaaaggctgttggaactcttataaatcagcatgattgggatgtttaacctcatttactagttaacttaggattgattaattcacacaacttctggggtaagagtgtctctttttaggggtgagggaccccatttatttttggaagactatcagatatatatccaattgctcttttaattagatttactttaaaatgccgcagtcgactcttcagtataaagccagaccctcagagatattgtctatgcaattcaaaaggtttacagaaaagtactttctaaaattacataatattatttaaaatatttttaaagattgcgtaaagattacatagaaagcttctgaaatattgtacaagtggctatctaaacagaaaatttggcagggcgcggtggctcatgcctgtaatcgcagtactttgggaggccgaggtgggaggatcacctgagcccaggagttccagaccagcctgggtaacagagtgagaaaaaaaaatctaaaaattagtcaggcgtggttgcgtgcagctgtagtcccagctgcttgggaagctgaggcgggaggattatttgagcctgggaggtcaaggctgtatgagctgcgatcacgtcactgcactccagaatgggtgacagagtgagaccatctcaataaaataagatgctgggcatggtggctcagcctgtaatcccagcattttgggtggctgaggcgggcggatcacttggggtcagatgtttgagaccagcctggccaacatggtgaaaccccatctctactaaaaatacaaaaaattagccgaacatgggggtgggtgcctgtaatcccagctactcaggaggctgaggcaggagaatcacttgaacccgggaggtggaggttgcagtgagctgagatcacgccattgcactccagcctgggcaacagaacaagactccgtctcaaaaactaaactaaaataaaaaaataaaaaataataagataaaatttgattggaagtttaagctgtagatgggtctgaaagtgtggcatgtgaaatacatgttaattagtttgaattaatgtaagggtgcttctcgatcttaaaactagcagtgtaagcttaagcaaaaaaagttcagttttattttttcccagactaatataattctagtaccttccaagtgctaaggtagaattctgaatgtttccaagagtgtaagaaattggcacatggctgggtgaaaagtcatgccctttttttccattattcgtctgtggatttcacccctctgggctttcacctagccaagggatctgtagaagcttgagttttgcgcattttcttctgacttagttttggttgtttggtgttaagcttttcttcctgtggcgtgccgttttacagtagtatcttcatttgttgattcattcactcagtcaacatttagtaaatattatgtgacaggcagccatgggaaatatactgatgaataagactcagttctatattttattttattattattttttaagacagggtcttgctctgtcacccaggctggagtgcagtggcacgatcttgccttactgcaacctccacgcccagggctcaagtgatcctgccacctcagcctccagagtagttgggaccacaggcatgcaccaccatgcccagcttttttttgtatttttagtagagacagggtctcatcatgtgcccaagctggtctgaaactcctgagctcgcgtgttccgcccaccttggcctcccaatgtgttaggattacaggtgtgagccaccgcgccgggccaaggttccattcttgtctttcatgagctcgttacataaatggacccgatagatacgcagacaatggactgtagtacagagcagaatgaagtaagctttgtgatgtgtggacggccagatagccggacttaaggggttaaagagaggctcttggggggcatataggaagcagactggaggcaacaggcttcgccggcctcctggggaagatgccctaagagaaggcagggagcagagctgaagatgggcgagttggtggatggctgggccagatcgtggaggaccccaaatgccatgtgaaggagtttgggtttgataccaggcttggaaagagctgctgaagggttctgaagaagggagtggcggtcttaaggttggagtgcaattattagaagtggggaacacaggggaagagcagaagccagtgggtctggtgtaagttgagtttgcaaaccagagggtcatccatccacagaagtgcagttgacccttgaacaacacagggtttaactgcgtggatccacttacacgcagatgttttctaaccaaatgtgggttgatttgagggatgctaaatctgtgtatagagggctaactttttgtataggcaggttcctcagggctgactgtgcagttggattttggtatatacgggggtcctgtaaccaatcccctgcctataccaggcgttgactgtaattgggaaatttctcagagataactggaaattctggtccagagcttagatgagaggatttagggcttagtttagatttgagtgtacaattgtctgtgttattttgaagccctgagggggaaagaagttattgggagaagtgggttctagtgagaatcctggggtccgcctatggaaaggagctggtggaggaggcagatggagcagttagagtggttggaaggggccccagaggatgcagtgagaggaaggtgagtgggggagatgatggtgaggggttagcagtgtctgcaatttcagaggggttgatcccttcattctagatagtcaccttatcacccttgtttgctgtcgttactgtatatcatgtctgatttcagaaattttatttcacccaaagccttcagaccagcagctcttgggttgagaggaatggttcccagccctttttgcacatcagtgttcccagggttgctttgaaagagtacttgggccacttttgagagtgtgcattcctgaatctcctttccagagactgtgatttgaatggcctgagttgctccaagctgcccagggaattccaatatgcaaccaagtgtgagaaccctgatgcagacttccacagggtctgcttttttgtgttcccgctgtgtcgtggctgcctgccgtggttgcttcaggggtctctgagcttgccatccagggtgtgtgttaactgtgttcttttcgaaagcaaactaagactgtactgaaactcctataatctggtgttaataggtaatatggtgggttaattattcacatggtctggctaatagagagctcgtggtataccataagtagattaggaattgtcaaagagttttaatgtccttaagtgttagagctacacattattattatttttgtagataaaaaggcctttaaatcctatagactggttgaagttcttgaatatttttgtactgtagatacatggaaatcccaactaatggtgtagttgatggtgtatgggtgcaggggttagttggccttattggcctctggctaagtgcattgtgatggctttgactctgattttcttttctgtgactgttttaagtcccaggaagaactggcagcccacagatgctgcagcagcatttgaaaagagaatattgatcgcaggcgaacttaacctgggactagggtggagttggaaaggtggcggtgtgactgtattgacaggtgctctttatggagcgatgactcctgtgcctgtgggtgagcgtaagggacatgtggggaaagtgcactaacggctgttactgtctgctgtgcaccaggctgccagagctgctgagggggagagcagacagaagttcttcacccaggatattaatggaatcctattagagtgagtatcgtctgtctgtctgtctgtctgtctgtttctgctattactgagcttggggcaagccagctaggggacagtgggagtacaattgaactgcataaaggtgaccaccaaggagataaaagaagaattggattaacatggtttcattgttatttttcttttaaaaatcaaaacacaacagggacaccaagtacttgtctccagaagcgatagacctccttgatcttaggcagcaggcattaataacatgtgataatcatggcctgttagaagaggatttcttggcaggtatgagatgaggagagagagaaggtgttgcctgactgtctctgagaatcctgaagaatgagagacagcctggtggcctcgggcctgctctgccttgggtgttgcttggcgtccctggctgttccgctcgctggcactcctgttcctagtgccacgtgcatcatccctaatgctgttcccacatgcctgagcctctgagacaccacgctgtgtgaatcgggttaaaaaacagatgagcaaacatttgtaaatccagactgggaaaagtgaatccttgtggcctggcctgcagtgttgccgcttttctcctggttgcagtttgtggcaggggaagcttgttgctcaacagctgaggagtttgtgtgtgtaagaacagttgtcaaaatgtgggtgttctaccacatggcctcgcctggccgggacctggattggccccttgggtcaggaagtgtgagctgcagagagcacctgagcattggtgcggacgataggattgtgtcaacaaggaacctgcttgagcgtgccaaatgtggacagctcaaggcattgaagagaaatatttttttgcttatctagatggagaaactggaggggtgaggctttccctgacctcataatggttgataaacgtggggactgggggaaaaaaaagaaatgctgccgggaagtgtctcctttgaaccccaagtaactcatgactttccactttgaaagctttcatgttttctctatgaaatttagtgcttcagagcttgttctcctgggctctgttttcctggtattgtgacctaagagccttggcccacattacctagccatgttcatcaggcttgggagttgttgttgtttgttgattgctgaggatgtgtttccttgggcattcagttacattgtgtgaccaacaagacagggtttgactgccgttggctcctagctttcctctccacgtacggtgagctgatgaagacaggagttgcagtgagctgcagccggtggtgactgtgttttgttcttcagcatagaggcgcagactcgggagctgagcagtcaggtccgctctggggtgtatgcctatcttgcgtcattcctgccctgcagcaaggatgccctgctcaagcgtgctcggaaacttcacctctatgaacaggtgggtgactctagagtgaagccctttggctttggggtcctggcggaggggtgactgagtcttaagcaatgatgcgtctgctgccccactgcctccttgtgatcaccccatcatgcgtcctgagcgtaagagcgatgtgtaaacctgccttgaattgtgtcccgctcttcgcaggggggccgtctgaaggagcctctccagaagctcaaggaagccattggcagggcgatgccagagcagatggccaagtaccaggacgaatgccaggcacacacgcaggcaaaggttgccaagtaagtttgtcctggcgcttgcaggtgcaaccctcccgtcttgcctcttcccctcccgtttctcggtgtgtactgccgtttcccaaggagcctcttggctcttctttggccttttctccttctctgtgaagtcccagtagtgcagagtgaggggagaggcggtgggcaggagcaccttggggccccatgtaattctattcaccccgtaggatgctggaagaggagaaagacaaggagcagagggaccggatttgttcggatgaggaagaagatgaagaaaaagggggcaggaggataatgggacctcggaagaagttccaatggaatgatgagatcaggtgtgcccacactgggacttggcctctttggagggttggtggggcagtgtctgagcacgtcccctattgctgacaaaggttaggctcatttactttcatcagggctgctgaaagcacatgattggaaccttggagcagcatctgaagtagtttggagtttctgatttctgcctccttctcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccaggtgagggccgtgtgctgagatgggcatctgtgcagtcaagacacgtttgaacgctgcttttgtgccaggccaacaggatccttgctcacagggagtcactgtctagctgcctcaactctgatctcacctgagtaactgggggacatgcaggtagctgggaaagggtcttctggatcttccctggaggaagggaagttgcctccagggttttgtttttgtcattttttgtcccacttcagttgatgtttggcctcccatctcaatatgcactttccttttttttttttttttttttttttttttgagatggagtctcgctctgttgcctgggctggagtgcagtggtatgatctcagctcactgcaagctccacctcccaggttcacgccgttctcctgcctcaacctcccgagtagctgggactacaggtgcctgccaccatgcccggctaattttttgtatttttagtagaaatggggtttcaccgtgttagccaggatggtctcaatctcctgaccttgtgatctgcccaccttggcctccctaagtgctgggattacaggcgtgagccaccacacccggccacacttcctgttttaacatacaggctgctatgagcatttgagagatgggttcatcttgggtctttcctgatgttcctgaagaagtgtcatttgcaggtagcagggctgactccttattggaactaagtgccaggcttccatctcagaggctaccttgtacgaagtcacttcctgcgaatgaagtatttgtgtcatacatgggacagagaaagttagctggagtgattttcttgattggactcgaatcatctgttgtgcggatagatcttggaacctttgaaattgctgtcctctctacgtaggctggactcatacgaagaacgtttttgttgagtttctctggacaaagacatgctgggtcactccacattttattcctggaatggagggactaggcaataaggaaagtgctgtgccctttagggaagcatcaccatgagaggtttgaggcagagccatacattttcttggtaaaggccagactcagcctttgggcagccagtgtgtcccattgagatcctctcaccaggaatttggctccccaatccattgacctttttttttgtgtgtgtggggggtgggtgggcatggtgggggggcggggacaaagtctcactctgttgcccagactggagtgcaatggcacgatctcggctcactgcaacctccgcctccccggtttgagcgaatctcctgcctcagcctcccgagtagctgggattacaggcgtgcgccaccacgcctggctaattttagtatttttagtagagacggggtttcaccatgttggccaggctggtctcgaactcctgacctcaggtgatccacctgccttggcctccaaaagtgctgggattacaggcgtgagccactgcgcctggccagttgacatttaatgagggatagctactgaggaccagggacactagcaaagttctggaagcagagtcccagctttctggggcatgtacagatgcctggtgttctgtgtctttcagaactctgtttaaggagagcagacgaggccatgggcacctgacttcaatcctgtgagtgtcttggtattttcacatctcgggacaagtgttgtttttggtctcctctggatattctctaaacttttctgtgctcattcctttgaacagggccaagaagaaagttatggccccttctaaaatcaaggtgaaggtgagtcagtttgctcgggtcacatgtcagctatgcccatctccctacaactatgctctggaaacagtcaagtgactgtggaagctcattgatctttgctcgtctggggacagctgctcaggatgacattcttgaagtcataacaggacagagacccaagccacttaacccccctctagccttggttctacaaacagtacccagctggcccagttcctggggttcatgtgggattaagtgggatcttcttggcagccctctgaggagtcagtagtccctgaaggtgtgaacgtgttacactgtgatctttgtatggaagaaatacactctagccaagtgcagtttagcttggagccacagcagaaagaaaaggcgactttactgagctaccaggcagaaatggagggcaatatagtggctggagaatagacactgtgaaaattaccttagatgttgcagaaacctctcaatgtagtaaaaattgctgtttatcaacatttttcccagttcttagtgtggtgcccttagccatccctaagcagaccgtgagaatgagatgtgcaaatcatttactcctaagtatctgttgagctcccacaatgtcccagacacactgtattaagcaccagggatgcaggagtgaaggattagaccccattcctgttcccatgaaaagctcactcttctttgaacccagtctgaggagatgggtgctgggaaaaatcaagaagggaaaaatagctgctttaaggcaattctcatgccatgccttggtctgattgcagctaggagtgcgctgagacagtgggaatgccagtaggcagagtatctcttcacgagagtcttaacgcttttcaaaacagaagaaagtttctcctggcggcttgtttgtacttagcaacgaagcatgccggggtaaacccagccctggccaaccagatactcaccaggggtgatgaagtcatggcatctaaagtcaaggcgggcacagctcctgctctgtcccaccacttgtcttgtaattatacaggaaggcccagtttttttgactcgagttcacatgtttgtatcctcacaacaggccaatgttggcatctttggacctttctaaacatcaacatttctgttttcctttaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcagtgagtatctgtcatagcagcctgccctgccccactcacaggggccttggggatgaggttgcttgccttgccccgggtggagagtgagatctaaaaccacaggtcaggtaggaacagtgggctcagacgtaggaagggagactgggctccctgttctcaggtattcacttttctggtgacaggaagcccaggatggcctaaagcttcttctgaggagggcagagggacctaaaggatggccagcaccaagcaccatgcctcttcggaggctgtctgtgtggcacagaatgagcaacagcccttgccttccgtgaccccttgcctctccatctctctaaagggggctggaaatgctgtcttctatcagttgagtcatgtggaggtgttcatggaccaggaatagcaggaccttctaagagtgattctgttggtttttgaaggacagagtccaataattaatgcatctcgcttgtgtgtaatcacagcaggttcgggaagagggagtgagcattttcttttctttttttcttttttttttttttgagacgaagtcttgctctttcaccaaggctggagtgcagtggcgctatctcggctcagcgcaagctccacctcccgggttcacgccattctcctgcctcagcttcttgagtagctgggactacaggcgtccgccaccacgcccagctaattttttgtgtttttagtagagatggagtttcaccatgttagccaggatagtctcgatctcctgacctcgtgatctgcccgcctcggcctcccaaagtgctgggattgcaggtgtgagccactgcacccggcctctttttctaatatataaatgaagtggttgcaaagacaaaaccatagaaaggtctgttggaggtctcacctcctttcctgcacccaccacctctgtaaggtaactaagctctttagtttctggtttattttcctctttttaaacaaaagattaataaatataaataaaggtatatatgtatgtgtgtgtatgtatgtatataaatatatatacacatataaatatccatgaacatttatggatatctatattacatttttcccttcacaaaggaggctttttttttttgagacagagtctggctctgtcacctaggctggactgcagtagcgcgatcacagctcactgcaacctctgtaggagacatatttaatatcctgcttttaaaaaaattatgttccctggaatccattccatgttggttcataaagactgtcctggatcctgtctttggggctgcagggtcggagggtgcctcccagggccatctgacatggatgtgtatgtcctcctttgtggacacacaaggaggatcctttgtgttgccaggtttggtgtgagtgagccacgaacaggactggagttcttaccgcttgctgtgtttcttccctagaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtaagtgcttctttgctgcctctggtcactcaggaacctctagattgtggccaggggtcctgctgttgtgtactctggttcctgtgtttgagtctggtgtgtgactgtggggaacatctccgggaactgtgccaagcccccactgcccctttgggtgtggtgcccagactggcctggcaggttatcgggggcttttggctgctggagctgctttcctgttcctgtcttcaatgtgtgtgttttgttcttttctcccctcctgttttctctcaggtcttctggctggcttgcactccagcccgccccatgcagcgcctctcccacacgctgcggtgcccacccatatcccgcagagtctgccaggtaatcacccgacggtcagtgtgccacgcgcaccgtgtgcctttgccctctccacccctaggtgctttgccgctgccaagggtcttggtgtctttgccttgacgctgttgttgttttggtttgtcctttgaggctgtgctttgtcagtactcagggtgacacgcacttctactcttggggtttcctctggtccccacttggagctgccgccaggtcagcctcagcctgtgtgatcacagggaaagttgcggggggcagggtggtgcgcttttgtgtgcggtggaggagttcctaaccctcggcttgtttttttctcttcagtttaaaaaaaaaaaaaaagggaaggtaatggtgcatcttctccaagggctaattgggtacaacaaggtcttggaatgcaagctgctccactgtcagatgtgattgcttaacagaaggctctctaaactttgtttccattaaagggaaaatccaggtagcagccagaggccacagtgcaagactttgagaggagcagctttaaatctgtccaagtgtgaaaactccatcagaacagatttgtgggagcacagcaggcatgtggtcggtgctccccttagcatcttctgaaatagggaacttctaaaagcctcaggcttgaggctgctctggtagcacctgagaactgggctcaggtgccccgggttggtacctttgcattgagtgcgtctgcctcaccctatcccgagtctgcgattcttgggtacgcctcctggaattctggcatgggaagtctcatggtgtctcagctttgacctagcattgttcctactgtagacccgcttcagacatgaccagggtgctacttggataaggggagagccgctcgtatggaagccagccgaggtaaccctggcgaactggtgccaggtggaagtaaggaccctctgtgctgcacgtctcccaagttacatctgcctcatgatgtgctgtggctccctggcaccatggcgcattatagtaaacaccagaggccatatggggcaagactaaatctgtaaatctccacaatggaaactgtgcttctttgaggggctaagcctatagcactagtgactcctcctttccttgggaggagaagtaaagtgcagtgacttctctacagactagaggctgcagagccaccttggtgagagcaggggtctttccaaagtcaggctgccctgcctttgcttactctcaggaatgttactctcagaaaagcaaagtaattgaggccggacgcggtggctatcacctgtaatcccagcactttgggaggccaaggcaggaggattgcctgagtccaggagttcaagaccagcctgggcaacatggcaagaccctatctctacatttaaagaaaaaaattagtcaggtgtggtggcatgtgcctgtagtcccagctctttaggaagctgaggcagaaggatcacttgagccgaggaggtcgaggctgcagcgagccgtggtcatgctactgcactccagcctgggcaagagtgagaccctgtctcaaaagattgctttctgctatattttcatttttcctctgggtatgaaaaggctatcagaataggaagaataagtgctagtgttctataccactgtagggtgactgtagttaacagtagtatgtagtttcagttaggaggaggatattgaacgtcgccagcaaaaggagatgaaaaacgtttgagatgatggatatgctaataactctaacgtgacactacacattttagatgttgaaacatcactatgtaccccataaaatatgtgtcattattatgagtcagtttttaaaactgtttaaggctctcagaggctggatgtggtggcattgagaggcaggaggattgcttgaacccaggaatcagagggtatagtgtgctgtgatcatgcttgtgaatagctgctgtactccagcctgggcaacatagtgagacctcatctctaaaaaaattttttttaatcagtttaaaagttcgaggaaaaagaaaatcaatcagaaaagcaactataccaaaacagggttatccaagtgagcttctctcacttccttagatggacttcagcttataggatgacacgagatgcgagtaagaagctatttgcgcatttcagctgcgtgacttgtgtctgcgttgctttcctttctttcttctgtggactgagaatgctagtgcctttgaatttgtctttacaggacctgagggtcttttgatggtaagagaatgaatgatcattgctgccttgagttctgtgtgatcgtcaggcctcgcctcaggatggcaattgtagcctgagatgacgtagcccaagttgcacagcagagttgctgttctggaaacactgtgctgagtgaccaccgaccttcacagtgctagtgtgcttgcaggctgtggccaggagtagtgtacacgaataactgctggctggtgtctcatggcttgtttgagctctagaacactcagcatttggggacttttgctatttaggtgtctcccttgaagtttggttactactgccttaaggaaatcagagagcatgaaaaacttgcgttctaatttttcttactcttttccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacattttttctcactcttttctttctaccatgtggaagtaagtagttcttcctgtaggagctgttacagatggaatatccattttggctgaaagccaaggggggggggcgggggagtaagccttgcatgcaaaagaagaaacatgtggaccgtacaagcagactccagccaccaggtttattttcatgctataaataaatttccctattagttcccattttcttatgttctacatgagatacagagacccagatattggcgtggtgaataatcaactgttttgtatacctaaataccagtgagataataagcgagacttgtaaagcactgaaactaaggctaacagcagcacaatccactatcaaaggatttaaatgccagaactgtgaaacattctctgtaggtgccgggacagtctggtggctgacaattaacgtccactccagcaccgagggctggacacttgtggtttctgttcacctttcctggcttggagcccagatctgtctcatgagcagagtaactactgaggaggcttctcggatggaaagttggttttaagccagaaatctggagagatgtcatgccaggcagcagcccccacgggcccaggcctttgtggggcagtgtcactgtctggtgtgccaccagtacccatgctgcaaggagtgggcttggctgctgtggttggcttgtccttcagtggttttcagattgtgtgcagttatcatgaggagtttgttgctgggagtgtacaggaaaagggaggaaaaggcatcgcagttgtccagtcattggaggatgaagtacgtcactcagggtgaatgatggttgggacgagagttgcctgtcttcagccagtgcctgtctcatatgtgggcgggactctgagcagcctggcagcgagggtatgtataaaatgcttggcctgcaccagggcaagggagaggacgacaccaaggaggtcactgcgtcgtaggagagggccagcgtctgccgttacgaagagttgcaagagctgtgcctacttctgcccagataccaagaccgccagctcctggatggacatatccttgttgacatagcggtcatactgagcaggggtcagcctgccactctgcagggcctcttcgatggagaacttcttgccagacttcctgtcgtgtatcactgaggactccccattgggacccttcactgagatctcctcccagtcgcactcctggcttctgagtttcacgaacatgttccagtcaatgagcccggcacggtgggcttcctccggggacagctcgcggcctgtgtcagggtggatgactacgatggagcgccgcaggtggttctcccgctgctcccgcttgacggccacggagcccaggcgcttctgcagctcgtcgatctcgaggtctttgtccttggagagcctcttgaggtcatccagttccctctccagggaccacagtctggagtcatggttggtcccagagtccgccacggtcatgttccgcaggtctcgtgtttccgtcgctgccatgttgatttccgattggagccttcgggtctccagctgcaggttttgcctctccagctgtaatttgtggttctcttccctcagaaagtctagttccttggatgacttggagttatggaattccagctccgaaagcctggcttccagccggctcacctcgacgtccagctcgcgcttgctgcggctctcctcctccaggctgctcttgagcctctggatctcttgctcggtgtcgcccttctccacctggacactctcggagagcaccaccttctccttgacctccgccttctccagtgcagccagtttcctccggagggtctcgagctccccctccaggagctgccgccggtgctgctcttcttccagctggagtcggagcagggcatgctctcgcgcctgctgcgggtcctgctgcagcaccaccttctgcgtatgggttaccttctcacgggcctcagcttcttcctgctccagcgctgccagccgctgctgcaaccgctgtacctcgcgctcggcctccctgcgggcctgccgctcgcgctctagctcctccagctgccgctcaagctcggtgcgccggcgctgcagccgccgcagctctgcccgcagcttgtcaatctgccgcagctccacatcgatgctctcggcaaaggcgctcgcctcggcccgcaggcctggctcctcctcatacctgaccacctcctgctgcaccaccctttccttcacccgcgagagctcctcctctttccgggcgatctgctcttcctgggaagctctttccctctccagatccacttgtttcttctgctcctctgagagctttgccctcagagacgccacctcctccttggtttgagggtcttcttggaattggaggatctcctggaccacctctttggtctggacctggggtttggtgtctttcagggcctggatttcctttttcagctggtagatctctaaatcacacctttcgatcagtctggtcttgtccacgatctcctccctgagccgctgaagctccttctccatctcagggtcagtcttgtacttaatgacttccttagtcacctctttgacttccacctgggggcctcgcctcctgagggcctccagctcactctggtagctccggagctgctcctcggcaccccggtactttcgctcctgctccacaagctccaggcggaggttcgccacttcactttccgccttggggtctggccgcacgatctcccgcaccttctcctgcaccaccactttggcgttctcctcctccaaggcccatatctttcggagcagctccgtcttctccctctggctagcgcgagccttggcagcctcgtcctcatattggcgggtgagatcgctgacctccctctcggtggccgcgtccttctccaccttgagcacctccttgacggtgatcttgccctcggccatggcccgctccttctctagcctcttgagcttgtcctggaggaagctcagctcctcctcctgcttctccctgagctggtcctggcgctggtggtcctcctgcagctgctggtactctgcctccagctgggggtcattctgcagtttcaccacctctttctctgtgaccttctcctgcgcccggctcttctcttcagccagggcggccacacgctgctgcaggaggagcacctctgcctcccgggcgcccttctgccgcctcagtgcctccagctcctcccgcagctgcaagacctcatccgcctgggccctgtcaggctcgatgcgcaggacctccttgaccacgtactcctgccccccgtctctggtctcctgctccagggcacgcagctgcagctgcagtgcctccagctcctcctgcagcagctggttcttgtgctgctcctctgccagcgtccgctgcagctgctggaagctctcctccagcacgggatccggcaccttcttgagcacctccttcctcaccaccgattcctgaggcccctgattcctcaaggtccagatttcttcctgggtgctcttgacctcgttctccagctgccgcctccgctcagtctcctcatccagttccttcctgatcttccacgcctcctccactccagagtccggcctattcctttgcagggtctcatgggtcacttctacttccggctgctgtgatggagaagacaagacaaggttaaagccaggctctggcagcacatgtagggcctgtccccacctggtcagagtggctgtcctgtggtccccaagggactccctcagtgccagttcatgttagttgtagagttctagggttactttcaaaaaggatcaaacaactagtttggggttttttttaatcaggtaaaacatttttgagctgtggaagagtttaaaatgaaaccacggtctcccacctctggtccccgtcctagggcgtgtctgtcagccttgcagatgctatctgtgctcacacaagaatatctgtctgtagtatgtaccatgtgtttatctctcctgcacaaatggtattcctgctgctcactgcacttacagagctcattccagctcagcacagagagtgctgcttcaggatttaccagcagcattgtttccgctctctggacagaccgcagtttagcccattgctgatgaagagtgaactgcttccagtgtcttgctattaaaaaacaatgctgtcatcaacatcatggacttcagaaaataacattcactttcttttgtttctttctttttttctgagacagagtctcgctctgttgcccaggctggagtgcagtggcacagtctcagctccctgcaacctccacctcctgggttcaagcaattctcctgcctcagtctcctgagtagctgggattacaagcatgcgccacgacgcccagctaatttttgtatttttagtagagacggagttttaccatgttggccaggctggtctcgaactcctgacctcaggtgatccgcctgcctcggcctcccaaagtgctgggattacaagcgtgagccaccatgcccagctgaaaatagcattcactttcagcagatgtttactgagttgaataagttctcatgtcagtagaagcattggctcgggccagtctttgcattggccctgcccagaaacgttagcaaggggacacttccatcaattcacaaaccatttctctaagacagagtctgtatttgtcacctgttagaacagcctgaagtagaatttcttactaagatcagttacctgtctgaggagattcagagcaaactccagattctgcagcctctgtctgttgatggcataaacttcagtgaacttggcggcaagtgctgcttcctgcagagaagaggattaggagagcggtcaacaaacaggtgtcaacagggtaagcaacagagagctagacagcgtggacgtggttcttgagaagtgtggaatttgggggtagaggcatagctcttgcccactcctgcctggagttagactgtagcctcaccggtggagagaaaaatggatctcgaggcagaagatccaggccagggtcttggccacactgactttgagcaagtctttctgcctcttagagcaccagtgttctctcttgtgtgtacaggagactaatatcagccctccactgtacttactgaggtgagcaaaacaggaacttcccagatccatggttctgaccctgacacttctgttcagctgcattttcaaaaatttttatttcttaaagacagaatctctttcactcagactgaagtgccatggtgtgattgtagctcactgcagccttgaactcctgggcccaagtgatcctccctcctcaacctcccaagtagctgggactacaggtttgcaccaccacgcctggctaatatttttgtagatatggggtcctgctttgttgcccaggctggtctccaacccctgggctcaagcagttctcccacctcggcctcccaaagtgctaggattacaggtgtgagccactgcgcccggccttgctgtctttctaggcatattgatgtcactgccctagaacaagttcctcatctcttaccaaacctgtttgcatgcaggagggctctcagtggcttccctgttgtgtgtgcatctctgaggccagcgtgtgacaccatgctccctggggagcagggcagcttggcctccacctcagtcccgaggccgcctggcccatggaactcacctcttccttcactttggtggcaggagattggagcctggctctcttgctcacgtggcttctccttccattctccaagtcgagaagagaccttagtttttctgcttctaactcatagtcctgcatgagggagagacatggcagaggggagattaaaacagctgagaagagacagacatgttcctgtaccccttcaggctgacccagacctgccctgtgccatgtgctggttttataatctgcgtgggtcttcctcacagctgcaccctgcagtgatttccaggaggttttgagaattactgatatctcagcagtacatagctccatcactcagtaacatatgagacaagaagtgccccctgaattcccctcccagcctttctacatgcctagagattttcacattctgctgctgcttttaacatcgtaccataaccctgtctcaccttgccaccacctcttctcatgtttaccagcttgctgactttataatccatcaggtggatgtgtgctgattcacgcagctttccccttccactggacaccagtcctttccagcgtactagttttgctattgtaaatagtgctgttgcaacaatgttgtttatcctgcatttttttttttgtactttttccttaaggataaattcccccaaagtgtttactgcttcagagtataaaacccttttacagcattccatgtctagtaccatgctgttttcccaaaagcctgtgccagtttgcacagcagccggcagtgcctcggatggccagctccacccccatgtgccagggccggtgcttgctgcttctctgaccagggcacggtggaataagacccctgctgtttgtgctttgggcggaagtttcccggctcacctttacagcttgctggtactgctgggaattggcacagatcttctgtacttcctgctccctacttgctatctcatctagcaggttctgtaagacagagtttaaaaatcaaaactaaccagaaaaaaaatttaaaaaagcaaccatggatgcagtagctggaaatctcagaatctgaatttattcttctctagcacaaagtatgatgaatggctcccttgtatacatttttattcattgcaaaaggcagtttttttgttgttgttgtttttttttttttttttttttttttttttttttgagacagtctcactgcatcgcccaggctggagtacagtggcgcgatctcagctcactgcagccttagcctcctgggttcaagcaattctcctgcctcagcctcccaagtagctgggactacaggctcctgccaccatacccagctaatttttttttgtatttttagtagagatttggtttcattatgttggccaggctggtcttgaactcctgaacttgtgatcctcctgcctcagcctcccaaaatgccgggattacaggtgtgagccaccgcgcccagccacaaaaggcagttctaaggctctgtgaagaagggccaagatcattatctctgctaggaaacaaatgtttactgatgatttggaccaccagacactgttctgctgtctgacttagattatctcatttaatcttcaaacgatgccaggaggtaagcatcgtgacctccagcttatgagtgaggaaagcttctgaggtggggatgtggctgatggggtggacccgggatttgcatctcagccattggcttcccgtgttcctccctcaccccaaggcactgcgttgggcatgggggaggcaggagtcccaactttgaaaatgggatttcccccacaaaggcggctcctcattctgtagctgttcactcacatagccaacccacgccaagtgtccattctgcaccaggccctgtgcggggcactgagctgggagaggtgagcgacacactcggttcttgttctcagagggttgggtgttgggagcttgagctgaggcccagggaggacacagctgtggcaggcctctgccctgctccacctcccaaaggcttggctccccagaaaggggcttgttgacctctgaccctcccttgccagtgtgtgcctggggctgcggaaacggccatctcaccttctggttcttcagcttggtctccatctggctgaggctgtctgtctcctggggctcgtaactggggatgctgactaggaactgcagcacgtggtcatggccgcggtggaagtgctcgtaggctgccttggcgctctgtaggctctgcgccctgtcaaggcaaagcgttcaggcctcagccacagcaaacagatgcctcaccgagccctcatttttttttttaaagtgggaaacaaccaaatgtaacaaccagaaataccccaagtatctcccacacagggtgggtggtcattagggaacgtcaggttggactgtggagaaccaggtgggtccatatacattgacttgcagagatgcccattgtggattacaggacccaggtaagcatgactcaaaagagagaccacagggccgtcagagaatctgacgaactcaccaaaaagaaaaacagcaaaatctgtgggacacggctaaagcattgcttagagggaattagatcgcattctcagaaaacaaaaatggccaccacccaccgcaccctcacctgcgttccacctgctggcgcaggttgttgaaacgctggcccagcttgtgcacctcggcctcctggcgctccaggtccggacagtgctcctggaagcggctggccagtgtgctcgagcactgcttggccgcctgcaagttctgctccacctcacccaggagggacttctgggcctgtaactcacaggccatggcctggcggggcagaggaggagacggcggtgctacggccagagctcccagagccaggcgatgacacccactgaagcccctgggccactgactgtaggagggtgggcaaggccacaggtaggaaggaccggagccttgctctgtacatcccaaacctgggtcacttctgccatcttctgttttttaacaatgaacaaagccctgaaaagctaacttctaaaaaccctgcagcaggcagctcgtgccctgcgcgagaacagcctgccactgtctggtcatgaggctgtggcaaaagcaagtcgtgagatgggagtgtgaataaggggcctcaggtcacagacttgaatgtttcctgtgctcaggcagtgtgggaagggggcccgtggcaactgcgaggtaagcaggccgagaaggcagctgctcctctgcccactgacttgccctctgagctgcagcccaggatgccagctctgctcagcaagagatactgggaacatggattgttatgtgctttatgcttttttttttttttttttttttttaagagatagggtcttgcaacgttgtccaggcggctggacttaaactccaaggctcaagcaatcctgccccagcctcctgaatggctggtgttacaggcatgtgccactacactggctattgcagatatttgatcttaaaatgctggcacccgaaatcccgtaagtcacacagatcccgtgaatagcttggatttgtgctgtgggcctccatttgcagttcccaatttgggcattccaaacctggggagactggatgctggtgtcctcatctatccagacgggcgggtggatgtgccagatgctctcacctgctcagagaaggactcccaggacttgggccctagactcaccgccagctcctgccccttgctgtccaggacacggctgctctcaggcactgtgtcatcctgattcagatggttctcgtgtgtggccagcaactcccagctctgctgcaggctcttctccaggcggttggccacatcaaccctgagagcaccaatcaggcgtcgggggatgcccacctggccccctgaccccaccccaacctccatgctgcctgtctgccacccacttctcctgggccaagtccagcagctgcaggaggtgctcgtatttccggttggtgtcctccacccgggtcctcagcaggggtgtggtgccactgcctgggagggcctggatgaaggcttcgccctcagccgtgctccgcgtcttctcaggttcaatccgcagtagctcgttggtgatgttctgtgggaaccagggcccctcagttttggacacagccaggcagccccttcccctgaggatgtgcccagggtgagcacagattcccacatcaggcacagtggaagcagctggagaggcctggcacattctggggctctgacccggcatctggaccccagcctgagggctgtatttttcacgagcatcccagggaaccgctgaggtggaatggactagtgacaccagaagcacccaggcagctgccgggcctgtgctgtcctcagcactgcacgcggacgcttctgtttaatctttgcggcaaccccgggaggtgagtactacgactccacccagtcacgggtgggggtgtgacgactcccagcagcttaggaagggacttgtggggtcaggctacacccgagaccggcatcctctcgccctgacttggctctcactctgaggccccatcaggggctatggcacttctccaatcccagatcctcttctgtaaaattggagtgctactcactgcctcagagggctgccttgaggatgtgggagactttgtataggaaaggaggtggggggaggtggcccctccacgtcccccctggcatcagctcaccctgtcctcgccactgccctgtgagcagggccaacccatcctactgaagacactgaggcctggagtttataaatacaaacgctaacgtgtttgcagtcaagccagccggtgacccagtcctgcggaattccacagcccatgtgccatgccaggcgtcagatcgacaagccgtgcaggaacaatgcaagtcctgccagctctttctcctggggaggtaatgacagcagccctgccacctccatgacttgggacccttttacatgcagcaggctgtccctgacagacagctgcagtgaatatcccaagactccatggggaaaagacctcaaataggggccccagggggccagtgcagggctcccccggccccacctgtgctcctgacccgcaggtaccttgaggtccttggcccgctcggcactgtcctgcacagcccggccttgctccagtggtggccgcaggatccctgtgatggccttctcctgccggtccaggtcgctggccaccttgtccaagccagccagcagctgccgcccctgtaggtcagaggcatctgtggagggagggaggacacaggcaggtgtgacaacgggccaggggtgtgaggcccagggatggacctaggcagccagccccccgccgtctcatccacagcacagaccctggtccagcccctcctccccggtacccccagagcctcaggcgagtggccctggcacccacctccgggattctcggtcttcagcacctcataccgctgctgcagcgtgcgtttgctcccagctgccttctgccgcacgctccggtactggctgcccaggctgtgaggacagaaatgagctgggaacctgggcagcccaccaccccctgcacccacagaggcgggactgcggactctggctgggcagacaccccagaggagcctgacagctccttagatgcggacagcaagtgctcactgtggcactggcctttctgtgctcctgggctcagagctcttctccctccttccctcctctttcgtaggaagtctcactacctaaaattgtctgtccaataatcaccaccaagatgttacttctgagggagcatacacagtaggtgctcaataaatacttaataaatgaaggcattccttgaatgatccactcattcagcaaggagttcctgggcacctactttgtaccaggtacttaactaggccctggagagaggaaattcaaggagcccaggcccaatgagactgacgcatacgctagtcacttaataaaaagcggtgcgtgcagtggaagaaggtgcctgggagcaaagaggaggcagcccttatcccagctgagtcctccagccaaggggctggggtctgcaagtacagggagcagtgcgtgcgggagtcaggggcccttagaaactgcttagaaactcgtgagggggccaggacgaagcccagagctagacattcatgtttagcaagtcagctggcccacaatctgcccctctcctgcatgaacttccaagggggtgcagatggagagtgtcagcgaccccgcgctccccacaggctgagtccaaatccccggggctatgaatggggcctgagaagccctgggggtgggactggtccatgcagactcccgcctttgcccttgtacctgtcagccagagccagggcctcagggtctgtgggggggatcacaaaacacacggccggagcaatcagcttgttcccagcgctgtccatgagctcccagctctccccgttgttcttctgcagggtgtagctgtagccccgcgagatcaggccctggcgggggcaggctggacagtcaggatcccggcagggcctgagggcctgggagcccggttgccatctcagcccccgactcttggacctggggagccccggctcatcacttggaccctccccgtagagtggggaggggcatgcaggagaagcacatgtgttgaggctgccggcccagcaacccacctccatttccctttggggaaccttccctcccaattcccagtccctgtggtctctccttctccattcccaagctccagatggacatgtgacttggacctggccaatgactggcattcgccagccacagtcattggtatagggtggaccctggcattccctggccacagtgattggtgtaggatggacacgtgactcacagtgagccaatgagaacctggcctgggacttctgaggagggactggggttgctaagctggtggaacacaaggccagggcagccgaggtgggggcggcataggggtgccagttggcctgcaccaggggaagggttggcagagtgacaccaaccacggagacaggcacaggctcctgagaacggcgcctgaggcccgggatccaaccatgttaccccaaaaactttgtagtgatgtgaacagaggagctggccccacgcacctgctccccctcaaagtcacagagtgcctccacggggatgggcttgagcggagtctcccggcggtacttgaggggcaccacctgctggcctcgcttctgcagcccctgcaccacgtcctcatacttgtccagcaccttctcctggtcctggagagaacggggtcaggggcccaggtgagaccaacagccttccccctggtgggaggacgcagagcaggggctggattcagcaggtggggtgctgtggaggggcctgtacagggctgagggcaggcatggtgtagaggggtcccccgccccccgggccagcaggggtcctgggccatcgctcacatccagctcccgcagcagcagctcaatctggtaccggtccttgaagtcagggccatacttctggttcaggtccgagtccaccttgcgcagcagctcctgagcgtccttcacgtcttcgtgaaactaggggagaaggtggctctgttacagccaggaaaccactagaagcacctgggcttctgtcggaggcttcaagctcatccctcaggcggggctgggcctccggttcacctggagtccagcatgggaccctgtgctgagcctgaggctcctctgcgtggagacagccccaccctccctgagctggctccttaggggcctcactgggaaaagccaggtcccttcccacccatccatgagatgccacctctgtgacatgttttcttggatgtatcagtaagtcttgaggtgtctttgattcagttcctctctctgtactaggaacatccagacttaatactatagcttctttctaggttttgataatagcctcccctttttgttctcgaaaattctcttgcccattcttcagtctatcaactcttggttcactgtcagctatcccctgggctgagcacctgggctgcagccataaacaggacctgaagcccccactgtgcggctcagacagggaatgaggagtgacacggcgtcgcccacatccagctttccccagacacctcaatcctaagaattacccgcagcttcttaagaactctcattcctctggaaacagacaagtgtccagccacagatgagtggataaacacagtggtctagccatacaataggatatgattcagccataaaaaggggtgaagcactgaaaatgctacaacacggatgaacccggaaaacatgatgctcagtgagagaagccagacacaaaagggcagagattgcatgatcccactgattcttcatattcgttctaggtgtgacacttctggaacaggcaagtccatagagacagcaagaagaccaaaggtgacctggggctgggggagtgggaatggaaaacttactgcctaatgagtacggggttgttttttttttttttttttgaggcggagactcactctgtcgcccaggctggagtgcaatggcgcgatctcagctcactgcaacctctgcctcctgggttcaagcagttctcctgcctcagcctcccatctgggactacagatatgggccaccacacctggctaacttttgtattttagtagagatggggtttcatcatgttggccaggctggtcttgaactcctgacctcaggtgatccagtcgcctcggcttcccagagtgctggaattacagacatgagctaccgtgcccagccagggtatagggtttctgtttggggtgatggaaagttttgcaagtagatggtggtgatggttgcataacattgcgaatgcaatgaatgccactgaattgtacacttaaaaatgcaaactggccgggtgtggtggctcacacctgtaatcccaacactttaggaggccgaggcgggaggatcacctgaggtcaggagttcgagaccagcctgaccaacatggcgaaaccccatctttactgaaaatacaaaaattagctgggtgtggtggtgggcacttgtaatcccagctgttcaggaggctgaggcaggagaatcacttgaacccaggaggtggaggttgtagtgagccgagatggcacgactgcactccagcctgggtgacagggcaagactctctcaaaaaaaaaaaaaaaaaaaaaaaaggcaaattttgttttatgtatctgcatgtatattatagattttaccaaaattaaaaccctacacactcaccctgggccccatgtgacctggggaatcagactctggccctggtccccagggaagttggacaggggccggcaagcttgggacatgtctgcacacgccatcagaagcatgggtgctgggggcctgggatggctgccccgcaaggctcctggaccaaggagcacgaggccacacatgagccaggtaggcactgagcgctctcagagagtagcacccccggtgctggggggactcccaggaaaggtaagtacctggtggtagtcctccatgtacttgaggtggctctcctcgcagatgagcaggttcaggtactccttccagtctgcgtgcacagcctccatgtgcgcctgccaggaagagaaggggccggtcaccactgggcaggtactgcagacaccaagggagggactgctgggatattgggctggggcatggcgggggagggaggcatctggcatctgtctgggtgtggctaccacaggggtagccagcttctgctcaggagtgggaggaggagagaggggtcacgtcaaggagccaaacagggatgccacatacggatgcccaggctgtgcagtgcacaaagggcaagtgggggctgtggtgccttcggcaaatctgtacaaaggcactgtcatggaccgaacagtgtcccaccaaatccatgaccctggccaggcatggtggctcacacctgtaatcgcagcactttgggaggccgaggcgggtggatcacctgaggtcaggagtttgagactagcctggcccacatgatgagaccctgtctctactaaaaatacaaaaattagctgggcatgatggtgtgcgcctgtagtcccagctacttgggaggctgaggcaggagaattgcttgaacccgggaggtggaggttgcagtgagccaagattacaccatcgcactccagcctgggcaacaacagcgaaactccatctcaggcggggttggtggcattgtgggggttgggaagaatgcgaccttatttgggaataagatctttgcagatgtcattagttaaggatcctgaaattagggtgagccctaaatccactgactgatatccttataagaagagaggatacagagagacatggggagagaaggccatgtgaagacggaggaagggactggaatgatgcagccacaagccaagggctgttggcaacccccagaagccggaagagcaaggaaggcacatgtcctggagcttccagagggaatgaggccctaagacaccttgatttcagacttacagcccacagacctctgagagaatgaatttctgttgtttaaagccactaagtttgttttaacttgttgcagcaactctaggaaactaatacagaccccacaggggcttcagaagtccaggggctgagggcagaagtgtcaacggatcaggataaatggaggaggcagagtcagacacagcaagaaagagacagacagacacaagatgcagcttgcaggacccccagctccggggtctgcccgagctccaggcggcccacaggcagcggccaaccagaagccaccctgggggaggtgtctggtctcggggtgcatgaacctcaatggagttcctcccggggtgctcggccgccagcagctggtcgccctcgctgtgcagtttgttgattctctcctctttggcctccaggttccggttgatgaaattctgcagtggggggcagtggaggggcctcagtgcccagcctggcggtcccgtgctccttccagggctgcctcctccctgatgccccaggcccccagaacccacctcatactggcgccggcggctggggtagtcgaggttgcggtcactccagtcgtactgcatgcggcccttggcctgctggtccagccagtacagctcattggtgcagcgctgcatgtagtcctgcagcgaactcaggtgctgctgccgggcctgtgatgctgcctgaaggggccggggcaaggaaagggctgcgtcctcagcccgctgccactgctcgcttccttccctacctcctgcagggcccagctatggctggcctgaggacaagcccagctatgggtggcctgaggacaagcccagcttagccacgtccaggccagtcccccttagacaagtcacctgaacccctgaaactcattcattcattcattcattcattcagtaaatgtttactgagcatctactacatgctggacatggctccagacactggggatacagcaaacgaaacacacaaaacccttacggaactgacatttttgtgaaggcttagttcgcccatctgtaaatggggaagatgacagtcctgacctcacagcgtacagagactggcatatagttggtgctcaacaaatatcagtaactatagcttctacttttatctgtatcatgatcgtcttatagagggctggaaggaaagcaccactgtacgtctgagaagcgggtgtgcaagggaaaggagggatgtttgcattttggtacgtggggccctccacgcctgatgaacttctgcaacattgactcatttcatcctcaaagcgaccctatgagacaggaacatgtaggagctccatttctcagatgaggaaactgaggctcccggaggctaagtaactcgctcaaggtgtcaccactaacactaaggagcagaggaagcatggctccttatagcgacacaatgctgcctctgtattctctgtctgaaacattggcaacaaggaagcgtttgcataacacttatgcaatttttaaaagaatgcattctttaaaggtttgggaaggaaaatggaaagcttttgtatagaaagcaagtggcatcatacttggcacacagcagataataaagaaatgagcaggacaggctgtacccctggggcctgttagggttttccctgaacaaccagggcagaccttgcagccgctcaggaaaaggctggggcacctctcttcccgcctcaacccctctcctgattgaaacgtttactgcacgccttttttttttttttttttttttaaaggcagggttttgctctgtttcccaggctggagtggagtggcacgatcacagctcattgcagcctccacctcctgggctcaagcgatcctcccacttcagcctcccaagtagctgggaccacaggcatgccaccaagcccagctaatttttaaatgttttgtagagctggagtctcactatgttgcccaggttggtctcaaactcgtgggctcaagtgatcctcctgcctctgcctcccaaagtgctaggcgtgagccaccatgcccagctgcctatgtcatttttaaaacaatacatccttgtccccccgactccaagcttcccatcctctcctctccccatgaggcctttcccccagggagctcctcaccagcagtttctggtacttggcccggagttcgctgttctgctcctgaggacagagccgagggcatgggtcagggccaggaagcaggcgcggccccctccatccctgggtccccaccacaccagcacacgccccaccttgtccccgtccttggccaggtggggcccgatggccttgacctcattgtggaagatgttatgctcctccacttggtggtccaccagcggcaggtcagtcccaaagctctggttgttcagcttgtcctggccaggagggcagagaagcaataaggagagggtgggctgagggctggggacgtgtggccaccccaggagcctcgggggtgggcatgatggtgctctctttttcacggggccctgcagagccacaaggagatgctggccacaccttcaaccctgaggttctgtttgctgagcactgacctatatcatctttcatctcacagagcctcaggggtccacatggttactgtcccatctctcagatgaggacacagaggctgaggctgaatgagggccagtcacctgcccagggtcacgccagtaacattgggaaagctggccaggcatggtgactgatgcctgtcatccaggcactttgggaggccaatggggtcggatcgcttgagcccaggagtttgagaccagcctggccaatgtagcaaagccccatctctacaaaaatacaaaaaattagccaggtgtggtggcatgcacctgtaatcccagctacttgagaggctgaggtgggaggatcacctaagcctgggaagttgaggctgcagtgagccgtgatcatgccactgcattccagcctgggagacagagtgagaccttgtgtcaaaaataaataaataaataaataataaaactggggaagctcaggagtttgagaccagcctggccaatgtggcaaagccccgtctctataaaaatacaaaatattagccaggtatgatggcgtgcacctgtaattccagctacttgggaggctgaggtgggaggatcacctaagcctgggaagttgacgctgcagtgagccatgatcatgccactgcactctagtctgcgcgacagagtgagaccttgtctcaaaaataaataaataaataaataaataaataaataaataaaactggggaagctaaggcttgaacccgggacacctagctgcagtggctgtgtgcttctctgtggtgagcacccaggaaagggagcgacaggccagaagcctggccgcttccgccccagcctgcccacaaaatgtcaccaagaccccaacatgccagggttggaaagtgggacccaggagcagcagcgaggtgtggctgacaggggacagagtccgaatctccaccgcttgagctgtgtgaccctgacttcgtgctgcacttctctgagcctcactcttctcatgggcacactggaaaaccatcaggaccacgactgtctccctggtaagacccgggatgcccattacatgggtaggctctccctgcacacgcacagccccctccccagctgaaaccctggagccagcggccccgtccaggccataccagcttctcctccaccagtgccgcccagttgacctgtggatccacttccttcaccgccagcctgtagatctgcttgtgtttcccgcgcaggttggtcacacgctccttcagctggcggatactgatgggagagaggctcccacttagtggggctggttggcactgcctgcaccccaggaggggccccccacccagaccccggcctcagtgtcctggaaggacacagtgaccatatggccttgggttccagacaatcacagcatcctctcacccctcctcccatgcactttttttttttttttgagacagagtcttgctctgtcacccaggctggagtacagtgacgtcatctcagctcatggcagcctccgcctcccaggttcaagcaattctcctgcctcaacctcccgagtagctgggattacaggcatgtgccacctcgcctgggtaattttgtattttcagtagagacggggtttcaccatgttggtcaggctggtctcgaactcctgacctcaggtgatccgtccgcttcggcctcccgaagtgctgggatcacaggcgtgagccaccgtgcctggccccacccactttccctcaaccttccttcccccatcagtttcctgagggcctactatgtgccagaatgatagaaagttctggaataagcaggaaagatcttgttttctggagtctgccatccagcagggcccacagtgtggtgcatgccatgccaaggacaagtgccaagggtcgtggggcaccgagagagccctgcccttgccggggtggagatagggcatgggacaaggcaggagtcaggggggctgattcatccacgataaaatgaactgggagtcgtgagccaaggaagccagggacagggcaccaggcagcggaagagctcgctcaaaagctcacaggtcaggctggtggctccagaacaagggatatcaactccctaagcctccatttccccaactgcaaaatagggtcatcaagaggatcatgtgaggctgggcgcggtggctcacatgtgtaatcccagcactttgtgtaatcccagcactttgggaggtcgaggcaggcggatcacctaaggtctggagtttgagaccagcctggccaacatggagaaaccctgtctctactaaaaatacaaaaattagccgggcatggtggtgcatgcctgtaattccagctacttgggaggctgaggcatgagaatagcttgaactggggaggcagagattgcgctgagccaagatcatgccattgcactccagcctgggcaacaagagcaaaactacgtctcaaaaaaaaaaaaaagaaaggatcatgtgaagcctttggcacgtgcctggcacctaattagcccttgataacccctgactcgggctcccaaatgctgaacaggaccccccgccctggcccatagcccccaatggctcccctggggtaagaagcagaagggacctactcctcggcgatcatgtccccctgtgggtgcttcatgtgcttggcaatggccgcatccgcctctagcacatagagcagcttctcagagtccaacaccttctgcagggtcacgtcccggtgctcaggctgccgaccctcctgcagccgagccaggtcctgtgagggtcacaagagaggggacaatgaacaggagccgagagcgggcacggtggcaatgggaggggtgggaggaaaggggtcagcagggtgctccccttctttccctttgaataacgtcttccaggcttgtccatatggagcgcagtcggtagttccatctctttgctgctacgtggtatttctcaagttcactttgcaaagcaggtatttctcttatgccccctccagcctgtcctccagccactcagcaaacagagctcaagtacctactgtatgcaaggagttgggacacagctgtgaacagaagagacatggcctccctgcctggcactcacaacccagtctgcaaggccaccaggaaggccagtcaaaggatgagcctcatggaggtgactgcaagtccctccaagtcagtgtttatgaaagaaatgctccagaggtggaacgaggggacctacttcagctctggtggtcagggaagcctcttcgtggtggagacacaagctaagaacaaaggatgaaagggacagtgttccagccacaggaacagcctgtgcaaaggtcctgaggcaggagagagcgagctacgactgggccatagtgaaaaggtctctgtggatagggaggaaacagggcaggcggggggcggggagggtgagcagctagaacacacaatggctgcaaggagggatcctgcacagctccatttgtgcttaaaggcgatgcctccaggggctctgcagagaggacagcaagggtgtgggctgggagggcaggcagtggtctgtggcagcagccaggtgacagcgaggtggcaccagcaagaaggaacagagccggggggatatctggaaggggccgtcgatggttgctgatgagtacagggcttctgttcgtttagggaagagcaatgaatggcagccgggacagtaggtttctaatcacagcgggttaattcactgtgtcaatattcaagaagtctggctgtgagtctacaccatgctaggtcctggggatgaatccctgagggatccccagtcccgcaggggaggcagtgacatgtcactgaggggaatgagtgcaggttggctgacgctggggcactcagagccggccgccggtcccttcccctagctgggtctcagcattcccatctctataatgggcataaggaaaatacccgcttatgaagtgaactgagaaataccacttagcaacaaagagcaggaactacggaccgtgctccatctgaacaagcctggaagacgttattcaaaggcaaagaagccagacagagcccacatggtgtgggatccattgatgtgaagtgtcccgaacaggcaagtccagagagatggaaagtcactgtctcttaagtggttgcctggggcagggctgggaagaggcattaacagtaaataggcacaagagatcttgcacgggatgaaaatattctgaaactgattcatgggcgtggttctgccccttgctaaagttactcaaaatcattgacttgtacacttgcagtgggagccttttttaagtgaaatatgtctccatacagttgttttttaaaaagaaaaagcaaaaggaagaaaaacgagaaatacacaggggtgacgtggtgcctggtacgaagtaaagacttggcttcttcttggaggaagaaaatgtgtcaagagtgcctttgcctggctaagtctggaagggctgaagggtgaacaggcctgactccccagggggttggagatgaggctgatgtcccgaaaagccgctggaggccaggcacagtggctcatatctgtaatcttaacactttggggggctgtggcaggaggatggcttgagcccaggagtgcaagaccagcctgggcaatatagtgagaccccatttattaaaaaatatttttaaaaggtagctgggtgtgatggcatgcacctatagtcctagctactcaggacgctggggcaggagaatcatttgagtccaggagttcaaggctgcaatgagctaagattgcaccactgcactccagccttggcgacagagcgagaccctacctcaaaccaaccaatccaaaaagccaatggaaccaggcatcccccaaccctggggtaggctggcccgttaattacaacaaaacatcagcttcttgacttggagtggaatttttaaattttttttgtttttttatttttgagatggagtctcactctgttgcccaggctggagtgcagtggcacgatctcggctcactgcaagctctgcctcccggattcacaccattatcctgcctcagcctcccaagtaactgggactgcaggcgcccaccaccatgcctggataatttttttgtatttttagtagagacggggtttcaccgtgttagccaggatggtctcgatctcctgacctcgtgatccacccgcctcggcctcccaaagttctgggattacaggcgtgagccaccgcgcccggcctgcttggagtagaattttattcactccattatcaccagcttccctgagctgcagatcaaagattaattttgcaaaaggaggaagtccattaatcattgcctaattcgtgaaggtgcccggtgggaatgcaagttctctcaaaacactggctgagagagaaagagaacatctagctgagggaggctagtgttcgaaagttcaaagtcgggcagaactgatcgatggtgagagagatcagcatagggttgacccctgagggatatcaactagggagatggcccgggagctttctagacagttacccatcttgccacagacagtggttatctgggtacctattgatgcaaaaattcacccaggtgaagtctgcgaatgtagacacttctctagagtttatataagttataccttgataaaaaagttttttaaagtcacaggggccaggtgcagtggctcacgcctataatcccagcactctgcgaggcccaggcgggaggattgcttgagctcaggagttggagaccagcccgggcaatatagtgagaccctatctctaaaaaaaaaaaaaaaaaaaaaaaaatacaaaaatgagccaggcatagtagcatgcgcctgtagtcccagctacttgggaggttgaggtgggaggattgcttgagcccaggaggttgaggcttcagtgagtcgtgattgcgccactgcactccagcctgggtgacagagcaagaccctgtctcaataaaaaataaaaataaaaaattatagggactgatatatctaatctcacacacacacacacacacacacacacacacacacacacacacacacggacagatacatgataaagccaattcagcagacgttccttgtaggatcaggtggtgggatatgggtgttcgctgtacggttttctgcatgtttagcatttgaataaatgtgtgatgcagtgtatgattctgtttatgtgaaatatccagaataaataaatccacagagagaaagcagattagttgctgccagggggaaaggggaggtggggagtaactgttaagggtgtggggtttggctctggggtaagggaaatgtttgggaactagatcgaggagatggttgtgtaacattgtgaatgtatgaaatgccactgacttgtacacattacatggttaattttatgttatgtgaatctcccctcaattaaaaaaaatggaaaattcaacagaactgggaaatgaaataaatagtagtatctttagcaaaaagaacataagaaaaagattgtgtgatccatgtagtcttcaaagcctagcttcttttttcaagtgggttcagttgaagttaaaaaaataggccgggtgcagtggctcacacctgtaatcccagcactttgggaggccgaggtgggcagatcacaaggtcaggagtttgagaccagcctggccaatgtgatgaaaccccatctctactgaaaataaataaataaataaattagctgggcgtggtggtgcctgcctgtggtcccagctacttgggaggctgaggcagaagaatcacttgaacccgggaggtggaggttgcagtgagccgagatagcaccactgcactccagcctggacaacagagtgagagactgtctccaaaaaaaaaaaaaaaaaaagaaagaaagaaagaaaaaattgttcaggccaagcacacagtggctcatgcctgtaaatcccagcactttgggaagctgaggcaggaggatggcttgaggccaggagttcaagaccagcctggacaacatagcaaggacctctgtctctgcaaaaaaataaaataaaaatggttcaaaattacctattttgagtcaatacttcagggaaataaaatgagaaggttaaaccctcttccttctttctctctctctctctctctctctcacacacatacacaaaggtcaaacagatatacaccaatatgttaatagtcagtagatacctctggtggtggaattctacatgactgactttattgattgattgattgattgaggcagggtgtccctctgctgcccaggctggagtgcagtggtgtcatctctgctcactgcagcctcaaccttccgggcttaagcgagcctcccacctcagcctcccaaggagctgggattacaggcacacacaccaccacacctggcaaatttttcatattttttgtagagacgaggtttcaccatgttgctcaggcttgtctgaaactcctgggctcaggtgatctgcctgcctaggcctcccaaagtgctgagattacaggcgcgagccaccgcacccggctcatgattttaattcactttgttatgcttgtttatccatcgtgaaatgtgtgtgatgaacacatattatttttgttatgaggaaaaaagagacacacccccaaaagatgttttccatttaagaaggaaagaaatccaccaccacagggggcctcagatggcagaggatgtaactgcaaatgacaaggggagctgatgggagggaacaggtgtggggtggccaggcagaggccagggaggcaggaggtggaggcccaggggggcatggaggcgggggccccaggcaggaggccagggcaaggcccactcctggggcccctgcaggggatagctggtggcagagaacagagtctccacttatctgccccctacacccccgtggactgtgcccaccccagcccacctacccgcttgggtctcttggctgctgtggacaggccttcagagggtgggcaactgggccatcaggagcagccaagggggttggatacctatggctgggcctggggacagcagcttggccgggtagaccttgacctccctcctgacctccccaccctcagcctcccactcctctggtcccaccttttttttttttttttttttttgagacagtcttactctgttgcccaggctggagcgcagtggcacgatcttggctcactgcaacctccgcctcccgggttcaagcgattctcctgcctcagcctcctgagtagctgggattataggtgtgcaccaccacgcccagctaattgttgtatttttagtagagatgaggtttcaccacattggccagtctggtctcaaactcccgacctcaagtgatctacccacctcggcctcccaaagtactgggattacggccgtgtgagccattacgcacctggcctggtcccacttcttagtcgcccctgcatagggatgccagatgaaatacagatcaccacttacacttgattttcagataaacaataaataatgttttagcataagcctttccctaataacacatgggctttcctgctactaaaacatgatttgtgttctgaaattcaaatgtaactgggcatctcatattttatttgctaaatctggtaactccacctgcaggccgatgctggcaccatctctgtcactgactcatcatcccagccccttctaaacctcagttgctccagggtacaaaacaggcatcaacccaatcgcaccgggctggcgctggtggaaggtttaaagagaaggtgaccattccagcggctcgtgagtccctcagggtacagaggcttcatgccgttgagtccactgggcagttgttatccccatgttacagaaagggaaactgaggcacagataggggaaagtgatttgcccagctattttatctctcttctccaaaaaaggtggagaaagacctgcaccctgagtgctggcagcagtaggatgagcagtgagaatgatattgacgataatagccctgtcctatacctgcataatctcatttaatctttacaaccaccccgccaaatgggaaccatcactcctgcctgcttagagagaatctcgttcatggggaggtgggatggctcacttgtccaaggtcacccagcaaggacaaggctgggctgtttccatagagcctgaccccatggcactcctccaggcaggagacgctttccacagggcccaggaagagggaggaacttagtatccgggaggtactagtattaacgacaatggccaggttcctctcacagagcagggcttcctgaccttggcacccctgccctacagtgcacggtagggtgttcagcagcatccctgtctcccctccccaactggacgccaggaggaccttccttccaagcagtgacaaccaaaatgtctctgcatgttccctcggggccacaatcacccctgggtgagaatcaccgattccaaacagatcctggtcctgaacagggctggcagcacggggcacccaggtgggagtgggagtgggggcactcacactctgcatcttggcctctgtgtccacgatgttcttctccacctggtcggcattcttctgcagctgctcgatcagctccgagagctccttgttagagatgctgcgggcagaagccgaggggagatgggcggggtgcctggtgggtgggggctatgtccccaccagcaccccatcctctggctggccccggccccacgctctgagcaggagctgcccacagagcctttgaggtagttgggctgttcccatagggcaacatcactaaagccacagagacaaggcagcgcctggcaggcggtcagcctcctttttttttttttttttttttttgagatggagtcttgctctgtcacccaggctaaagtgcagtggcgtgatctcagcttactgcaacctccacttcctgggttcaaatgattctcatgcctcagcctccccagtagctgagattacaagcatgcaccaccaagcctggctaatttttgtatttttagtggagatggggttccaccatgttggccaggctggtcttgaactcctgacctcaagtgatccacctatcttggcctcccaaagtgctgggattacaggcgtgagccaccgcgcccgcccagcctccactttgatcattctctctaatgcttctattttttatttttattcattcattcgttcattcattcattcattcattcattttattgagacggagtctcacactcttgcccaggctggggtgtagcggcacagtcatggctcactgcagcctctatctcccaggctcaagcaatcctcctagcccagcctcccaagtagctgggactacaggcacatgccaccactcctgcataacttttacatttcttttggtagagaaggggtttcaccatgtcacccaggctggtctcgaactcctgagctcaagcaattcgtccaccttggactcccaaagtgctgggattacagatgtcagccaccaggccccgactacatatttttttgtgagagatagggtctcactctgtcacccagactggagtgcagtggcgtgatcatagttcactatagcctcgaactcctgagctcaagcaatcctcctacctccacctcctgagtagctgggaccactggcaccaccagcacacccagcttctaatgcttctattttgccatgttggcaaaacgcaccatatttgaaaaattgggagataactcacataccgtaaaattcacctgtttaaaatacacagtcactggcttttagtactacacattcagaatcgtgcaaccatcaccactatctcattccagacatttttatcaccccaaagctccacacccacaagctgtcactccctattccccacccgctccagcccctggcaaccaggaatttactttttctctctatggatttgcctattctggacatttcatataaatagaatcacacaacacgtggccttttgcgtctgccttctctcagcataatgttttcaagctttgtgcatattgcagcatctattagaacttcattctttttatggctgaataatattccatcacgtggctacttcacattttgcttattcattcaacagctgacaaccatctgggccgtttccacctttgggccatcgtgagaatcacgctgctatgaacgttcgggaacaagcttttgtgtgagcagtcttatttttaattacctgatatttttctttcaacctactcgttttattttagagttaaatgtgtttacaaaggtaacttctctccccattttaatcagaaatcagaagccctcaccatgagtgaattagctgccaaaataaatttcatgggaacgcagtggcactgggttccgtggtgacactgggctgcccgctgttacaagtcaggaggtgtgacagccgtggtggcgtcaggcccagcctttctcctgatcttctcagagcgcctgaaagagacttgaggcccggtgtggtggctcatacctgtaatcccagcactttgggaggccaaggcgggcgaatcacctgagatcaggagtttgagaccagcctggccaacatggtgaaaccccatctctactaaaaatacaaaaattagctaggtgtggtggcatgcgcctgtagtcccagctactcgggaggctgaggcaggagaactgcttgaacctgggaggtggaggtggcagtgagctgagattgcaccactgcactccagcctgggtaacagagcgagactccatctcgaaaaaaaaaaacaagaaaagaaaaaaaagtcttgaaagcagactggccctctccctcactgtctctgtgtcccctcctgtcacatttgtctactgccccccgtcccccagaaccacagacagaccactctggaaaatgctctaatgggagttagttaagactttggccctggggttagctgtgggttcagatcttggctcccatcagccacttagtggctgtgtgacttggcccagctcccttgcctatctgtgcctctgtctcccaatccgatggactagagtaacagtcctttcccggggccagggtggcaggggttatgaatggaagtgaggttacactaccaaaggactgtgcatagagccgggcacagaataagtctgaacaaaggtttgtgattttagttgtcaaggagccttagagatcacccagctctgcctctgtggttttgagaccgagtctcactctgtcacccaggctggaagtgcagtggtatcatcttggctcgctgcaacctccacttcttggggtcaagtgattcggctgcctcagccttttgagtagctgggattacaggtgtgagccaccatgcccagcctccttctgttgttttctttaaacaaagaaagaaagggaaaccaacttggccattgtcacccagttagccagcgatgatagctcccctgtctccactgaagacccacagtggggcctgagtggctaggcacgcagaagttgccttctactcacactcattaagcacctgctgtgtgcgggccctgcacctcacaaagacaagcctctccctccctgatccaccccacagaccaggaggaaatcagtatttatagaaacagtcacgagactgaggcaggcctggaggctggggatgcccaggggaacctctggactggctgggtggggacagcggtggtcactgaaggcttcctggaggaggtggtgtcggctgggtgctaaagcaaaaggaagaatttggtgttcctgtgcagaaggctccaatgaggacacgccatagagagaggcaggtcctggcacgtcccgtggggtgggccagggcggggttcttgaccgtcaaggcagaggggaccaccagccctttcgagtgatgctccccagatcaaggttctggggcctagcatgaaaaattcagattcccggccactaacccagacctgctgaacccaggtctccagagctgggcccaggaagctgtattattattactatttttgcaggttccccagggtacctggacacctaccggagtcatggaccagcaatgcaggtgctgttgatgttgggggcattgggggcagaaatggcagcagccaacatgctggggatccatccgtctaggttccacaccttgcttaagggccagctttgtggcagacctggatacaccggagctgggggatcttgagggaacaggacccaagccataccttctgcaaggtcaactgggggcagcctgtcccaaagtggggtcccaggaacccaactcttacaagtcttattcttccttggtcaaggcacttaggaaaaccccatccttgatatgttcatgagccagcaaaggcactgacaagtcctgcagtggagaaagccagtgtttggcggggtggccaggaaggcttagcagtggggggctttggatggaggatctcggtaagaagggataaggtgggcttctagaacagccaggtcaggggtccacccgactcctccctcattccctaaccccccacttcctggttgggcaggccacatggagaatgtgagtttctgggcccccacactcccaccccagtcactgaccatctgccaggccagctgcacctagaggcggtgagtctcaccccaaatatttaacccctgactctgcagtgcatcgttagggtctgtactgtggctcaagtgggggcctttgtctctcttgggcccagtcccacctcaggcacagggccagctcccaaaccagccctttcatggattgtggcagatgcaagaaaagccaccttctggactctatcctggctgggcctgttgttccagccgaagccccccagaggacatgggagttgtggggcaatgaccactgcctcagggaccttggactcctgatgggacaaagctgtgagcggtagcaggaagctatgagcagacaggccaggcccaaggcccactgggctgcttgctgcttagacagcctcaggcaagtgccctaccctcgtacagcctccgcttctccatctgtcctctggcgatgaccacaaaggcatcctgggcatttgccacttgctgtgggctttgccagacctcagacatattcacaggcaccagctcaatatcatccttgccctaagtccccggggaggttggtgtgcccctttgaagaaggggatgaagaaaccaagactctgagacatcaaagcacttgctcagggtcacacagctggtgaaccgcgattctccccgcaagcaatctcactccagaggcatgtgatcgactgggctagaagttactcatggggatgctaggaaaatcacaccaataacaatctccaccatcgtaatatgagctaatacttactctctacgtgccaggctcctcactgtttctgactcaatcttcatgacaaccctgagagctgggtgttagcatggtaggtaattgtattattatccccgtttatgggtgtggaaactgaggatcagagaggttaaataactctcccaaagtcacccagcaattagatggcagagccaggactctaggcccttaacaattccatgtgacgatcttacagggctcccagcacacagtaggtacttcacagattaatttaaaatgccaagagcccaaaaccacaccgggatgccacttttcatccactacaatggctataataaaaaagacaataacaagtgttggcaaaaatgtggagaaattggaaccctcgtgccttgctagtggggatgcaaaatggtgtacagttgtggaaaacagtctagaaattccacaaaaagttaagcagtcaccataagacccagcaagtccacccctacgtattttttttatttttattacttatttatttttttgagacagggtctcaccctgttgcccaggctggagtgcactggcatgatctcggctcactcagcctccgcttcccagactcaaatgattctcctacctcagcctcccgagtagctaggattacaggtgtgtgccaccacacccggctaacttttgtacttttagtagagacggggttttgccatgttggccaggctggtctcgaactcctgacctcaggtgatgcacttgccttggcctcccaaagtgctgggattacaggtgtgagccattgcgcccagccttattattttttgagacagggtctcactctgttgcccaggctggactgcagtggtgcaatcttagctcactgcagccttgacctcccagtctcaagcaatctttgtacctcagcctccgagtaactgcgactacaggcgcctggcaccgtgcccagctaattttttttttttttcagagagggaggtttcgccatgttgccccagctggtcttgaacccctgggctcaagcaatctatctgcctcggcctcccaaaatattaggattacaggcgtgagccactgcacccagcccacccctacatatctatccaagagaaatgaaaacctatgtctgggctggatgcggtgactcacgcctgcaatcccagcactttgggaggccgaggcaggtggatcacctgaggtcaggagttcgagaccagcctggccaacatggtgaaaccccatctctactaaaagtacaaaaaaattagctgggcgtggtggtatgtgcctgtaatcccatctattcgggaagctgagacaagagaatcgcttgaacctgggaggcggaggttgcaatgagctgagatggcgccactgcactccagcctgggtgatggagcaagactccatctcagaaaataaaaaacaaaaaaacaaaaacaaaaaaacaaaaaaatctatgcctgcacagaaacttgtacatagatgaatcacagcagcatgattcataatagccttttggcctccactttttagtggaaacaactcaaatattcatcaactgatgaaaatataaaccaaacgtggtctatctctattattcggccaaagaatgaaggcaggactgacagctgctacagcctcaggaacctcgagaatgttatgctcagtgagagaagccagacacaaaagctcacatattattccattgataagaaacgtccagaatgcagaaatctacaggagcagaaagtggatgagtggttgccatggcccaggaggatgtaaaatggacagtgattgctaaggggtatcagatttctttttggggtgataaaaatgttctaaaatcaatcgtggggatggctgtacaactctgtgactatattaatatccactgggctgggcgtggtggctcgcacctataatcccagcactttgggaggccgaggtgggcagatcgcttgagaccaggagtttgagagcagcccgggcaacatggtgaaaccccatgtctactgaaaatacaaaaaattagctgggcatggtgatgcacacctgtagtcctggatactcgggaggctgaggtaggaggattacttgagcccagggggttgaggctgcagtgagccgagatttcgccactgcattccagcctgggcaatgagagtgagaccctgtctcaaaacaaaaacaaaaacactgaactgaacactttaaatgagtgaactggatgatatatgaattacatcacagtaaagctgctacaaaaaaaaaaaacacaaaaaaggcagctgggcatggtggttcaggcctgtaatcccagcactttgggaggctgagtcgggcagatcacctgaggtcaggagttcaagaccagcctggccaacatggtgaaacctcgtctctactaaaaacacaaaaattagccaggcatgatggcaggtacctgtaatcccagctacttgggaggctaaggtggaagaattgcttgaacccgggaggtggaggttgcagtgagccgagattgcaccactacactccagcctgggcgacagagcaagactccatttcaaaaaaaaaaaaaaggcaagtgccatttagaaatgacaggggtttgtttcttctctcctgagtcaggtcctgcctcttgtctcattctccagggaagctggccagctgcaggtaatcccccagcagcctggaagatgctagttaactcctagagagctatttgtcctgcccactgcgaagcaagtcacatatatattagctcatcaatcctaccagcctctaagtaagtaccattattctcaaaagttggaggattacaactttaagtgagtgaattgcatggaattcatataccatgcaattcactcagttacagatggggaaattgaggtacaaagaaattccatcatttggccacagttccactgccagcaagcaaggcagagctgggattcgaatccaggcctccggaagcacagtctcagcgtttttgccctgtagctttgcggtcctgtgttccccccaccatccagctggccgcaggaatcaaccatgtgtgccccttggagagctatggagccccatgctaggaagccagcaggaatgtgggtggggcaggaacctgcaggaaaggggacaggtcccaggagtgctgggaaaccggctaggctggtccagcttttcatctcggtaatgagccgcatcggggcagccagacgtggcacccctgggccatcagccccactgatggaggccgagacacagccctgtcctgcccatgcagacacagacagcagccacctgcctgagccaggaacacaaagatatcccccctccccacacacacaccggaaaagggaaagggcctgagtgacagccgagggtacacgcccagccctcccttttcttactcagagggtaacacggacacacgtgctgagggcagtggccgctggccctcgaaggggcctcagaagccatccagccccacctgctcattacccagatgagcaaaccaaggtcccggacgtgaagtcactacccaggatcacttgggagggcagcctgtgtaggagaaagacttcaggtctggagtcagatagggttcagatcctgactgcaccaaccagcaatgtgaccctgtgacagtgtgacagaggagctacactgtatttcttttttaatctttttatattttcttcaaatttttaaatagagatggtttctcactatgttgaccaggctagtcccgaactcctggcctcaagtgatcctcccatctcggcctcccaaagtgctaggattacaggtatgagccacaatatgcctggccagccactctgtatttctgagtctcagtttcatcatctgtgaaatgtgagcaagaaatcctctctagttatgttcatgtatgggcccaggcacaggagtgcacacctgtaatcccaccactttgggaggctgaggcaggagcatctcttgagcctaggagttcgagaccaaattgggcaaataggaagaccttgtctctacaaaaaatacaaaaattagccagatgtggtagtgtgcacctgtagtcccagttccttgagaagcttaggtgggagaatcgcttgagcccaggaggtcaaggctgcagtgagctgagtgagatcgcaccactgcattccagcctgggagatggagaaagaccctgtctcaaattaaaaccaaaaaaagtgtatttgtggggtgggggtaatcagggtcacttttagaaacacctcagtcaggccaggcacggtggctcacgcctgtaatcctagcactttgggaggccgaggcaggtggatcacgaggtcaggagatcgagatcatcctggccaacctggtgaaactccgtctctactaaaatacaaaaaattagctgggcatggtggcacacacctgtagtcccagctacttgggaggccgaggccggggaattgcttgaacctgggaggtggaggttgcagtgagctgagattgagtcactgcactccagtctggcaacagaacaagactctgtctcaaaaaaagaaagaaagaaagaaggaaagaaggaaagaaaagaaagaaagaaagagagagagagagaaagaaagaaagaaagaaagaaaggacacctcggtcaaatttcaaagacacctttgtggttcaaggactgaactggaggttcagagcagcgtccctgaaacagacttgagatcatttatactctttttaaaattttgaaacagtcttgctctgttgtccaggctgcagtgcagtggcaaaatcttggctcactgcaacctccgtctctggattcaagtgattctactgcctcagcctcccgagtagctgggattacaggcgcacgccaccatgcctggctaatttttgtatttttagtagagacagggtttcgccatgttagccggggtggtcttgaactcctgatcaggtgatctgcctgcttcggcctcccaaagtgctggaattacaggtgtcaaccaccatactcggcctcaactaattttttaatttttttgtagacatggagtctctctctgttgcccaggctggtcttaaactcctgagctcaagggatgctcctgacttggcctcctaaagtacagggattacaggcatgagcccactgtgcctggctcatttacattgtttatacaattcgggccttgctggctgtttcaccagtgggcctgaatgaggacccagaacttggttggcagcagaaacagccccctcagccttgttgacgctgtgggtcaggggctgcctgctagatgggttttgcaagcctctacgagtcacctcgagtcgactgaggctgtttttccctagctttttccttctgggctggggatgccagagtctgggacaatcctgagcagtctcacagagccccattttcttggcctggtctgcatatgaggctcttgatgcaagcaaggaaaaatggaaccagcaggtcaggaggctgcccggttcctcctcggagttccagggctgtgtttgagggtactcccagggaccagacaagggcttcctgggtctgagcccgcaggcttgagcctgaacagccatcttcttgtgtcccaggacatactcagagcagaggaaccactagggagggggcctgggggcctcagatggcatcaggtctcctggctctgtcgccaggagtcagagcctcagtagacacagcccgacctgctttattgattgattgagactgagtctcactctgtcacccaggctggagtgcagtggcatgatcttggctcactgcaacctctgcctcctgggttcaagcaattctcgtgcctcagcctcccgagcagctggaattacagacatgcaccaccacgcccggctaatgtttgtatttttagtagagatggggtttcaccgtgttggccaggctggtctcgaactcctggcctcaagtgatctgcccgcctcggcctcccaaaatgctgggattacaggtgtgtaccactgtgcctggccccagcctgcattagaggtggcaactcgaggctgaggacccagtggctcagtaagcccagctgcaaagtggagagctgggactcgaacctaggactgtgtgctgtcctggccgccaggacagcacacagtcctcagagggccagcagggatgcccgtgagaggagctgggacagaggtagcaccctggccttgacacaccaccgatgctccacgtgggcagagaaagataacacaggtgtctcgggggaccctcgctctccacctcctgggtctctcttcctgctttaattttgtgcgggtgccactggcactttctttcagctggaagggcagtgtggcccagtggttaagcacccagaccaaagccagacagcccggggtcaaatcctgcctctgctcttaataaactgtaaattacttagcctctctgagcctcagtttccccagctgtaaaatgagagtcatcacagtatgcatgccacagggctgtggtgggggtgactgagagaacagatatggggtgctgcctctgaggagcccggctctgccttgacctgggtccaccatccagggatttaggctccttttaaggagctgataaaagccagaagccagctgggcgtggtggctcatgcctgtaatcccagcactttgggaggctgaggtgggcagatcacctgaggtcaggagttccagaccagcctggccaacatagtgaaaccctgtctctactaaaaatacaaaaattagccgggaatggtggtgggcacctataatcctagctactggagagactgagacaggagaatcgcttgagcctgggaggcggaggttgtagtgagccgagactgtgccactgcactccagcctgggtgacagagcaagactccatctcaaaacaaaacaaaacaaaaaaaccctagaaacaaacaaaaagccagaagccaaggcctgaagttagaatcctccagcacctgggagatgaaagcagacccccggccgtccacactgttcacgctgatcctggtgcaagcccagacgtgctttgcttctgccctgtgaatgttgccttgccggggcacgtggaattcacaactaacctcagaatttggaaccatctcctccaacatctgcgaggagaggctggtgcccatatatgggtaatgaggtgtcgggaggacaggagatcctgcgtcccagatgcccactccctgggcctagctgggggacaaacgcacagcccgcttcagctgtcttgggtttgggctaaggatcagagtcagtaggtttggggatttgaagggtacagggtgttcccactgctctgagaacgttcttccgtccgcataagggaaactgcagaaggggagggtggggaggacctgtctacccggttatgccaacagatccctgagacctgtccctgcttctccctccactggttctacctgggaacgcgtctcctgcgcatcctcctccatctgcccctctggcctcaccttgatcaaagtcaccacttcttacctggcccaatgcaacagccacccactctcttttctgagagcatttgggagcacaggtaagttttagtttggatgatgggatgatctggttgcatcatacaaagacctaagagttggggagatatgcttcccggcctcctgcccccaggagagacgtggaccctccaaggacaccatgaatggcaaccttccagccatcagcgacctggaagggggctccctgggtgggggtggcttcaagagccacccttgatgtcttcagctgtacctgttcaagtcacatggcaccaactggcccattctttctaccctgcctgcaggggaggaaactgaggcagcctggccagggcagggaacgtagcctgtgttgtggctctaacccaggtgtgggctcgggcagattccttagtctctctgtgcctcagtttcctcatctctgagacagggataggaattgatcccactgcagagggttgagataattcaaggagataacccttataaatgaaagcgctttgggtgtggccgcaccatgattaggataactgggtttcatcctcttcctccgtgtcactggtgggggccttgccagggcagggctctttgtctgttgttcactgccatgtccgtagcgcccatcagactgaatgaactatgctggcttttggaataacagcatgtattactccacctgtctcagccttaatttctttcaacataaatggggttatcatgcctgcttgtcacggaacaagcagaaagacactcaacagctggaaaacattcccacaggagttcaggtattaagttgctttgtatgcaaggccagcactgttcaacagaaactgaacctgagccacacagaatttacatttttctagtagccacgtgaaaagagtaagaagaaatgagcgaatttttttctattttatttaacctaatatatccaaaatatgatcaatttgacaggtggtcaacagaacattattaacggatattttacattctctttttcacactaagtcttcaaaccctggcacacagacatacgtgcacagcccatgtcacggggccagtaattactgaataggactgcgagattctaggtgattctggggcacccggacctgctttgctctaagcccgcagtgaccacagtctctcagttctgctgtaggaaagctgatgggcgctcagagcatcttccagtctcactcggtgcctggtacccagggacacctaataaatgctcattctctttgaaccccgtgactcctcctgcccacactcactgattagatgtctgccccaggacagggtctcctctgtgggtccctccctggctgcctgactccaaaacaacctggggctccccactgtgcccactggagcctggtgcctgggtgtggaggaccctggcacgaagaccgcagcaagacacccttccccaggtccccagagcccctgcaaccctgtccataggccatggggctgtgctggaggcacctggcctgctcacagccatccccttctccaggctgcgagagcagccaccccggtaacagatcatactttagcaacatcggaggggccacgttcctgccatcacctccaccccagctgtccctgtcgcccagaactgctgtgtcccctgctggctcacagcccagcctgcactctcctcccatgtgtggacacaggtccctgcaggctcagcactccctgcctggccagggccactggcctttgatcacatctgcagttccttcctctgggggttaattctgtctcagtgggtgtgtattggggttgcattgctgctggaatgtctggaacgcacaggagggtacacccctccctggaaccagcctcacctgtcccagagcccagagaaggggctgggcctcctgccaccacggtcatcctcttctggcgtcctgcctgcctggagggccagcttgggggaggtgcacctccggtgccgagtagccctctgcccctaccttctttaaacactgcctggctcctgaaacatctgccctggctctgacacaaaggcaaccaccgtggacactcaggaaataactgatgaatagtaacaacactgagggcacctactgggtgcccagcgaccgctcagtccttttgtgcatcacccattgacgtctcatagccctaggaagtagccacccttagtgttactggggctcttaatcctacctattaggctattaaatttttggacaaaaagaacttactcacctttttgggggcccttctataaccttaattccacaccttgcgtagggctgggctcaataaataggtgttgaactgagcagatgttttaatgcaattcggtaactcttatgtctctgtgttctaggtgaagataactgaggctcacagaagttaagaaactggtccgagtttacacagctgggaagtggtggtgccaagattcgaacccatgaagacgggcttcaaaaagccaccttctcagtacaaaggggacatcagtatcaatccacacccaccccttacagacaaagggacaagagacatcggagagacaggatgatgggaccaggcattcaccacccagggaagcagagtgatttacagtttgttgtcattttcatcagtacaattaatcccagtggttggttgggtaaggattagtgatggtaaacggagactgagtcattctcctaagttgtccccacaagggactcccagcctgtccctccaaacagacctttcaggcggaagcaactgccattgagtgagcaccttcctggcccacaccctaccctagcaccggaagcaggtttcatctctgatccttataacaactagttgaggtacgtgctatcatagctccattgcagatgaggaaactgagcctcaggaagaccacttgctcagggtcaataggttagtaagaggtctatgcttgtaactgctgcagccccaactgggcactttctagatattcagtaattgccaaataaattttcgaccccaccccaccaactctttgtcatctctctgccccttacaggccctggcaacaggcccttcaccattaacaagcccccagagatatgaattgtccacatgctataaaatacctgctcaatttcacacctatttatggagccccaagcttatgtaaggcctggaattaaggacaacagaaggccctctcccaaaagatgagtaaatcccaactattcaaaagcttgtaagctagtaggtaggttaaggaaaaacaccccaatgggtataattacaaagatttggcttggcgcggtgactcatgcctgtaatcccagcactttgggaggccgaggcgggcagatcacgaggtcaggagattgagaccatcctggctaacatggtgaaaccccatctctacgataaatacaaaaacaaaaatagccgggcgtggtggcaggcgtctgtagtcccagctacttgggaggctgaggcgggagaatggcgtgaacctgggaggcagaacttgcagtgagctgagattgtgccactgcactccagcctgggcaacagagcaagactctgtctcaaaaaaaaaaaaaacaaaaaaaaaccaaaaacaaagattttagatcacttacaccagggtattttcatccactgtgttccatttaggccttataatctaactttaatgatgaaaatatactcaatccagtaaaaaccaggaaaagagcaaaatggaaacaaagggaaagcatgataaatagggcactatggtggagtaggttcaaacacattagtcattacaataaatgtaaatgagttaattttgcctattaaaagataaaagactctccggtgagattacaaaacacacaccttccccaagctatatgccattttataagacacacacacttgaaactaaatgatacaggaaggttgagaataaagaatggagagtgacataccaggcaactgatactgaagagagaaagcactgtccatatatctcaaagacaagagggagcgaggcaatccatgtaactatgtggttcccaacagctgcacatcaaaagaatgatgtctggacccatgtccatggagattttgacttaactggtcttggaaagggctctgacatgctgttcaaaactcctcaggtgattctaatgtacagccagggatgagaacaaggaactgaaccacagcaaggtttaaaagaagcaagatgccgaagaatcctagatctctataggaaggaagccctgtgagaaagcagtacacagaatgtgcccaatgaataccagattgattggtcaattgactgattctctcactactagaaactcctgtgctaattagacagtaaatgtcctcacacccagctattaatcctgtggaaatatatcctaagatgagaaggttgctggtgtagtaattccaggtctgtttttaaggcctaatctgtttctgcccagggaaggccgccctgcctccaggcctctgatggggcctagggttctgtgtcaggtgagtgcttttgggctccttttacaaacatacagaagttcaagctgcttcaggtaacaccaaggcaggtcttgaagacagggcaacacagcaagaccctatttctaccaaaaataaataaataaataaaattagctgggcatggttgtgcatgcctctagtcctggctgctcaggaggctgaggtgggaggattcatagctcactgcagctttgaattcctagactcgggggataaacagggctcaagccaactttggtgccccaaggcatcaggatgtcactctgggttcaggaccactggagaaagagcaccagcctcctttttcattttttgagacagagtcttgctctgttattcaggctgaagtgcattgctgcacttcactcactgcagccttcaactcttgggctcaaacacaaaatatattttgtatttttagtagggacagggtttcaccatgttggccaggctggtctccaacacctgaccttaggcctcccagagtgttgggattacaggcatgggccactgtgcccggccatctcagcagttcttacccagacactttgagagggctggcagggtgtcctggccgccccgcccatcctttcctaggcagagggtttttgtcatgctttgtaagataaaacacaccagagctgctggctgagcctgcaaggccgcagggctgtgggagaaatagaacttgcagaattttttgctgcccccactgcctgggctaggatttcaggctgataccttttagggtttcaaattctctgccttcgccatggcgatggtttgtttcccatcgaagggtgggaaaggattccaagtttgtaccacaaagaagagacagggcttcaaccctgcttcaatctcagataagaaactctatttggctgggagcagtggctcatgcctgtaatcccagcactttaggaagccgaggcaggtggatcacctgaggtcaggtgtttgcgaccagcctggccaacatggtgaaaccccgtctctactaaaaatacaaaatatagccaggcgtggtggtgggcgcctgtaatcccagctacttgggaggctgaggcaggagaatcacttgaacccaggaggcagagaggttgcagtgagctgagattgtgtcacttcactccagcctgggcaacaaaagtgaaactctaccttaaaaaaaaaaaaaaaaaaaaaaaaaaaaaagatctgccgagagtcctggagcgagtcactcaaactctctgagcctcacttggaacgagagctgagggtagaatttatctcagacaatgtaataatcataatttagggtgatggttttaagctagcacccaacctcaaggcctttctgtgttcatacctttcccagttctggtcccctcccctctcacttccttgcagagactctccatttttgtctccccatccagaacctgcctgcttgccttccaggactgggccccctttgcttcctgaggtccctcttcttcctctcccagaccttttattttgctatggactggactctgagacccaggactcagggcttgcctgcaggctcttcccacgctgtgccccccgccagctgtgccccacgccagctcgccttctctactccacccttcacctaaactggaaaactcgtgatctactcagacatgcagaaaagtactgaaaagaatcagccacgcatgtccccaccaccacggtttggttgatgttttcacagtaccatctttgctgcagatttttctaaaaaggaagagaaatgttattgttcattatcctttcaggccccttcttaggagtagcagaattttagatttactggttcttcctaagcctgttttattttatttatttagagacagggtcttgctctgttgcccaggctggagtgcagtggcacaatcacagctcactgcagccttgaattcctggactcagggatcctcccctctcagcctcctgagtagctaagactagaggcatgcaccaccatgcccagctaatttttttttttttttggtagaaatagggtctcactatgttgcccaggctcgtcttcaactcctggcctcaagtcatcctcccgccttggcctcccaaagcgctaggacaagtgcgaaccactgcacctggttccctaagctttccaatacatagacacatctgcattcaggaagagtaagtggaattgctctgtgtatgtttctaaaaatgtatatatgcaagcatcatctttgcatccttcatcaacttgctttgcttgctcactgtcatgccttttcgggtcgtggatacacacatccccgtcaccttctgtcaactgcactctctttatcctctcatctccaactgatccccgggttcggcgtggaggacctctcctgaagaagcctgtgtggctgggtcagggccctcctttatctcactatcactccgcattgctgccagctgtgtactcagccaactctctgctcaccgtcctgcacgcaggaggtgactggatggggacagggcagggggcagcctgctcaggcctcgcactcctttccactagctggaacccctgccccattcatccccacctccgggctctgctggtcctggggtgtgaagcgcagggcaatgtatgctctcttgaaatgctgagggaaggggagaatcttagcagtcccccatggcttactctcattcattcattcattcagcacgcgtgtagcaccagtgtctgggggaaggcagccacacagccacatgtggctaccccggagtcacatagctgctgagataagagctaccaaggagaaggggagtccatagaataggtggatctaccccagcagagaggttggggaaggcttccctgaggaacagaaggtaaacctggaagtggaagagaagcagtgaaaaggggtgggaggggcattctgggcaacaggaatggcagagggaaaggccttgtggccgggcacagcgtggaaacaagacggtgacaggcacatgttgatgtgcagggcaccagctcccagggcctaagagcaaagagaggtctggggcaggggttaagcagctggaggtatggtcagatttatgtcgtaaggagctccctggctgccatggggagaagggactggagcgctggagtggaagaaggaacagtgaagagggactggaggcctgctgggctgctggctctgcaggcagggagaagtggggatccatttaaagggaaagggcctgcgtgcagtggctcatggctgtaatctcagtgctttgggaggctaaggcaagaggctcacttgagcccaggagttcaggaccagagtgggcaatatagtgagaccccatctctacaaatattaaaaattagcggggcacggtggtgtgcacacctgtagtcccagcttcttgggaggctgaggcatgaggattgcttgagcccagcagttcaaggctacagtgagctatgatcgcaccactgcactccaatctgggtgatacagtgacagcctgtctctaaagaataaagaaagaacacttaaaaaaaataggttggggtagggaagggcagggctgggacctgaagagagctttgtcccacccggaggcagaaaggggcaccaggtggcctcccgggctccagaggctgcagcacagcaacccatcagaagccgggagaacaaagaccagaggccgtttccccattcgctcccaagacaggccggggcaggcaggctgggaggatgcaaggtggtgccggtaacaccggcacagacctgccgggagcagagagcagctgcacgctgggaagccagggttctcttccccagacgaggagctttggaagctctctaaagcagcttctcccccaggtcccctacttccagggcctcccccaaccacacccttagggtattgcttaaagggtgtggacggagctgagtctctcccccaaaataccctttcccaacatgatccgcccgacagtgcctgaaatgctaccattagcagctgttcctccaggtaagctcagctctgtcctgaatcgaatttatccagtctcattccttcttccaagagaactgggcaagggatggaggggcaaagctagagagaagagaggtagagggggttgctgggggtagaggcagtgagcacaaacaccaatgactctaccatttggcctggagcagtccccaggcacagttgctgccagatccaggtacgagtggggaggcctcatttgcttccccaggcccccctggacttccagcatcagccatttgtgagctgtgagctcaaggtgaatgtgagccctctgtgaaacaggacacttccacctgcatggcaggcccgctgtcagaatgagatgtaacatccatggccttgctgggctcacagtatgtgcctgagaaatggcggggcggctctctctaagctgttacccacatgggtcccctcccatatcgatcaggcgttcctaccaacactgatcgatgggtgcatgtgcgtgtctgcttgagtcagctccctggtcagctctgggcttggctcagtcatgaatcttttttttttttttttgagacggagtctcgctctgtctcccaggctggagtgcagtggtgtgatctcggctcactgcaatctctgcctcccaggttcaagtgattctcctgcctcagcctccccagtatctggctgggattacaggtttccgccaccacacccagctaatttttaatatttatttttgtagagatgggatttcaccatgttggccaggctggtcttgaactcctgacctcaagtgatccgtccgccttaccctctcagagtgctgggattacaggcgtgagctaccgcgcccagcccgtcatgactcttaatagcagtgtgtgcttcctagtattggctgctatgatttgccgggcactcgctctgaaccaggtcatgggctggacccatcatgtgcatcccctcatttgatctacccagcagcctcaccaactgggggttgctgttgtcaccccacctcatagatgaagaaactgaggctcggagacattaagtgacttgcccaagatcaaacagcttaagagacccagagctgcggcctgaactcatgcccagctagcatcaaacactgtgttcttgcttttttttttttctttttgagacagagtctcactcttttacccaggctggagtgcagtagcacaatctcagctcactgcaacctctgcctcccaggttcaagggattctcctgcttcagcctcctgagtagctgggactacaggcacccacccccatgcccagctaataaaacactgtgttcttaaccactaagaggctcagggtaccccaggtgcctcccagtagagcatgcttcccttttgccagctctcccctcaaagcctggggtcctgcctcccatgcaggagcgctccatcagggcggccccagtgttgcaagacccgtctaggcaaggccaggctgctgggtgtttactgggacccaggtctgggtggaggggcaagattaatcccattcaacaaattcagaagcgctggggctcagggatgctatgtttcttttcaagcagaggcagaattgagcctgactgcagagctgggtcttggccactccatcccaccccgtgacaggtcagatgcctcctctgtgaagtcctccctcacctcccagcatctgtgctctgactgtgacaactctcacttgaggcctgtcacaaagtatgtgagtggccagggtggagacctcatctgtccggctctatgctccattgctcctgcctggccccatcagtccgacgctcatgtaaccatacatgtactgaagcttaactccatcttatctctgtgatgtgactgccagcgactcaagtgcagggaggttgtccacgtctcctccacgaccacgtgctaaaacccagcaacagtgcctatggaattgtgcagtgcacagcctgtccaccatgatatcaagtttaaccctgggtacaccacagctagcttgcccgcatttgcttaataactgtaatcgtcacagatgctattacctgcggccgcttatcattcacaacctttcccctgcattatttcatttaatcctgagccaacatcgccaggcaggcaccgtgcttattcccatcccacaggtgagaaaacaggctcagagaagccaagcagctcctctgaggtcgcacagccaggagggtggcagcgggtctcctccagggcctctctactaggctggaggctgtcctcggtcacctgcaccatctggcctgactctgtcattagctcaggtgtgaacatcaactcccacacctgtcattaggaacccgggcaacgggagcaacggggttcacaccctgtcccggccctccccagcttcagctgctaaaaggcagacaaactggaaggggtggctttctcggtggggtgttccgttcactaatccacactttgtagtccaaaggcctgactaccttgggtatgaaagtcaccacttggggctcctgggtcccctgggctcggaaagggctgctaccctcatccgggcacctcctgtgtgctacagcactgctcctcccagcagccctatgcatgagacactcagtattaccacccgtgctgtgcagaaagggaaaacaaggcttcgagaggctccagggtggagatgccaggatcaacagtgaggcattctgctctcagtgctggagctcctactgccccccatgctgaatctcaccagcaattttgtcctcccccagacaatggagcgggcccctggaaaactcagagtgaaggaataacttggggatccactccctgtgaccagcgaccacagcctagagccgcaagtctgtcccctccacccccccaccaagacacttgctatggggctggctgggcatcaggcaatgttcaagagatgcgtttgagaggatggggtacagggctacccccaccccacaatccagtctgcgaactagtccccactaaggggagggggcagagggatgcactgggcttggagaccacccggggaggcatctgacatctgctcagggctgtggctgtgctcattctgtgctggggtggcaaggctcaaaggaatggtcttgcaccccaggctggggagagaatcaggagggcttcctggagaaagagacgtctaaatggagatctgggaccaatggctatcagcctaggacagaccgtggctgccttgggccagatatacagagagtggcaggaccccaaatctttgccaccccagaccctcccagtccctgcagctataaaggatgggatgcctttcatcctcatgcttctgggaaagcccgcacccctcccagcttgtctgggttcattagaaccttttgttaggtccaagctggggccttcaggatggagagctgcacgaaggagggaggctgggaggaggcagagggcggggcgaggcctggccccaccactggtatgtgggtgtctgcatgtgtgaaggactggatgggtctagtctctggggtggagaggacagaacggttctccacggctggcacggagcatccaattgtgcaatgccccagggaacagtgcagggactggacgggcctctggttgggtctgagtgccagctggacgcagccatggaggaggggtgtgcaggccctgcccagtctctggggttgtgaaagataggggaggggtggggaaatctctaaaggcgggtaatgcctctgagcttgaaagagcccaaacggagatacgggtgggtgggatcacagggcaggggggtttctgaaagggctggaaggccccggaatggagtgtcgcactccagcgtgctagggccccgccgcctgcacctgtccgactggtcggcctaggccggactgcaggggttgagtgggagccctgggcccagaggcctctccttgcctagggaagaagtgaggagctgcttgagggcacagtgggggctcccagtgagagcagcttgggggcagaactcccagacaggagagccatgtaatgtgcgggcccctcacctgcctgaagcctcttgtccgagaagctggcaaaatggtccttgctagcccagagcccccactctattttccgaagtggggatataaggcaggggctggattcccaccccctccgtcaatctcagcatctccaccaggctcccctaaaccggttattaagtgaacacattaggcttatcaaaagggacgtgggctgcttctccctgcaaacacatcaagacatgccattcccctcccaggccgccctgggaacccgcggctcagagacgccgccagtttcggggctggggtgggggcagggagccacacccctgcgaaaccgagcttcgaagaggaggccccgaagccgcccaacctccgctcagaacccagagggtggggaggtaagggggtgcctccccctgtgcccctcgacccgaccccacaccccccagggcctccgggcgcggctctggcgcgcagggtggcaggtgccgggaagtgcagcggcgggtggcccgccccctccggacacccatccctcgcctccccgacgccaggaacacttgcgcggtctcagaggcgctggagagcgccccccgacgccagctcagtttccctgcctcagggcgccccctggacggagcttcctgggtcgcccgcagcgaccccgccttgagtgcccggtcctccaaaaactccgccccctcatccaggtgactattcccggtcctgtgcgaccctctgcgcaagagcgaccctgggacacgggggtgccctgtacccccagctcagctgcccgtgccctaggccctcaaggcaatgctccctgggctcccggagtcccctgtgttatgctccccctcggggaccccagccagtcccttcccacctggcggcgcttcccagcttcagggtggcctcggtcccgcgttcccgagagtcccgcactccgggttcagttcccggttcctggacccccgtaccccccattcctacactgcccgggaggtcttccaggtcctgtgcgcccacaggggcaagagcgtcccggagcggagctgtgggcgcctcctcacctccgggtctgcacagtggggctgtatttgcctttgtttctcttcctgaagagcgagttcatggtggcgctcggggtgcgggcggcggcggctggcgggccgggcgcgcaccgaggggcgggcgggagcgcaggtgagcgagcggcggcgcggggagcccggactgcggcgcggcagtggctccgggtccctactcgctgggggcggggcgcccgccggccactggctctgcgggccgctccccgagaaggtggtgcttaccttcccgaggaggggccaccgcgcgggcggggcttggacgcgggggtggggacactgggtcttggccggacgccgcccacccccagccgggggactccggaggccgggcaggcactggggcgcaaaggccgccggggcgagcgctcgcagccccaccctcctcgggcccggcgcgcctctggccgaggccttcacctggttctgcgctaccgcggaactcggcgctcctggtgctttggcggacacccagctgggccccgcaagacaggtgcggcagagacccgcacggattcatgtgccctagtagctagcgaattgcactcagatggtggcaattgagggaagggggctgaactgccgagggcgccggcctgagttcaagccctgccacccccaggttggctgacactcctgggcaaggtgttttactgctcccagccacagtttacttctttgtcaaacggtgataaccaccaccccatccgaaaggcctgtggggatgtccctgcaggtaatgcacgcaaagcgctgagcgcagtgccctggcctgaatctgctctccgcttgccatctcgggtggacaaaaactcctttgaaacttcaataactccaggccctggcactagaagagcgcttcatagctggtcataaaagctgctcgattgcggctcagaacaacgacgttgcacaattctgccagcatgtcctggcccagactgtgtgccagtggaggaggctgcccttagacagaaacctaatctgacctgaagcccggatggcacacaccaccacacctggctaatttttaaaaatttttgtagaggcagagtttcaccatgttgcccaggctggtcttgaactcctgtgctcaagtgatctgccggcctacagcctcccaaagtgctgggattacagatattagccaccgtgcccagccaaccttattcttaatggggcttctatgggtgggcttaacccatttatgcctgaggttgcaattttttgaattgataaatcataccttggcagtgaccttgagcagtaggagataactcccacaggcgtcacgttccaataatggaccactaggcgtaaatagaggtgtgattcctcctaaagttgtgcctgcctgcctgccttccttctttccttcctctctctttcctttcttgctttcttgctttctttcttctttcttctttgagactcagttgcccaggctggagtgcattggcacaatcatagctcactgcagccttgacttttggggctcaagcaatcctcccacctcagcttcccgagtagctggatccacaggtgtccaccaccacgcctggctaatttttaaaacctttatatttatatatgttttttgtagagatggggtctcgctgtgttgcccaagctggtcttgaattcctgggctcaagcagtcctcccaccttggcctcccaaagtgctgggatttcaggtgtgagccactgcacccagccctaaagttgctttcaaaatgtgtgtgtccaaatgtgcatttttctgggggaggatgtattgctcagtggagtcatttactcattcaacacatgtttcccatcactctcacagcctcagtgtgcctggctctgcttgttgtacacggatgagaaaagggaaaagaacaacacaaaaggggctttctctttgggagctttcaggtcccggggcaggggacacatattaaaaatgttaacttggatgggcgcggtggctcactcctgtaatcccagtactttgagaggtcgaggcagggggatcacctgaggtcaggagttcaagaccagcctgaccaacatggtgaaaccccgtctctcctaaaaataaaaaattagctgggcgtggtggcgcctgcctgtagtcccagctacttgggaagctgaggcaggagaatctcttgaaactgggaaggggaggttgcagtgagctcatatcacgccactgcactccagcctgggaggtcacagtgagctgagatcgtgccactgcactccagcctgggcgacagagtgagacttcgtcaaaaaacaaaaacaaaaacaaaaacacgttaacttttctttttctttctttttttttggagatagggtcttgctgtgttgctccggctggagtgcagtggcgtgatcatggctcactgcagccttccttgacctcccagacggaagccgttgtctcttctcagcctccctctcaagtagctgggaccacaggtgtgcaccaccatgcctggctaattttttttaaattaattaattattattttttttttgacagtctggctcttgtcgcccaggctggagtgcaatgacacactctcggctcactgcaacctctgcctcctggattcaagcaactctcctgctgccaccacgccctgctaatttttgtatttttagtagagacagagttttgccatgttggccaagctggtcttgaactcctgaccttgtgatctgcctgcctcagcctcccaaagtgctgggattacagctgtgagccactgtgcctggcctttttaaatttttttaattaattaattaattatttaattttttttgagacagagtcttgctctgtcgcccaggatggagtgcagtggcatgatctcggctcactgcaagctccgcttcctgggttcatgccattatcctgcctcagcctcccaagtagctgggactacaggcgcccgccacaacgcctggctaattttttgtattttttaggagagacggggtttcaccatgttagccaggatggtcttgatctcctgaacttgtgatccacccacctcggcctcccaaagtgctaggattacaggcgtgagccaccacgcccggcctttaatttattttttttagaaggagtctcactctaccaccgggctggagtgcagtggtgcaatctcggctcactgcaacctccgactccctggttcaagggattctcctgcctcagcctcccgagtagctgagatcacaggcacgtgccaccatggccaactaaattttgtatttttagtagagacggctcaaactcttgacctcagatgacctgcctgccttggtctcccaaagttctgggattacaggtgtgagtcactgcacccggccgcctggctaatttttaaaattctttgtagagatgggctcttactatgttgcccagggtggtcttgaactcctacaggctcaagcaatccacctgcgtcagcctcccaaagtgctgggattgcaggcgtcagtccctgcgccggccaaattgtgaactccttgaaggggtctggggacatatgggggagaaagaccctgggagaggcggtggttctaacattgttgcaccttagaatctctacaggagtttgtaaaaggcatattctggggccctgggacccttgacatcctgattgggggggtctgaagagggaggggcctaagaatctgaaatctggacaagcttccctgggtggtctgaggcctcagtgtgtgcagcctcccagctgctcaggcagacagccctgaacagacctccccagcaaacccagtccttccccaactcggctctgcctggctcagtttcgggtgccgcccccaggtgggcatttctcattggcaggtaagggcatgacaatgccctccctcgtccaaaagtgacttccttgcctagatctcagggccccgaagggatgcttcctccagccagctgatattgggagcaggtgttagagaggagctggggtttcagaacacaggtgtgcggggagtcaccttgcacccgcagaagcctgaactcaacatggagctggctcagcacacagaccccttccccataccccaagaggggttcccagggaacttgtgcgtccttgctgtcgccccctggtctgcctatgcctggacaccctctcctttctcgttccccatacctttccccacaggtgggctcttactccgggctcagcatgccttgaggatggtcactgcagcagtgttgctgaccttgtactaagtgtgcatcctgggatgcttttggcaacacagttgctaatggagaagctctgtaaagaaactgctgcctatttggagggggatggtccggtaaccagggctgcctacaccaggaagaccctgcagctggaaaaggggcagatgtggagaccatatgtagactaacatggagtggagtgccagatgcaaagtgcaaaagaaagagggaaagacagagtgtgtggtgtgtaacatgcttgtctatgcacaaaaaacttctggaaggatacatgagaaaccgttgctgaatctccccaaaaaggacaagaaagaagtttgaatttcttttctttttgagatggagtttcactctcgttgctcaggctggagtgcagtggcgcgatcttggctcactgcaaccttcgcctcccagccattctcctacctcagccccccaagtagctgggattacaggtgtgtgccaccacgcccagctaattttgtatttttagtagagatggggtttcaccatgttggtcaggctggttttgaactcctgacctcaagtgatccaccgccttggcctcccaaagtgtggggattacaggcgtgagccactgcgcctggccattttttttttttttttttttgagatggatggagtcttgctctgtcacccaggctagagtgcagtggcgcgaactcgcctcactgcaacctctacctcctggagtcaagtgattctcctgcctctgcctcccaagtagctgggaccgcaggtgcatgaaaccacacccggctaatttttgtattttttatagagacgtggtttcgccatgttggtcaggctgctctctaactcctgacctcaagcaatctgcccgccttggcttcccaaagtgctgggattacaggcgtgagccaccacgcccggcccagatctcggtttgaatccccgctcagtccctttcagttgtgtgaatacgggcaaatcattttgcctctctgagcctcagttttcctcatctgggaagtgggcgcaaacctagcatcaacttcacagggtgaaaggctgtgtgttaagcattcagtatgtcccctggcagttaggtagcccctaacgaaggggagggaattctctctgtagctagagactgtgtgtttgcgggactgacgggcacaagtgactacaggagctccaaacagtgtcaaaactctcggcttctccaacctgccaaatcccctttccctacaactcctaggaaggttaagagttggtttgcgggagggaaccagatcagggacctctaggtcagcagtgaattctagctcagctgctgaataacagtgacggcattgataatagtaatgtcacctcttgtttattgagggctgactctgtgccaggcaccatggcacgtgcccaaccacccccactgggtgaagcagggcagtgctccctgcctgggaggtagccacttccttgtcttattttctttaattaattttaagacacagggtctcgttctgtcgcccaggctgcagtgcagtggtgtgatcatagttcactgcagcctcgacctcctggactcaagcgattctcccacctcgacctcttgagtagctgggactacagatgcacaccaggaagcctgggtaatttttaaattttttgtaaatacggggtcttgctgttgcccaggctggttgagaactcctgggctcaagtgatcctcccaccttggccttccaaactgctgggaatacaggcatgggccacggtgcctggcctctcttgtcttacttttcagggaaggaaatgggccctgagaagcacagggcccatttgggctggtacctgggtcagcctgctcctggactgagctcttgaacctctgcctccctccactcttcagagttctaattcctgggctcgggcttggggcagctgggctggtctcccgctgactcagctgagcctggcccaggagtggcgggtagaattagcagatttagggaggaatttgagtggcgcttcaccatccctcccctctccattctctaggagctgggctaggagctcccatggctgtgtgtgtgcgcacatgtgtacacacgtgcacacaccacacgtttgtgggcaggccggatggggtgggagatccgttctcaccccatgcatcctcctctgggcagatgggatttgtttggatccgcgaagccctctcctgccaagtgactcatcccctctgttgccgtgggtggagggccagcctgccggggtgggggagggtgcttgctttcctcgagtttgctcgcaccttcagggccatttgttccctggcaaccaggccaccctcagcgaccctgaaacctgtgttcctgcagccagaccaggcagccagctcatgggaggccaccaacttcggaagggttcctcacgcccgccctccttgtttgccatcactgttgccctagcagctggagaggtgtttggggtattcgcctgtgaaccagtttgaaacaagaggggcagcattcgcccagcccgggacagagggacatgtgggatatatcccgagccctctccgagacagccattctcccatctgtggctgtatgcaccccaacttggggtgcatttacaaatgcagattccagggtccctccctggaagagattacggttgggtgagtcttggcagggccgagaaatctgcatttatttatttattaattatagagatgaggtctcgctgtgttacccaggctggtcttgaatgcctgggctcaagtcaatctcttgcctcagcctcccaaagtgctgggattacaggcatgagccaccaaggaatctgcattttttttgagacagggtctgactctcttgcctaaactggagtgcagtggtacaatctcggctcactgcaacatccgcctcccaagctcaagcagttcccctgcctcagcctcctgagtagctgggattacaggcatgcaccaccacacctggctaatttttgtatttttagtagagatggggtttcaccctgttggccaggctggtatcaaactcctgacctcaaatgatccaccagcctcagcctcccaaagtgctgggattataggcgtgagccaccgcacccagccaggaatctgcattttaacaaacacctactccgtgggatgctgaggcaggtgagtttggggccaccctgagaaacacggctgtgaacagaaacagatgttgcagtaactccagccctggtctgcccacagccgggatacacttacaggtttcagcctgaaacctgggtttgaaacttggctccacctcacaccttagccgtgtgaccttgggcaggtggctctcttaacctctctagacctcagtttccccatctgtaaaattgggaagagccggtgggcagggatgtgtgcacagcccctggcatgaaggccctgctcctgtccctgctccgaggggacaggagggggctggcccagcttcacccctgttttgtaacatgtgtttacttttcttacaggacaattcaaggagtggaaaattgtgctggccctccagcccacatgggctgactcacgctcagctctgggctgggggccctgtgagctccccacagttctcctggggccagaggggaggccaggccctggcagctggagcaggagagggtctacggtgagtcatgctctgcctgcccctgagtcatcccctgagaatgtgcctcaggcccctacccgcccgggccccctggcagaatgccacttctccctgcctgccaggcagccccgccctcctgccggcccagggagccgctgctccgatgaccgcctcctggctctctcctgaatgcacctgtacagccctgtgtgttatcaaaatattgaaatagctcccaaccggtagttaaatagcggttgctctgagcccctggccaccctggtttttcccctccccagccactgaggggttagccgtgggctcagcaaagggttcttcgactctgccccacccatggctggggtccaccgtgactatgaaaagcccatcagcccatcttgcagatccaggtttttgggatttcagacacttcatcttgaaccctgggccacattcctttttcttcttctctttgagacagggtcttgctctgtcaccaaggctgaagtgcagtggcatgatcacaagtcactgtagcctcagactcctgggctcaagcaatcctcccatctcagcctcctgagttgctaggaccacaggggcgccaccacgcctggctaatttaaaaaacttttttgtagagttggggtctcgctatgttgtccaggctggtctcaaactcctgggctcaaatgatcctcctgcctctgccacccaaagtgctgggattataggagtgagtcactgcgcccagcccccggggcactttctgacacaacctgctacacatcttggatcccacttgtcaagcctggccctaggcctctcaggggtgggtacatcaagtgaggaagtcacactgtcagggcagaaagaggggctgggtggggccggacaggctctgctggctcaggatcccggcaggacaggctgcccaacccagccccaaaactcccatcttctgtccaacgcccaagcctgcttcctccctgccccacctcacctcacactgcccagactggtggggctgcatttttggggccggtgccaggtgtgatggaggacagcccaggtcaggaggtcagggccccgtttcctcccaagccaggatgactcagtgatggacagactaggccacaaggggccgaacacaaagccaaattagggtttagtttgaagccaacctgggtttgaaccctggctctgccatgcacccagctgcgggactgtgggctggtggcttaacttctctgtaccatggggaagagccagtgagctgaggtgtcaaatctcaactgatctatttcctaactgtgtgaccctgggcaaatgtcttcacctctcttaacctcagtttccccatctgcaaaatggggacactctgacacctgctctgtagggtcttgaaaagtctcaataaaggaagacatggaatcatggcaaatagtaacttttgttgggcatttactataaaccaggccacgtgctgagtaccaggcttggaggctggcactttttcttccagcttgattgagatgtgatgaacatgcaagaaagggcacattttaaaaaattttaggctggacgcggtggctcacgcctgtcatcccagcactttgggaggctgaaaaggttggatcacctgaggtcaggagtttgagaccagcttggccaacatggcgaaaccctgtctctactaaaaatataaaaattagccaggcgtggtggcgggtgcctgtaatcccagctactcaggaggctgaggcaggagaatcacttgaacccaggaggtggaggttgcagtgagccgagattgtactgctgcactccagcctgggcaacagagtgggtgttcagtgtcattgttgaatgaataaatgaatgagtgggaggaccagtgtactgttgtgatcccggagaaggtccccttaggggaggaccaggaaagggttagtaggtcctaagttaaaactatgatggaagagaagaggttcattggtttgttcatccatccatccatccctccatccatccatccatccctccatccatccatctatccatccatccattcatccatctatccctccatctctccatccctccatctctccttccctccctcccttccttcctccatccatccattcatccatctcttcatcccttcatccctccattcctccatccatccatccatccatccatccatctcttcatccctccattcctccatccatctcttcatccctccattcctgcatccatccatccatatcttcatccctccattcttccctctctccctcccttcctccatccatccatccatccatctatccatccatccatccatcccttcatttgtcaaatatttactaagcacctgctacgtgacaagtcctgttctaggcactcaggattcaagatcaagtacaatagactcaggttcctgctcccagggagcttgctgtgggagacaggagtgggaatggacaaacaatgtaagtttgaggtccccttgggtggatcatggcgcctcttctgtgtgccccaggagacaaagtctgcagtcggcacagagtcaccgtcaggtgggggcccagggacactatgaggaaagtggccagactccagtctgagggtggttgaggacccggtgaggaaggggaggccttagcttgcagggcgtcaggttccctcatcgtgttttctgcatcactgacatttcccaggagccaggctcctccccaacccccgtggaggatctcgacctcttgcccccacaatacctcccacaagtcactcatccatttattgagcacctactgtgtacccggctctggggatatagtagcaaacacgatacatccctcacatcctgggggccccctgtcttggaagggaggagggacagaaaagcaaacagataaccacattttttacaaatgaaataacctaagtgcccatcagtgggggaagcggtggtaaattacaaaactgccctagtctgggaggaattcggggaggcctgtgggcctcacagggaagctgagggtgtagcaagtgaaaaaaggaagctgcctgctattaggtgtcgtgttttgccatttccgcttcagaacggagctgccctgtgtctccgtgagctcgtcctccacctgcctgcctgcctggctctgcctccactctttgttcacgctctctgctgagctcaaacattcctgctgggcccaggcagccaagcccccatcagccgcctcccaggccattctctaatcacaagctcaggcttaatccccacacacgcccaggactccgctctgggcaaatactcctcctttcagccctggagtccctgacctcccgctacccagaccatcctgtcccctgtccccagccaaaaggcccccctccactggttgggggtggggagacctcagtgtagccttgtccaataaaactgcctgtgacaatggaaatattctgtatacatggaggcggcaagccacatgtggctactgagcacgtgaaatgtgactagtgcaactgaggaattgaattgttaatttttaaaaattcattttaatccattaatttattttttgtagagatgggagattctcactgtgttgcccagggtgccttgaactcccgagctcaagccatcctccggactaagcctcccacagtgctgggatgacagtcgcctgccgccacgcccagcctgaattgttaattttattgtttatgtgtattgttatttatgtaaatatagagcatattcatatttacagaatttaattaatgcaaacgtaagtagcagcgtgcatctggtggctgtcgcagggtccacctgggcccaggcatggagaagaggacagctcgggtccctggtcctcttcttggcaggggcagcctagaggggctgggtggcagctgaggcctcaggcactgagctggggggtccctggagtcgctgtgttgatggggctgagctttgggtgttggtgcctgtggcccctccccagcggccagtcccttgttctgacccctgcttggtggtcagaatcacacactgagagctcctgaagacctgagctgaccttcaggtgggactgtccggctccaatgacaagaggtcgttttccccaggttcctctgtctgcatccgctccacggatgcgctctctaggaacagcttccccttcctggttctcctgggtctccctttccattcctacagcatctacctgggcaagagatctagggtctcaccccctcacctccagattcctgaggtcactttggtggcctccctcctcctggctcctcctccgtgctctctgcacccttccccctcctccaccgtggtcaactacaatctattcccaacacagcaaccagagggctaaagtgaagtcagcagactcccctgtcccatacctcccagacactctgagtacctcagcatcagagccagataacccatgagaccccctccctcaggctcccctcagagtctgctctcttccccgccacttccctcccactaactctacccccgatacactgaccgcctccccaatactcaaacacgccaagtatgctcctgcctcagggcctttgcatcggctgcccccttggccccactctctacgtggaccccctgctcttcttccaagcctttgtgccaagtcaccttctcagcgcagcccacctggtccctacattgtaatctgccctgcacttcccaccctctttccctgctcaccaatcatggcactcagtgcaatctaacccacaacagaagccactcacggatacaaaaaaataagccaggtgtggtggtgggcgcctgtaatcccagctactcaggaggctgaggcaggagaatcgcttgaacccgggaggcggaggttgcagtgagctgagatcgcgattctgcactccagcctgggtgacagagtgggactgtgtctcaaaaaaaaaaaaaaaaaaaaaaggggagtgaaggcctgacatgcgcttcagcatggttgaccgtgagcacattaggctcagtaagaaaagccagatacacaacggcacatattatacgatcctgcctgtgaaatgttcagaggtgaattcgtagagatggaaaggagactgtggctgctggggagaggggagtggcgagtgactgctaaggggcacaggtgatgatagtgctctcaaattgaccatgctgatggttgtgcaactctgaaactaccaaaaccggctggatggcactctttttttttttatttttttttttgacagggtctttctctctctctctccttttttttttttttttttttttttttttgagatggagctttgctcttgttgcccaggttggagtgcagtggcgcgatctcagcttaccgcaacctccgcctcccaggttcaagtgattctcctgcctcagccttcctgagtagctgggattacaggcatgcatcaccacgcccggctaattttgtatttttagtagagacagggtttctccatgttggtcaggctggtcttgaactcccgacctcaggtgatctgcccacttcggcctcccaaactgttgggattacaggcatgagccaccacgcccggcccctgttttttatttttacttttttttttttgagacagagtcttgctgtgttgcctaggctggagtgcagtggcacgatctcggctcactgcaacctctgcctcccgggttcaagcaattttcctgccttagcctcccaagtagctgggagtacaggtgcctgccaccatgcccggctaattttttttgtatttttagtacagatggggtttcactatgttggtcaggctggtcttgaactcctgaccttgtgatctgcctgcctcggccttccaaagtgctgggattataggcgtgaaccacctcacccggccttaaaattttttgtagagactggagccttactattttgcccatgctggttttgaactcctgggctaaactggtcctctctccttggcctctcaaagggctgagattacaggtgtgatcccctgtgcccagccaagggtattgctgtactgctgaggctggagtgcagtggtgtgatcattgctcactgcagcctggaacttctggcctcaagcaatcctcctggctcggcctcccaaagttcggggatgatagaggtgagccatcagacccagctgaattgcatactttaaataaatgaattctgtatctccaaaaggcagagttatcaccttcctatactgtgttggccaccccctcaaatgtccaacgtcaagtcctcactccccttcaccctaaattcccgtgggaaatgcccctccttctaagcccgcacagttacaaacatgtacccgggtcctctggtggtccctgtgcaattacttttcctcacgcaatttccaccaaccttcaggataacactatggttaaccccattaaaaaaaaagtttccaatgtgatttttttttttttttgagacggggtttcactctgtcacccaagctgaagtgcagtggcacaatctcggctcattgcgacctctgcctccaggttcaagcgattctcatacctcagccatccgagtagctgggattataggggcctgccaccacgcctggttaatttttgtatttttttgtagagacagggtctcaccatgttgtccaggctggtctcgaactcctgacctcagatgatctgcccaccttggcctaccaaagtgctgagattataggagtgagccactgtgcctggcctcaatgtgattttttaaaacaaggctaatcaggtgaagcagtgggagtggagaaaacaaaacaaaacaaaacaaaacaaacacatctgcaacgggttgagacaattagttgtaaacaccactgcactcagaccagctcctgttattttttttattgcagtaagatatatataaaacattgcccatcttaattaatcatttttcagtgtgcagttcagtggcattcacattattgtgtaaccatcacaccatccatctccaaaactcctttttttttttttttttttttgagagtctcgctctgttgcccaggctggagtgcagtggtgcaatcttggctcaccataacctccgcctcctgggttcaagcgattctcctgcctcagcctcccgagtatctgggattacaggtgcgtgccaccatggccggctaatttttgtatttttagtagaaatggggtttcactatgttggccagcctggtctcaaactcctgacctcgtgatccgcccgcctcgggctcccaaagtgctgggattacaggcgcgagccactgtgcccggcccagaactcttttcatcttctaaaacccaaactctgtgtccattaattaactccccatgcccctccccccagcccctagccccgccaccgttcttctttctgtccctgtggattgggctcctctaggtgactcagatgtggaatcactcagttcttgcccgttcagcataatgtcctccaggttcatccaagtcgtagtgcgtgtgggtgctttattcctctctaatgctgaataatttttcatgttacccctatttttttttttttttgagatggagtctcactctattgcccaggctggagtatagtggcatgatctcagctcactgcaacctccacaatccgggttcaagcaattctcctgcctcagcctcccgagtagctgggattacaggggtgcgccaccacgccagccaatttttgtatttttagcagagatgggttttgccatgttggccaggctggtctcaaactcccgacctcaggtgatccacccacctcagcctcccaaagtgctgggattacagccgtgagccactgtgcacagcccatgttaccccatgttaaaaggaggggacattggctgggcgcagtggctcatgcttgtaatcccagcactttgggaggccgaggcgggtggatgacaaggtcgggagatcgagaccatggtggctaacacggtgaaaccccgtctctactaaaaatacaaaaaaattagccgggcgtggtggtgggcgcctgtagtcccagctactcgggaggctgagggaggagaatggcatgaacctgggaggcgaagcttgcaatgagccgagatcacgccattgcactccagcctgggcgatagagtgagactctgtctcaaaaaaaaaaaaaaaaaaaaaagaggggacattgaggcaacaaagctagggggtggcagggtcagaacgcacatcaaggttggtctgactcctgtacccgccccaagtgcccggccacctgacccctcccacagggccacccctcccatcccctgggccaccctcctcccgctgtgttccattctctcctttgggcttcatgtagcagttggtggagcccagaagtctttgtgaagtgaatggacttgggtgcccggctgggggtcaaggtgggtgggtcctggctgtgtagccccctgggtcagactgcctcagactcagcctctgctcagtcaaagctgctcccatgaccaggactgttccacagagttgtgcaggttacaacctatacacctgtacgtaacagccctgccaaccatcatgatagccctggagattcccaaatccaggaggcctcagggctctgcttcgagaaggggcaagaagcaacacaacgtagaggccacccgggacgaatgagatgtcccccaggaagcagataaacagatggatggtttccaggggctgcgggaagggaggaaggaggagtgacagcttcatgggtatgagtttccttttggggtgatgaaaatgttccaaaactagaaagtggtgctggctgtacgtgcatcttgtgaatataccaaaagccagagaattgtacactaagaaatggttaaaatggtaacttttgtgttatgtgcattttttttttttgagatagagtctcgctctgtcacccaggctggagtgcaatgacatgatcttggctcactgcaacctccacctgctgggttcaagcaattctcctgcctcagcctcctgagtagctgggattacaggcatgcagcacactaagaaatggttaaaatggtaacttttgtgttatgtgctttttttttttttgagatggagtttctctcttgttgcccaggctggagtgcaatggcatgatcttgactcaccgcaacctctgcctcccgggttcaagcgatcctcctgcctcagcctccccagtagctgggatttcaggcatgcatcaccacacccagctaattttgtatttttagtagagacgaggtttgttcatgttgatcaggctggcctcgaactcccaacctcaggtgatctgcccacctcggtctcccaaagtgctgggattacaggcatgagccatcgtgcccagctgatttttttcttttttttttttttttttgagatggagtctcactctgttgcccaggctggagtgcagttgtgtgatctcagctcactgcaccctccacctcccaggttcaagtgattctcctacctcagcctcctgagtagctgggattacaggcatgcgctaccatgcctggctaattttttcatttttagtagagacaggtttttgccatgttgtccaggctggtctcgaactcctgacctcaggtgatccgcccacctcggcctcccaaactgttgggattaccggcatgagccactgtgctcggaccattttgccacaataaaattaagctggggaccgtaccctgcttactgcatcttcttcagcttcagagccatcccagggcccattatgtattccagggtcttaacccccattctcaatgtcacactgagccattcaactcaggacattcccagcaggatgccttccaggaacatctgcctttggatggggtccagagttttactcaaacaaatgcatcactaatggttgaatcttctctggcagtggcccatctgctgggaagacattcagagacatgaggtggtttctggggttcccaaaacccacctccacaaaaggcagcattggctgggtcattcttgcagggcaggtgggaagcagcagatagaggctaaagatcctgccctgggactgagttcatgcccagcacccctggggaatcagcctatccttgcagcgccttcttgtcctggagccagggtgcctggagatcttgcagttcagggcttggaaatcacatcttcccggagcatcagctgcagctctaggagaagaagtcattggagaacgagagtcctgggtatgagttccttactagctgtgtggccttgggcaagttattcagtctctctgtgccttgtgccttagtttccctacgtgtaagatgaggattaaaatagttttgactgtatatgggcttttaattgagatgaaagccacgtaacagaaaattaatcattttaatattgtggccccaattcagtggcatgtgcatttgcaacgttgtgcaaccaccacctctatcacattccaagacattttcattgctctggggttgctttgaggattaaatgcattcgtgtttgtaaagctttagaatggtgctaggtatagtaagcgccaatggagtgtcaacaagtggtaggaataattagtagaacagtaataataggcaactgggccaggtgtggtggctcatgtctgtaatcccagcactttgggtggctgaggcgggtggatcacctgaggtcaggagtttgaggccagcctggccaacatgatgaaacctgtctctactgaaaatacaaaaattagccaggtgtggtggcaagcgcctgtaatcccagctactcgggaggctgaggcaggagaattgcttgaacctgggaggcggaggttgtagtgagccgagactgcgccactgcactccagcctgggcaacagagcaagactccacgtaaaaaaaaaaccccaaaacccaaaaaaagctggagtgagtgttggtggcgttattaattcccttccctggggctggaggaggagggagtggggttctcactcccctccaggccccagtttccactttgagctctctgtacccgcagggctgtcacacctctgtctcccacgcagtcattgtcctccctcaatgttgggcagcaggagaggcggacttaacgcctttcgtggtggtaacagcagctaacggtgttaacgttcactttgctctgtggcgatgcctgggcagagctgggcatttcctggatgagcccgggttaggacagtcatccctggatcccatgtcccccacctactcacccttgtgttactccaggagccatgggctatcatttgctgccaccttgcgacagggatgggaactttgtgtcccatttccgcccttgattacctaagccaagagtctgctgggcacctgctgcctgcctgccaggtccccagtaagatccttcccaacatgcgggcagctgaataaggcagccactgcccctgccctcagggagctcacagtctcctgagagagacctccaggaacccacagatatataaaacgaataaatgcaatattagaatgtgatgcaggctaggaagggaagagaggtgattttcacagggtgcagtgacatacttgaaatatatcaggggttgtccatctccctggccacctctgacttcccctgcttgaaggggtgaattcaccccacggtggcacgtagtaggtgctcagtaaatgttgaatgagtgaatacatggatgacagcactgtccagagccaatttcttgggtcttgtaggctaaacagatgaggagtggcaaggcaggacttctgggagcaaggttggtcccctgggagtcctgggagggctgaaaggggttaagtgtgagttaaaatgagagtgatggacaaatgtcactctcccaagggaggcccccttactccctgttttatttatttatttacttatttattttgagaccgagtcttgctttgttgcccaggctggagtgcagtggccaggtaacagctcactgcagctttgaacttctgggctcaagggatcctcctgcctcagcctcttgagtagctgggaccacaggcacgtgccaacacgcctggctaattttttttttttttttttgcgacggagctttgttcttcttgcccaggctggagtgcagtggcgcagtctcggctcactgcaacctccgcctccttgattcaagcgattctcctgcctcagcctcccgagtagctgagattacaggtatacgccaccatgcccggctaattttgtattttagtagagacggggtttcctcatattggccatgctgttctcgaactcctgacctcagctgatctgcctgccttggcctctcagtgtgctgggattacaggcgtgagccaccgcgccctgcctaaactaaaaaaaaatttttttgtagagataggttcttgctatgttacccagggtggtctccaactcctgggttcaagcggtcctcccgcttccgcctcctaaagtgtttggattacaggcgtgagacatggcgcccggcctcttacctgttttaaattgtcctttctctccgctggctccttgagcccctttcctgcttatttttctctcgttagagtttttcactacctcacacatcatatatttgccttatttattgagtgtctgtctccccaccgtagtataaactccacgagggcagggattcgtgcgtgtggctcaccggcggctctccagcgcctggacagggctgacccccagcaggcgctctgtgaaggtgtgcagagtgggcgaaggtgcatgcgcgggccgtggggcggggacaggtggaggagccagtcagacccaagtgcagcgggacgagggcgaggttaatctgagcaagaaaagcgtaaattctgcttatctacaaatgtaaacagtactgtcggccagacgcagggtccggggcgggtcggcccggactcagggtctgcttggaggcagagctagattagggcggggtcgtcctgtggcctaccattccccgaggctgagggccttggagggcggggccagtgaagggggaggggacttcctgaggtgtgaccaatctagagaaaggactgggctgagggcgtggtcaaacaagcgacatctaaaaataaggggcggggctagaaccagggggagttcgcctggggcggggccagagtggggcgggaccagttagggggcagggccaacctgggcggggccatggccggggacgtgggcgggaccaggtcaggggcggggccaggccaggatctccgctgtcccgggtcctggagctctctcggcccggcaggtttcgctcccgcccctccggccttccacagctgtcctggccgcagggtgttcaaggcgggacacaccaggctagagatccgcgatcgggccccgcctcaggtactgcgctccaggccaggcgggcgcgggtaagcgctcagctcccgagccaggcgggcttccagggcacttcccctaggctgcattcccaaaggctcccgagggcgagggtgagcaaagctgcggggacctgtgtgtgcatgcgtgtgcgattgcctctacgtgtgtgtacgtgtgtgtgcatgtgcgcacgggtgtgtgtgcgtgtgtgcacgtctgtgcacaccaggggaattgcgtgcgtggagctgggcaggtgcgtgtttcagggtgtgtgtgcaaagttggaggcgtgtgcaaaagcagtcccgtgtgggagggaaacctgcgtgtgtacatgtgtgtgatagagacagtgcctgtgaaatgtggtgaaggctgtgtgtgtatgtcagggtgtctgggaggaaaatgggagggcaggtgcaaggagactcgggggtgggctgtaggccagcaagtctgtggcaagctgcggggtgcatgcgtgaatagaaccgtgggagtgtaagaattgcaaatgtgtgtgtgtctgtgtgggtggccgtaaggcttctgggggccctcagtgtgaaggggtgggggtagaggaaagtttgggggtgctgactgctcttggaaggctgagcgtggtctggggccatggctaatgacagggaagctgttggggcttggcctggagtaatttggggggaatatcagccttctcaatttgaaggctggggagctgtgtgggtggggccaggggctgccccttacacttggtgggtggtgtccctgcttcccgaggtgggagctgcaacctcaccagtcactcctcgccccaggctctgtgcacacccctgcctggtgacctccattggtgctccagcgtgaacatggtgcaaagataccagtctcctgtccgagtctacaagtacccgtttgagctggtcatggcggtgagtgactcctgattcttgggcccccatgtgacagttggaggggcttgagatcagctatggcggtaggaagacggagctccttagactcccagatcagaaggaattagtgagttactcagctgacctggtgggtttaacttctatccagtgacctctctgtccaaccatcctatcctcggcccagtgaccaaaacacaaagtctttcttccttctccttgttgaagctgacctgctcccttactttagactctcctgatagaaaacaaaggtatcaggggccaagccactgctgtcatttcatataatggcatatcacagtgataaatggaatggtggtgataatgacaacagctgtttattgaatgtttacagcactgtcttaacagatgatgtttcttccaattcccgatagctgttattttcccatgtaacctccatgaaactgaggctttgacaggtgaagggatgacactaagttctgtatctacgcagaggtggagtcggggctgagatccccacaaaggagactctagaacctcacatttgaccacagagccctccttctgctcacagacccccttccctcccctttaaggaagctgacactgggacgagagagagaatgagtgggtaggtttgctttgtgatgtactctgtgttgtgcagcaagtcagttggaggcctagaattggctgccagatccttggcccccaggatcactggtcttttcaccctgggggcagaagctggacataggtggatgtggaattccttcttggctgcatccctctgcctctgagcacttcacttccctgctcagtaacatggggacaatgctacaaggttgcggggaggagtaaatgagatagttcttggtgctccttgctgtgtgccgggcacacagtaggagctcacaaaatatgctgtcgctgttattacaccgaagtcttgtaaattaatgtattgaaagtgtaagaaacattagcatccacccccatctgtcccaccccagcactgactgcttaaccccagccttctatccagggactttcatatctcttggtggctgtgtgtgcctgtgtgtccagtcctgtcttattctatgaatctacatgcgtatatgtttattgtcacacagaggatttaaaagcatcaccaaaatcatccacataccttgtgctgttacaggcagatggttctaggacagcaaagaggcaggaactggcttagggtcatattctagctccccaattgacgagctgagtgactgtggggcaagtcacttcacctccatgagcctccactccccatcaccaatgggaatctcctggcttccaaatcctggtgtcatgctgtggattaaatgagtcaatgtgtataaagctcctggtacggggctgacgcagatcaaatgctcactgagatccagctatgatcgttactgtttttgcaagtgcctgagtgactttgcttctgcgtaatgggagtggaacaccaggggatggtgaagagatccagggacgtgaattcagatgctttagggttctgctgtgctctgccatgctctggttgtatgtttttagaaagttgctgaacttaagccgggtgcagtggctcacacctgtaatcccagcgctttgggaggccgaggtgggtggatcacaaggtcaggagatcaagacaatcccgtgtaacacggtgaaaccccaactcaactaaaaatacaagaaaaattagccgggcgtggtggcgcgcacctgtagtcccatctactcgggaggctgaagcaggagaatctcttgaacccaggaggcagacgttgcagagagccgagattgcgccgcaacactccagcatgggtgacagagcgagactccgtctcaacaacaacaacagcaacaacaacaacaacaaagttgctgaacttttctgagccccattttcttttactttttccagactgagtctcactctgttgcccagactggagtgcagtggtgccatcttggctcactgcaacctctgcctcccaggttcaagccattctcgtgcctcagccccctgagtagctgagattacagatgcacaccaccatgcccaggtaatttttgtattttcagtatagacggggtttcatcacgttggccacgctggtctcgaactgctgacctcaagtgatccactagcctcggcctcccaaagtgctgggattacaggggtgactcactgcatccggcccctattcatatagccttaagtgctatattcatgggcatggcttattttcaagtgcaatgattgtaaatattttcagaaccctaaacgtgacaaattaagttggaatttattaagcacatgcagtagatggttttccatcctatagttaatgtgtctcagattcatggcagagaaccatgggtccttggactgtcagagaagggtggggacagtttctctcttcttatgaatgaatgaacaagtgcttgggtcttagaacatgtgagctgccagagccttaaactaagggtgattatttatgtttatcgaccacttattgtcacttggtaggactgggccctgtgcgaggcaaacagacacacacacacacaatcacttttcatcttcatgacaaccttatgaggcgcatataggcatacagtcatccccatttcacaaatcaagaaaatgggggctgggtgcttattcatagaataagacaggactggacacacagtcctgcactcgagcctgggcaacagagcgagactctgtctcaaaaaaaaaaaaaaaaagaaaaagaaaaaaagaaaagaaaacaaaaacaacagaaaaactatatgaatagcactagtaatgtactcgcattgcctgtattgggtatgttaaacatattttgtaagcttcaggttccacaaatgaaggcacggctccatttactcccttcgctgttgagtctctaggtactgacacctgtgggtagagtgaaaaaaaggctttcaaatctatattatctgtggccaggtatggtggatcatgcctgtaatcccaacactttgggaggctaaggcgggcggaccacctcaggtcaggagttcgagacgagcttggccaacatggtaaaaccttgtctctactaaaaatacaagaattagctgggtatggtggcaagcacctgtaatcccagctattcgggaggctgagagaggagaatcgcttaaacccgggaggcggaggttgcagggagccgagatcgtgccattgcactccagcctgggggaagagtgaaactctgtctcaaaaaaaaaaaaaaaaaaaaaacttccttatctgtacctgcgttaatttaagtcatttgtattttccagagggactgccacaaccctgtcattctatcttccatacagtccttgtctgtgaaatggtcccaagccacagcaacactgccaacaaagccactttgccgactgtttacaaaacattattgtccccaaaatagctgcataactcaacgtaacttgcacactgtggaagcacaaaaggggttttctatgcttaatgttcgtctttgtttcgcagttaaacacttgccctcagattgggtcagatgccggggaagtttcagatgaactcagctattttcactgcatccgagtgaccagaaaagctggcctttcagtttttctgtttaacaaaactgacttcagaatcaaaatgctcctagcttcttcaaaactccactgacaatgacacaaatgactgaaattgggcttgagtaattgattacaaaattgtgctttgaggtaacctttctagacctggctttaaacatttttaaaaattaatactctcacttaaaaaatttatctagtcaaataaacagagatttctctccaaatcccttcccacgaattttgcttctaaagagaaggattctagggtatctttcctcctcccaactattttttttttaagatggagtctcgctcgctttgtcatctaggttggagtgcagtggcatgatcttggctgactgcaacctccgccttctgggttcaagtgattctcttgcttcagccccctgagtagctgagattacaggcatgtgctaccacacttgactaatttttgtatttttagtagagacggggtttcaccatgctggccagactggtcttgaactcctgacctcaagtgttccgcccgccttggcctcccaaagtgctgggattagaggcgcgagccactgggcccaggcttttgctcccttttttctttctttttgagacagagtctcgccctgttgctgaggttggagtgcagtgatgcaatcatggctcactgcagccttgaactcctgggctcaagccatcctcctgccttagtctccagagtacagccttagctgggagtacaagcatgcaccaccatacccggctagtttttaaattctactatataaaaatttataaatacttttatagaaatgaggtctcactatgttgcccagcctggtcttgaactcctgggctcaagtgatcctcccaccctggcctcccaaagggctgggattataggcatgagccactgcgctcagccttcctttctttcttgatagcattccgtatcattgggttcaaaacaatgagcttttattatcttggtaaacagagaaaaacaattaagacaatggaggcagctggagtatccagtgttggagagggtccgtcagtcctttgaatgcccgggtcccagaaggtgtgtggggtggtggtgtctttgtggaggtccttgcatagaggacacaaaggccatgtggctcaggtcgcctgagtcccgaaggccatgctctgcccagtccattgtgagtcgagtctaggttatttgtctcttttctcaagtgggtggtaaagaaccagggccgggcatggtggctcacacctgtaatcccagcactttgggaggccgaggcaggtggatcatgaggtttggagatcaagaccatcctgaccaacatggagaaaccccgtcttccctaaaaatacaaaattacctaagtgtggtggtgcatgcttgtaatcccagctagtcgggaggctgaggcaggagaatcgcttgaacctgggagacaggttgcagggagccgagttcgctccattgcactccagcctgggtgacagagtgtgaccctatctcaaaaaaaaaagaaccagacccacaggctctctctctgctcgaggcctcagcacattccccaattcttcttcttcactcccgacctcaggtgatcttcctgcttcggcctcccaaaatgctgggattacaggcgtgagccactgtgccccacctcttcttcttttttcgatacggggtctcactgtcacccaagctggggtgcagtggcctgatgttggctcactgcaacctttgtctcccaggctgaagagattctcctgtctcaccctcctgagtagctgggattacagatgggcaccaccacgcccggctaatgtttgtatttttagtagacatggggtttcaccgtgttggtcaggctggtctcgaactcctggccccaggtgatctgcccactttggactcccaaagtgctaggattacaggtgtgagccactgtgcccagccactataatatatatttttaaaactacctcattcaggtgtgattgacacataaaaagctatatgtctttaacgtatacatcttgaatgtgtctggtgataagaagacacctgagggtacaatatttttaaggttcatccacatcttagcatgtatagattctgccttgtttttatggctaaataaatacttcactgtgtatgaatagaccacattttctttatcattcattagttgatggatatttaagttgttttcagtttggggggactattataaatagtgctgctataaatatttatgcacaagtttttgtatgaacatattctttccaaataaatctctgttgttggccaggcgcggtggctcacgcctgtaatcccagcactttaggaggccgaggcgggcggatcacgaggtcaggagatcgagaccatcctggctaacacggtgaaaccgcgtctctactaaaaatacaaaaaattagccgggtgtggtggcgggcgcctgtagtcccagctactcgggaggctgaggcaggagaatggtgtgaaaccgggaggcggagcttgcactgagccgagatagcaccactgcactccagcctgggcaaaagagcaagactccatctcaaaaaaaaaaaaaaaaaaaaaaaaaaaaagaaatctctattgtgaatggtaccggttattcaatgggtttttgaagattctattttaaattttatttaaggccagttgtggtggctcacgcatgtaatcccagcactttaggaggccgaagcaggaggactgcttgagctgaggagtttgagaccagcctgggcaacatagggagtccccatctctaccaaaaataaaacaattagctgggtgtgatggtttacacctgcagtcccagctacttgggaaactgaggcaggaggatcacttgagcccaggagattgaggctgcagtgagctgtgatgttgctactgcagtccaccctgggcaacagagtgagaccctgcctcaaaaaataaaattaaaaaaaatgttaaaaatgttaaaaatatttaacaaactcatacacagcactgaagttccgccaccatgcctggctaattttttctattttttagtagagacggggtttcactgtgttagccaggatggtgtcaatctcctgacctcataatccgccctcctctgcctcccaaagtgctgggattacaggcgtgacccaccgcgcccggcctcttttttttttttttttttttttttgagatggagtcttgctctgtcacccaggctggagtgcagtggcatggtctcggctcactgcaacattcacctcccgggttcaagtgattctcctgcctcagcctcctgagtagctgggagtacaagtgcccgccaccatgcccagctaaatttttgtatttttagtagagacagggtttcattatgttggcaaggctggtctggaactcctgacctcaggtaatcacccgacttagcctcccaaaatgctgggattacaggcgtgagccaccgtgcccagccccagacactgctctgagtctattcacttattaattcctcatagccaccccatgagatgagttctgtgggcagcccattcgacagaggaggagactaaggagaggcttatccagggctccaaagcaaacatgtagcaggtggggactcaacttcaggcagttcggcccctcaatttacaccccaactatgagctctaccatttttcagagctggatggaggatctgaagttactgagctggcgtctgggccaagtgcatggtcccagcggaggcagttaccatcaggatgcctttaccccttcgggaccctgcaagggagaatacagcccaagcctgcaggccctggcccctggcacaccggccaagcccgggagtgtttattcagcgctacctgtggccagccctttaggccagctcagaggcaggtccattatagcagcctgatctgtagcagaagaggaaattgaggctcagcaaggtccaggagactgtccctcagtgaccagtgtttatggtcccacagagccacaaaccgggtgacttagaacaacataagttcattgcctcactgttctggaggccagaagcctgaattcaaggtgtgggcaggcccacactccctctggaggctctagaaggggatctgctcctggcctctctcccagcctcggacagttccttgacttgggacagcagaactccagtcctcacataatgactcactgtgtccagatttccgtttttttataaggacaccagtcatattggatttataaggacactccaatggcctcgcttcaacttgattacttgtaaagacctgttctccaaatgaggtcacatttacaggtaccagggcttaggacttcaacatatctattttaggggttacatttcacagctgggatttgaactcagggaatctgaccccacagccagagctcacagccagactttccggattctggctctgacttttctttctttcgttttttttttttttttttttttttttttttgacagagtgttgctctgtcgcccagactagagtgcagtggtgcaatcttggctcattgaaacttccacctcccagggtcaagcgattctcccacctcagcctcctgagtagctgggattacaggtgcccgccaccatgcctggctgatttttgtatttttaatagagatggggtttcaccatgttggccaggctggtctccaactcctgacctcaagtgaccctgaggtcacttgaactcctgacctcaggtgatccacctacctcggcctcccaaagtgctgtgattacaggcgtgaccacacctggcctccttccttccttcctttccttctttccttccttcacctctcccctccccccctcccccttcccctcccttcccctcccctctccttcccttccctttctccctctctattttattttattatatttcttttttgagacaggggcttgctctgttactcaagctggagtgcagtggtgcaatcatggctcactgcagccttgacctcctggaggtcaagtgattctcccacctcagccttctaaatagctgagaccacaggtgttcaccaccacgcctggctaattttttttttgagacgaagtttcgctcttgttgcccaggctggagtgcagtggcgcaatctcggctcactgaaacctctgcctcccgggttcaagcaattcttctacctcagcctcccgagtagctgggattacaggcatgcaccaccacgccaggctaattttgtatttttagcacagacggggtttctccatattggtcaggctggtctcgaactcccgacctcaggtgatccgcctgccctggcctcccaaagtgttagggttacaggcgtgggccacggcgcccggccgcacctggctaattttaaaaaatatttttgtagaggtgagctctccctatgttgcccatgctagtccgaaattcctgggctcaagccatcctcctgtggtctcccaaagtgctgggatcacagatgtgagccactgtacctggccttgactttccataaacatttgtgcaccagcagcagtactgtggctttaggaatgacctggtccccttttgtccagccactgcccaggtgttcctgtggggctccaaagcccagtagcgtcaggtcatctctgttttgcaaacctaaataaggaagatggcttggagtagaacttcctaagcaaaaggcttttcctgtggaggaagggttacggaggtaaggttctgtccttcagcaattacatgttaaaatatttaaagacctggccttgttgtattgttaaacagcttgtaatttagccaatgcgttattaataagaagcagcctgtgaaggtaaattattgtggcttaggccaaaagcagttacagttggattcgctgttacggaggtagttttaacaaagcggccggggccttatttaaatgagtttaaattagctccctggagcctgtcatctgatcctgttgctaacagattaaggcaagcaatgttttctaccttgaatgctgctctgatttgcgctgggagaacagaggtgatccactgccctgcatagttgtcttctgatttccgagggccctgaaataagtgtaaggccctcgtgcattcatttctgtgtgcatttatttatgcattcatgcatgtgtgcattccacaaatattttttgagtttttgctgtgtgccgaaggctgtgcgaggtggattcctagcacttctttttttctccaatgtcagaggctcaaatgtgcactgatctagtactttcttttttttttttgagacagagtcttcctctgttgcccaggctggaatgcaatggtgccatctcgcgcatggcaacctccgcctcccaggttcaagcgattttcctgccttagcttcccaagtagacgggattacaggtgcctgccaccatgctcggctaagttttgcatttttagcagagatggggtttcaccacattggtcaggctggtcttgaactcctgacctcaggtgatccacccaccttggcctcccaaagtgctgagattacaggtgtgagctactgtgaccggcctgatctggtactttttgaaatgcattgttattctgttcatttgtttccttgtttacttgtttatatgggtatttttcattaagggaagctccaggaagaaaagactgtgtctgtcttgtctggttctttttctttccttttttttttttttttgagactggtctcaggttgtcacccaggctggggtgcagcggcacgatcacagctcactgcagcctcaaccttgcaggctcaagcgattgtcccacctcagcctcccaagtagctgggactacaggcacacacaaccatgctaggctaatgtttgtatcttttgtatagaagggtttttaccatgttgcccaggctggtcttgaactgctgggctcaagtgaactgactgcctctcaaagtgttgggatcacaggcgtgagccactgcacctggcccatctggttcttttgatgtggttcctgcccttatcgagccctcagcatagtctattgggggagggggtgacagacaaatgccatgtagaaccattcatcatggggaaaaacagggcattgtaggaacacaaagaaggacccactggaggccataggagggtcatttgagccagccaggctgagagttgcggggaagcagggagtggggaggtgggggatgttaagcagggtttagcctatgcaaaggccaatggggcagaacttgtctctcaaagaagtgaactagcttaatgggaccccagtgcaagttagaaagtggctggcagcgtcatcaggggccaggaagcagagacgttggaggtctggaggcattcctgagacacttggaaaatttaaaatagtgtttcccctctgcgcaaaatcctgacataccatgtaaatgtcaagctgctctaggctggcctcgctaagtcatccgccctcccggagccatcaggggaaccagctgatcctaggagtccctgggccccgctcctgacacgtgagtgagactctgcagtgggtttgtgcacacatgggtggcacgggctgtcgttctcccagtgccggagaggccagtcattctgagggtgagtcctcatgtggaggggacacggcttcccagcccaaaagtacatccaagtgtgcagaagtaggaaccagtaagaactagacctggctgggtgcggtggctcgtgcctgtaatcccagcactttgggaggccgaggcgggtggatcacgaggtcaggactttgagaccagcctggccaacatggtgaaaccccgtctctactaaaaatacaaaaattagctgggcgtgacggtatgtgcctgtagtcccagctacgcggggggctgaggcaggagaatcgcttgaaccgggaggtggaggatacagagccgagattgcaccactgcactccagcctggtgacagagccaaaaaaaaaaaaaaaaaagaactagctgactttggtcctgttgcagccatgggttagggaacttgttaaaaacaggcaaaactggccaggggcggtggcttacgcctataatcgtagcactttggaatgctaaggcaagaggattgtttgagcctaggagtttgagagaccagcctcggcaacacagtgagaccttgtctctacaaaaaattaaaatatgaactgggcatggtgatgtgtgcctgtaattccagctacttgggaggctgaggcaggaggatcagtggaggccaggaggtcgaggctgcagtgagccgtgatcttgccactgcactccagcctgggtgataaagcaagaccttgtctcaaaaacaaacaacaataacaacaacaaccaaaaaaactggcaaaactctccctctccagctttgttgttcatggctgattcattgtttaatccctgtggataaaccctgttctgacaactgagggggagttactcatttattcacctgcccaataagtatcttccagaacctagctctctgaaggtagagctttgggctgcgcacctgctgatgtcccctgggagtgtagatgtaggtccactcactctgagactagggagaccggtacttatgtgacttaatctcccagggatatatagaaagatggttccattttcctattttatttccctggcacctggccattcactcattccttcctcctttcattcctttgagaaatattggctgaacgtctacaatgtcccaggtgttgtacaaggcaccagggaattcagtggtaaatgaaacctacatagagacggtggcattgagactgtaaacaaacaaacgcagacataatgtcctattccaaaccatgacaaatgcttctgatagggctgtagaccatctaggaggtggcttattctttttttttttttaattgcccgggctggagtgcagtggtgcaattatagctcactacagcctcaacctcctgggttcaagcgattctcccacctcagctacctgagtagctgggactataggtgccaccgaacctggctaattttaaaatattttgtggagataggggttttgctgtgttgcccaggctggtctcaaactcccggcttcaagtgatcctcttgccttggcctcccaatgtgctgggattataggtgtgagccactgcacctggcttcactctatagttttttattgtgatgaaatacacgtaacataaaacttcccatttaagcatcttaagtgtacagttcagtggcataagtacattcacgttattgtgcaactgtctccactgtccatctccagaaccccttcatcatcccaaaccggactctgtacccatgaaacactaactctccactccctgctccccactgctgctattaaccactattctatttgctgtctctgcaaatttgaccattctaggtacctcatagaaaaggaatcatacaatagttgtccttttgtctctggctcgtttcactggacacaatgtcttccaggttcagccgtgtcgtggcaggtgccaggtgcctcactcctctttaaagctgaagaatacgtcattgtatgactccatcacctttcatttatctgttcatctgttgatggacacgtgggtgttttcccccttttgatcattgtgtaaatgatgctgctgtgaacatttgtgtacaaatatctgttttaagtctccattggtttgctcttgtccattaagaaaaaatcaacaatgtggtacctggcattgtccctttaattgctgcagcaactccagagcccacactcttaatggcagtgctatgctgttgctcattcattcgtcctgtaaatgtctattgagtgttgactatgtgctaggcatttttgcaaagcactgcaaattcagggatgtcaggggctggtgatgctacttcagcagttgtgatgtgtgaaggaataaaacaggcatacatgagtcagcatccttttcctctttttttctgagaaaaactgagcctcagagaggttgctttgagagcatccagctgtcaagtggcagagctggggtcacatgttgaccctgtgctgtgtctctgcccctcccccacgcgccgcccttgtcctgtcactgagtccaggtgccctggctgcagacgctgttctgaccctgtgtctccatctcatgtgtgtcccgggctggctttgctgggatgagcagtggcttttcagctccagggccatctgggtacagctgcaatgatggattgtctgcaacagtcatgtcagggcttccggaacagtgtcagcctggttctgccaggcccacttcccttcatcagctgggtgacactgctgccattggatggctgatgactcattcagcaagctctagttgagcacccctacgaaaagttggggggtctaccccatggcacagtcttcagaagtgaaaaggaaggaagcactgatgcacgatgcaacacagatgggctgaaaacattgtgctgagtgagagaggtcagaggcagaaggccatgtcttatgtgatttcttttttctctgtctcttttttttttttttttttttgagacagagccttgctctgctgttcaggctggaatgcagtgaggcaatctcagctcactgcaacctccacctcccgggttcaaacgactgttgtgcctcagcctcctgagtagctgggactccaggtgcatgccaccatgcccagctaatgttttgtatttttagtagagatggggtttcgccatgttgaccaggctggtcttgaactcctcacctcaggtgatctgccccctgaggcctcccaaagtgctgggattacaggtgtaagccacctcaccaggccttatatgacttcatttcttggaactatccggagaagggaatacatagacacagaaagtagatgagtcggatgagtggttgtctaggactggggtggcaggggagggggcggagatggggttgacttctgaaggatacagggcttcttttgaaggtgataaaaatattctggaataggtattggtgatggttttaagttcatgaatgtactgaatgaaacacactggactgcatactttatattttattttttgagacagggtctctctgttacccaggctggagtgcagtggcaggatcatagctcactgcaatctcaagccatcctcccgccccagcctcccgagtagctgggaccacaggcacgcaccatcatgcctgcctagttttttatttttatttttagagatgaggtcttgctatgttgcccaggctggtcttgaacgcctgggcttaagcgattctccgacctcgacctcccaaagtgctgggattacagggtgagccaccgtgcctggcctgacctgcatacttaaaaagggtgggctatatgatatgataattatattttaattttttaaaaaaacatttatttttatttaaacagtttttggggtacagcttttttttttaacatggataaggtctttagtggtgatttctgaaattttagtgcacctgtcacacaagcagtgtacactgtacccaatgtgtagtcttttattcctcactccctcccagtcttcccctcccaagtccccaaaatccattatatcattcttatgcctttgcatcctcatatatatatattttgagatggagtctcactctgtcacccaggctggagtacagtggtgtgatctcggctcactgcaacctctgcctcctgtattcaagcgattctcctgcctcagcctcctgagtagctgggattacaggtgtgtgccaccatgcctggctaatttttgtatttttagtaaatatggggtttcaccatgttggccaggctggtctcaaactcctgacctcaagtaatccgcccacctcagcctcccaaagtcctgggattagaggtgtgagctaccgcgcccagcttgcgtcctcatatcttagctctcacttataagtgagaacatatgatatttggttttccattcctgagttacttcatttagaataatgacctccagctccatccaagttgctgcaaaagacattattttgtcacgcctgtaatcctagcactttgggaggcggaggtgggcggatcacaaggtcaggagatcaagaccatcctggctaacacggtgaaaccccgtctccactaaaagtacaaaaaaattagctgggcatggtggtgggcgcctgtagtcccagctacttgggaggctgaggcagaagaatggcgtgaacccgggaggcagagcttgcagtgagtcgagatcatgccactgcactccagcccgggtgacagagcgaaactccatctcaaaaaaaaaaaaaaaaaaaagacattattttgttcctttttatggctgagtagtattccgtggtgtatatataccacgtttctaaaatccacttattggttgatgggcgtttgggttggctccatatttttgcaattgtgaattgtgctgctataaacatacatgtgtatgtgtctttttcacataatgacttcttttcctttgggtagatacccatatttcaattttttaaaaaagagttggaggaggtgagtagattgatatcacatctgtgctgaggtcccctagacttgcagggggaaggaaaggggttgatagggagactcctgaagagtatgacaggcgatgggggcaccttactcagtggctgcgtagtggccaggcccccaaatcaggcctgcagaatagaaaagggaagggagagcattgggctggaagatgttggtgcagcttggatattctttctgcattcttactggacgttttggcgtaagtggcattccagcttcctttgaatttggatgaggaagaacaggaaggaaggaaggaggggaggagggatcatctgtcaagtgattagcagaaatagctttttgtactttacagaatctcactcatttttaaaatttaaatttacttaaatggtgatgtagaatgaaccatgtgccaggcactgctctaagcacattgcatgagctgactcctttattcttctgacaagtagcaaggtagctacttttcttacttccccttttacacacaaaggaattaaggaactgagagcttgatgattttttcacacagctgatgagaggcagagcagagatcccaacccaggccccagagcccactctcttaagggcggtgctatgctgttgttcattcattcatcctgtaaatgtctattgagtgtggactatgtgctaggcattttgcaaagcactgcaaattcagggatatcagcggctgatgaccctatttcagtagttgtgatgtatgaagcaataaaataggcccacctgagtgctagttgggaggttctatgattattgcactttacaaatgaaagaggggttacccagcctggaattgggcaagtctgggtgggaattcagggctatttagctccagcctcccatctccagatgctaattgtgtcaatatggattttccaggatggggacccgtaagaggcagccctgcttggtccctgcctgccccactgtggccctgcagctgtgggctctgggctttggaccatctccttttctgagcaggcaggcttggatgtcctctccagccacctggcagaagggctgtaactgaatccttctgtggccttgtgttcctgagagcaccaaaccatgtgtttgtttagcagggagaggctcaggtctcatttgtgggtggtcaagccaactgtagggacaggagccggcagctgaggctcttaggcagggacaaaactagtggtgtgagctggtttccaacacagaaaggtcccgtcagctgtttgatcccgtaggaccttgggaggtatgaaaggcacaggggctgggccctgtttggtctctgccagggcctctcccagggcagggtgcctgcggcccacagtttctcaaggtcacagcaatgtttaacaaggaaagaaaataaatgtaattattccagaatacaaaaagaaacctgcaggcccaggtgcagtggctcacgcctgtaatcccagcactttgggaggctgaggcaggcagatcccttgaggtcaggagttcgagaccagcctggccaacatggtgaaaccccatctctactaaaagtacaaaaattagttgggtgtggtggtgggtgcctgtaatcccaggtacttgggaggccgaggcaggagaatcgtttgaacccaggaggcggaggcggcagtgagctgagatcgtgccattgcactccagcctaggcgaaagagtgagactccgtctcaaaaaaaaaaaaaaaaaaaaaaaggaaaaaaaaagaaaagaaaaagaaacctgcagagttaaaatgaacacatgctgaattaaatgcctaccaagggcaacttcatgccaggctgtcatctggacctcaactgtgatgagctcatgtatatgtaaatcacggaaagtggatgcattttaatgtgtgtgatgtgattgacatgggtagagcccaggacctgtgaaggcctcacaaccatcctgcgaagagaggtgctctataaccttccggggctccctggtcccttctaggtaaggtccctctccacttggcaggcgtttgaattttattcagccagtgtttttattttatttatttatttattattattatttttgagatggagtctctgtcgctcaggctggagtacagtggcatgatctcggctcactgccacctcctcctctcaggttcaagcaattctcatgcctcagcctcccgagtagctgggattacaggtgcgcaccaccacgcctggctaattttttgcatttttagtagagacagggtttcactatgttgtccaggcttgtcttgaactcctggcctcaagtgatccacctgcctcggcctcccaaagtgctgggaggataggtgtgagccactgtgcacagcctttattttattttttaaagaaacaagatcttggccgggcgcggtggctcacgcctgtaatcccagcactttgggagggcgagacgggcggatcacgaggccccgagatcaaaaccatcccggctaaaacggtgaaaccccgtctctattaaaaatacaaaaaaaatttgccgggcgtaacggcgggcccctgtaatcccagctaacttgggaggctgaggcaggagaatggcgtgaacccgggaggcggagcttgcagtgagccgagatcccgcgactgaactccagcctgggcgacagagtcagactccgtctcaaaaaaaaaaggaaaaaaaagaaacaagatcttgctctgccacccaggctggagtgcagtggcataatcatagctcattgcagccttgaccttctatgctcaagcgattctcctgcctcagccacctgagtagctggtattacaggtacgtgccaccacacttgggtaattttcttttttaaaaatatttatgtatttatttttgagatggagtctcgctctgtcacccaggctggagtgcagtggtgcaatctgggctcactgcaagctccgcctcctgggttcaggccattttcctgcctcagcctcccgagtagctggaactacaggcgcctgccaccacgctcggctaatcttttgtatttttagtagagacgggtttcaccgcgttagccaggatggtctcgatcgcttgacctcgtgatctgcccgccttggcctcccaaagtgctgggattacaggcgtgagccactgcacctggttaattttcttattttatgtagagatgaggtctcactattttgcccaggctggtctcgaagtcctgggctcaaacaatcctcctgccaggattacaggtgtgagccacttcacccgacctcagccagtgtatttaatatcttctccaagtcagatgcaggaaggggatcttcaggcaaagaggctggaccctcagaggtgcccatggtcaagctggggagacagacacattttcaaatgcatggggactgtctgaggaacaagggcacagggagggtcagaaatgggttgagtatgagctgagggtatgaaccaggcttccgtcctgtgtgggagtgtcttgagtgttgggctgtccttcagagatcaaggcactgtttggttctagaagcaacacagtgcaccaaccccatggtctgactgcaagggggtcaaattgcagcttgatccctcacaagctgtgcgactatgggcaagtgacttaaactctctgagttttggcttctccatctgtcaaatgcggagggtgagcgctacctacttcatcaggagcagcacacggtatgcagtgagcccagtgtatgcctcggctattgccattactgcaatgatggttaggcttgggcagctgaaaattgtccaaatgtgtccttttggtactcatcggcaccttttggtcatctgaaattaaaggaaagttttctgcctgaccagccacccgctataaacattcaccccaggagaaggcaaggcagttctcccggggcctggagatgaggcattgattgtccctggagagcccttgcgctgggaggagctgcttttcttgctcctgtcattttccctgcagcaggaggatgaggtttgaaagcagcagacagaacctgaggttggtttctgccgaggtccctccatccccttccctgcatccccttctctgccatccagggaggtgaacctccttctcatgccccaccggccccatcctcagcccaccccgatcctcacttctccaggtcccctgctttgcgagttacaggccagtgggactcagcatttccaagccaccgatgcttgtgacgtagccagagattctgaggcaggacacagtgattcagggttgtcgtctgggtcagacaggctcatgcgccaatcccaccactccccggccatgtgctgctgggcgagtcactctgtcttcctgagcctcaacttgctcatctgtaaaatggggaaatgctagttcccatctcaccagggcattgtaaggatgaagcgaggcagttaacactttataaagtccttaacaacagtgtccaacaatcgtgaaagtcctctgatgctggacaactggctctgggatggacgccttccagacggagcctcagctcgaatgtccccccgaaacatgtggctctgtcactggatactgggagaagtaccttcctttcctttcgaagtcagagaaagtcatgccccagcagaccagcctcccctccgtgcctgttatctgggggctccagaccgggcctttctaacaagaggtttgttaggatgggaagtgagtcaggaactctggcctttgactggctgcgtgtgctgagtctgtggctttatcccctccctgacaccctccttgaggctctttgggccaagtgcgtgttatgttcttctttgctggttagcattgttagcgccaagggtgtgccgaggaccaagcccggcacaggtatgaggttgtgctttggaaaagcaggcgatcctccttcacaagtctcctgttacaaggcacgataaacgctttcaaagaaataaaatggtaaaaggaaggagaactgaggaagaggcagtcgtgcctaggagggggaagggagggtgtcccgggaagaaggaccagcatggatgaggccctgaagcctgagcgtctccttggcccaaatccaggcctcctacccctccagaaagccccatgtctcatgcctcccatccccttcactgtcaagaaattgatcagcgttccaagcatctggaacagcaagtgcaaagtccccatggcagggacacgtcgatgtattgttctaaacgcagcaaagctggcgtggctggagccagatgagggggctgggatgggaggtgggtgggcagggcagatcacacagggcccgaggaccaccataaagagtgcaggtttattctcggcatcaaggcccgttctttctttctttatttatttatttgagatggagtcttgctctgtcgcccacgctggagtgcagtggtgcgatctccactcactgcaatctctgcctccctagtagctgggattacaggcatgcaccagcacgtctagctaattggttttttttttttttttttttttttttttgtatttttagaagagatggggtttcaccatattggccaggctggtcttgaactcctgacctcaaatgatccatccacctcggcctcccaaagtgctgggattacaggtgtgagccaccgcgcctggtctcgtcaaggcctgttctgtgtatatcctcccccgaaatcatttcgtttgggaaacaggagggagactgagcagtagaaggaaggggagaaggtcaggggtggtgtggccgctgcctggcaggattctgaaggacagagggtggaaaagggaggagaagatgtgaccgcttggcccggggggacagtgcctggctctgtttctgagctgcccatgacaacaagcccagctgctgagcaaacggttcttggagggagtggggactgggcccaactgggattcaaatccaggttcaccatcccgtgctgtgtgacttggggtaaattagtgagcctctctgggcaagtacatgagacatatacgcactttccaaatgatgaaacaggcccagagaaaggaaggggcttgcctcgctggaaggaggtggagctggacttctaaccaggcagtctgaacccctccagcctccactggctttactctgctctctgtcctccgtggggagatgatttcctttgaaagtgggtccagcgtggctgagatctacagggcagacacagttctcagggggtctccttgccagctcgctgagtccagaccccaggatccccatggtgcattctctgggggaacgaggcctccctattccaacgctgatgtgtttgtcgcagcaactgacatggagatatggcaggaggcagctctgtcctcctggccctggtggaggacaggcaggctggccttgcccagcctggggtgacaccaagggctcctgggcatgtatccatttcttcctcggcccccccctccccccgcctctcttcctgggagccaggagggaagggggaggaggtgtctgtcctcagatgccggcactatttttggagcctgccttgatcccaattccggggcacgtgggctgtgacaggcgctaggagcagaccccgctggaataaggaataaggtcagccacagatgctgggatacgcccccaccaccctgaccctggcccttctagaactgggcacggacccttgccctccctgagcgtaggttcatgggcttgggggcccctcaagctaccttcacccagctctacacccccgcctgggaggacctccgcccgcacagaagcaagcagccccagcacagagcctggggctgacctgaattggctccgaggacagtgaggggcccttccctgtgaagggcacagtggcatggaatccagcttaacctcctgtgctcgtggccaaatcctgtgtgagacacacggagagactgtggaggaaataatcctggccatcccttctccagcacccacagcagtttgctcagttctcaggacgactgtgtgcaacagggcactgagaggttaagtaacccacccaaggtcacacagcttgtaagtggtagagctgggatttgtacccaggcagggctcgagtctgtgctgtcagccagggtgagaccctctaatggctcacaggaagcacattactgaatatttacatgaacatatacaaaaaaaattatgtaatagatatattcatatataaaataaactccttaaactactcatatatttatttatatatttatttttattttgagatggagcctggctctgttgcccaggctggagttcagtggcacgatctccgcttactgtaacctctgcttcctgggttcaagcgattctcctgcctcagcctcctgactagctgtgattacaaacatgtgccaccatgcccagctaatttttgttgttgttgttattttttagtagagacagggtttcatcatgttagccaggctggtctcaaactcctgaccttaaatgatctgcctgccttggcttcccaaagtgttgggattacaggcatgagccactgctcacagcatgcccatatatttatatatggaatatattatgtatccatatatgaaataatatatttacatgggtacatttatatatacattatatatttatagatatgtatagatatgatctatatttatttatattctatctatgtttataaaattatattatacagaacaccttatatttacattgtgtatagaaagatatatgcacactatataaattgtgtatatttatattaacatatattcatatatatttatatatacacttaaataatatatgtatacatgtggccaggcgcggtggctcacgcttgtaatcccagcactttgggaggccgaggtggacggatcacccgaagtcaggagttcaagaccaacctgaccaacatggtgaaaccccgtctctactagaaatacaaaaattagcagggtgtagtggcgtgtgcctgtaatcccagctacttgggaggctaaggcaggagaatcgcttgaacctgggaggtggaggttgcagtgagccgagatcgcgccattgtactccaccctgggtgacaagaacaaaactctgtctcaaataaataaataaataaataaataaataaataaataaatagtatatgtatacatgtggattcatatgtgtgtatgtgtacatataaacacatacacttggagagagaaagacacttttttaaagaaacagttttattgagatacaattcacatatcatacaactcattcatttacagcacataattcagtggctttcagtagattcataatattgtgcaagcttcaccgcaatcagctttagaatagtctcattacctcgaaaagaagctctgtctgccttaaccctcatccctcaacacccccaccatctctttcctcaccactcctggtccctggcaaccactaatctactttctgtctctctctatttgcccgttctgaacatttcatataaaaggattcatgcaatatatggtattttgtgattggctacttgcactcagcataatattttcacagttcatccatgttgtagcatgaatcagtaccttgttcctttttaaggctgtataatattccattttatggctagaccaccactgatttattccctcatccgttgatggacatttgggttatttccactttgcctattacgaataatgttgctataaatatttgtgtatttttttgtgtggacttatgttttcatttctcttgggtacatacctatgagtggaattgctggatcatatggtaactctttgtttaattgtttgaagaactgccacactgttttccaaaggggttgtatcatattacatacacgtgggagggtttgggggcttcaatttctccacatcctcaccagcactagctattattatgtcttttaaaagttattatagtcatcctagtggatgtgaagtggtatttcattgtggtttggatttgcatttccctagtgactaatgatgttgaacatagtttcatttgcttttttgtgttggtatattttccttggggaaatgtctgttgagatcttctgccattttaaaattgggtcatctctttattgttgaattctaacactcgtttatacattctagatgcaaatcccccattttctacacacacatgtacacatatgtatgtatgtataatttgcaaaaattttctcccattctctgggttaccttttcactttcttgcttgtatcctttgaaacacaaaagttttaaaatttgatgatatccagtttattttttcttttattgtttgtgcttttgatgccataagtaaaaaaccattgcttaatccaagttcataaagatttattcatatgttttcttctaagagttttgtagtttttaaaaaatgcttttaaaaaattattattattattttatttgtttatttttttgagatggagttttgctcttgtcgcccaggctggagtgcaatggcacaatgtcgcctcactgcaacctccgcctcctgggttcaagtgattctcctgcctcagcctcctgagtagctgggattacaggtgcatgctactatgcccagctaatttttttctatttttaggagagacagggtttcaccatgttgaccaggctggtctctagctcctgaccttcggtgatccacccgcctcagccccccaaggttctgggattagaagcgtgagccaccgcgcccggctccaacttcattctgttgcatgtgtatatccaattgtcccggcaccatttgctgaagagattattcttttctcatcagattgtcttgacacctttgtaaaaaatcagttggtgataaacgtaagggcttatttctggatgctaaattcttttccactgagctgtatgtctccccttatgccagtatcacactgttttgattactgtagcctgatatatctatatatttatagatacaatatatatttatatacatactatctatatttataaaattatattatatagaaacaccctatatttacattgtgagtagatagatatgtgcacagtctatataaattgtattattttttcttttattgttgaatagcctgatgttggtataaatatttgtgtataatttttttgtgtggacttatgttttcatttatcttgggtatatacctaggagtggaattgctggatcataaggtaattctatgtttaactgtttgaagaactgccaagccattttccaaaggggttgtaccgtattacgttcatatgacagggtttgggggtttcaatttctccacatcctcaccaacacgtgctgttatgtcttcttcttcttcttttttttttttttgagacagagtttcgctcttgtcgcccagactggagtgcaatggtgtgatttcagctcactgaaacctctgcttcttggtttcaagtgattcttctgcctcagcttcccaagtagctgggattacaggcacctgccaccacgcccggctgctttttgtatttttagtagagatggggtttcaccatgttggccaggctggtcttgaactcctgatctcaggtgatccacctgccttggcctcccaaagtgctgggattgtatgcgtgagccaccacacctggcctgctaccacgtcttttaaagtaaatcaggaaatatgagttctccaattttgctctttttcgattgcttttggttatcttgggtctgttgtatttccatatgaattttgggataagcttgtcaatttctgtaaagaagtcaactgggatgtggatattgtgttgaatctgtagactagttggggaatattgccatcttaacaatgttaagtcttctgttccatgaatatgggatgcctttccatttatttagggctttaatttttttcagcaaatgttttgtagtgttcagagtatacattttacacttctttttgttgaatatattcctaagtattttattctttttgatgttgtaaatagaattttttcattttattttcagtttgctcattgttagtacatagaaatacaactgatttttctatattggttttatatcctgcaaccttgctgaactcattgattagttctaatctttttgtgtgtacgtgtgtggatgctttaggattttctatataaatgttcatgtcatctgcaaatacagatagttttacttcttcctttccaactggatggcttttatttcttttacttatctagaacctctagcacaagctcgaatagacacgaagaatgcacattgctaccttgttcctgattttaggggaaagcactcattcaccagggatgttaactgtggcttttagcagatggctttaccaggcggaggaagtgcccttctattcctagtttattgaatctttttttttttttttatcatgaaggggtgttggatttttctcaaatgcttttcctgagaaataccttattttaaaatgtccccagagtccctgtgcttccttctgagggcaaaaactcaaatgcagaggcaaaacttatgtgccaaatcattgtccaggctctgctgtgttgggctctaacaggtgctagctggtggaacgattgttggtaatgacggcaaaatccctgccccttccagtggccagggctgcctttcccgtctgataagtgacacagcagataaggaggtcgcgctgggggggggggtccctctgccccccccaccacggccgctcactgccgctctgcccccaggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaaggtgggcggccctggggctggggggcggaggaggggacctgttgcggaggtgcgggagggctgggcgcgggagctggggaccagggcggcggggtccaggaggtggagcaggggcgtgtgagttgatatttggatggaggttccaggatgagggtggcgggaccagggcccaggaggggcgagggctggaaggctgggctggggagtagcgggaactgggcggggttcgcggggccagggccggagctgggtggtgaagatgggttggcggcagggcggaagtcgggggttggtgtcctgggtccgggctgggtgggcggtggcgcaagggacctgggactcagggcagggggtgactggggcaggcccgccggactcgctctccattcctgtgtgctccacgccgcccacccacctccgcctccccgccccttcccttgcagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtgagcccaggccaccctcagcgcccacgcccggcacccacctgcgcccggcacccacctgtgcccagagctgtgtccccacattccttgagcctctgccaagccctccctcctggggcattgtcaagaaagatgcaggatgcttggttgcctttgcattccgatgaacaacccataatttttttagtatgtctcaaatattgcttgggatatacttatactcaaatgttatttgttgtttatttgaaattcaaacgtgactggacatcctgtgttttatctgttaaatctgacaaccctatcctctccctcctctttcccctccctcctttccttccttctttcattaaattatgcctcagtttcctcacgtgtgaaatgggcttaataatcatgcctactacacaggtagtatgtggcgcctttagaccagtgcctggcacatattaagttctacgtaaatgttacctttgactataattaataataatcataattattctctagtatatactgattgagcacctactatgtgccaggcaccctgccaagtgatgagcacccagcagtggaccaggctgcctgaccactgccctcacggagggtccattccagtggaacaaaacggaatcagtgtgtgtgcatttgtcacagctaaggctggatccagcagggagatgtgtgggagtcagagaaggtggtaggggcactgaagctgagtgctgaaggatgagaggagctgctcatggaggactgggaacagcattttgggggtgggaacagcatgagtgaggtctgccaaggtgaggccatggggcctagatcttgatgactttagaggctggaatgaggcacctgcaggcattcactgatgggacccagctctgccactttcttgctgagtgacgttgggccacactgtctgtatctgtaaaatcgggacattggcagatcctgccttgctggatcgttttcacgatgataactccaggatagcaatggtagaccattgtacgtgtttttttttttgtttgtttgtttgttttgtttttttttttgtttgtttttttgagagacagtctcgctctgtggcccaggctggagtgcactggcataatcttggctcactgcaacctccgcctccttgttaaaaggattctcttgcctcagattctcacgcctcagattcccgtgtaggtgggattacaggcatgtgccaccacatccggctgatttttgtatttttagtagagatagggtttctccatgttggccaggctattctcaaactcctggcttcaagtgatccacccaccttggccttccaaagtgctgggattacagacatgagccaccgtacccggctccattgccttttctttctacgcctccaactcctcttgggtcctccaggagcttgggctcagggtgttcagatcttctggggaggggcaagcaacagttgttgaaacccctcttagtgtgtgtggtgtttctcagaatgagttctatcaatagctgagtcagcagcacctggggctgcttgcgaaatgcagattcctgggccccaacctggaagtgtctaggggcaggcccaggaatctgcatattttaacagactccttggtaatgtttctgcccacagacgtttgaggaggactaggtctggatccataaaggagctctgccaatgaagttttctttttgcaaacatacagatctataaatgtttattgatatataaggatatgtaatatatctttatatagataacatataatatacaactatttaaaaaatctatatctaaattttatgtgtaatattgatatataatttatttatagattatataaatgatacactgaacaattgtatttattttattattttttttttggagatggagtcttgctctattacccaggctggagtgcagtggcatgatcttggctcactgcaacctccgcctcccaggttcaagcgattctcctgcctcagcctcccgagtagctgggattacaggcacccaccaccatctctggctaatttttggatttttagtagagatggagtttcaccatgttggccaggctcgtctccaagtcctgacctcaaatgattcgcccaccttgggctcccaaagtgctcggattacaggcgtgagccgccatgcccgacctaaacataagtatttctaactaattttctatgtatgtgtataatattgaaagggcagggctgcagatttgagacccacattctcccggcttctcatgagaaggctttttgttccctgacagtttgaactttgcatcgttctctgggtgggggccccttggtcctgctaccccatccagggttgccaggcttgatctgctttccactgcaggctctgcctgggcccaggtcagtgggagagccctaggggagggcagggtgcccccgacattgagtccctggcatgacccctgcctggctttcaggtccaccctgagaatgaagactggacttgcttcgagcagtctgcctcactggacattcggtctttctttggctttgaaaatgccttggagaagatcgccatgaagcagtacaccgccaacgtcaagagggtaagcggtgggttgcgttagttactggaggaaggtgcacacacctgctctgccatcaacagctgcatgacccctggcaagacccttacccttcctgggctcagtgttatctgttaaatgggtactctagtaatgaccaaatcaccacgagataatggatggaaagtaactggtctgtaacaggggcaccctaatcctcgctctggcaccatgagatgtccaggcttatgtggtgaattatctggacaacagataattctgtggtgctttttttttttttttttttttttttagataaaatgatcattgcttgctctaaagacctcagatccatccctgagtaaaaacccgttcttgtgatgaaacagatgaaattaactttaataacaaatttttaaacaatgtgttatcaatataaaacttaattctccgaggttggaggcccagttgagcccaggaatttcagagcagtctaggcaacatagtggactccatctctaaaaaaataaaataaaataaaattaggtgggtgtggtggtgtgtgcctatagtcccagctgctcaggaggctgaggcaggaggatctcttgatcctgggaggttggggctgcagtgcgctgagatgacactactgcactccagcctgggcaacacagcaagacactgtctcaaaaaaaataaacaaaaacaaaaacaacccccaacccaaaaaactgattactgagctattttgcattctttgtttcgtaccaagccttggaaattaggtgggtgttggacactcgcagcttctctccatcccgaccagacacatccagccactcaatagccacgtgtcggggctgggacctgagccggctgggggtgactccctgtggtgatcctgtgacccccctccatcctgccccgtgctcatgtgtcttgggtctctctggcttccaggggaaggaggtgattgagcattacctgaatgagctcatctcccagggtacctcgcacattccgcgctggacgcctgccccagtccgtgaggaggatgcccgcaaccaggctggaccgagggaccccagctccctggaggcccacgggccccgtagcaccctggggcccgctctggaggcggtcagtatggacggtaggtggtacagcccaggccagtcagccctaggaggctgctgcaggtcctcttgctccatggggggccctggggcatgttggggagaattgcctgccgtcccccctgggaatgggtctgggtcttggaacgacaccgcctcctgcctccactgagtgcttttctctctctccatcctggtccaagagcagaactcatttgtttcttttcttttctcttttcttttcttttcttttttgagacggagtccccctatgtctcccaggctggagcgcagtagcacgatctcggctccctgcaacctccgccccccgggttcaagtgattcttctgcctcagcctcccaagtagctgggattacaggcatctgccaccacacccggccaattttttctatttttagcagagatggggtttcaccatgttggtcaggctggtctcaaactcctgagctcaagtgatctgcttgccttggcctcccaaagtgctgggattacaggcgtaagccgttgcacccggcaaaaactcatttatttctagatcaggaattaacctctggtgccttgacattgcctctttctctggttttactatttactaacttagcaattattatgaatttactaattattacgattgctattgctattttaaattatacgagtaatgcatgatcatggtagaaaaaaattcaaactgtaaggaagatgtaagaagtacgattcttttcctctccctaaaggctaacaatagttttgtgtttctatgtcctgaagctgtttaggtgcatatatgcacataaaatgtatatatacccacacacatatgtgtgtacatgcatacatacatgtgtgtcttatgttgaatacgtgagaacatatacattccatttgatattttgcttttttttcacttactaatgttgcctgaaaaactttctgtatcagtgcctatgtcttcttttcatacttcatagtatggtgtggttgcaccataactaatttattaataaatattaattatttatttagagacagggtcttgctctgttgcccagcttggtatgcagtggtgcaatcgtgtctctctgtaaccttgaaatcctgggctcaaacgatcctcctgccccagcttcctgagtagctgggactatataggcacaggccaccatgtctagataatttatttttacttttattttatttttaattaattaattaattatttttgaagtggagtctcactgtgtcacccaggctggagtgcaatggcacgatctcagctcaatgcaacctctgcctcccggcttcaagcaattctcctgcctcagcctcctgagtagctgggattacaggcatgtgccaccacacctgactaatttttaaatctttagtggagacagggtttcaccatgttgaccaggctggtcttgaactcctgacctcaggtgatccacctgccttggcttcccacagtgctggaattacatgtgagccactgcccatggccttgattattttgaattagtctatttagctagttccctattgaaggaaacaaccctatttaggtcgtttcagtttttaaaaatacaaacaacatggtacatgtgagtacttaataatttttttaaaatgtctgtaagtatatacaaagcataacattttaaaagtggaattgctggttcaaagtttacatgcaagtaaaattttggtagatttaaccattaggcttccaatgaggttgtaccaatcattgttcccactgaatgtgtaattgcatctattcctgacttcactccagctccccacaaaagtcttagtaaacatctcaaacttctgaaagggaataaaagtagtcacttgttgattagtgacaagttttttcattatgagcaagatcaggcatgatttttcatgtttagtgactgttttcctttttttttttttttttaataatacatacttgttcttgtcctttgtccattttcttatttgcccattgctttcttattggtttgtaagagctctttgtatatgaaggcaactagccttttgtcacagttcaagcttttatggacatggaaaatgtttacaatataatgttaaaaggaaaaatcctaggatacaaattgtatgtacaccacaaatccagttctagccatgtgtaagatgtgtactcaggttgataatgtttttcctttagggccactgccgtgcagggacttccctaactctgacacacttgggtggcagtgccatggaactaataatacatctggggctctgtttagggagaatgaaattcattcatacaacatgtattattctttttcttttttttttatctgtcacccaggctggagtgcagtggtgtgatctcagctcactgcaacctccgcctcctgggttcaaacgattctcctgcctcagcctcccaaggagctgggactacaggcgtgcaccatcattcccggctaatttttgtatttttagtagagacagggtttcaccatgttggccatgctggtctcgaactcctgacctcaagttatcctcctgccttggtctcccaaagtgctgaaattacatgcaacaagtatttattctgcaccgactgtgtgtgctggttggctgttgttgtatgtgcacattttttttttttttataacagcgcccgctcctgccccctcctgtgcacgctctctgtggcctggtcccctgtaccttccccattttgcacaggtcgctccttccttctccatctgtgctgtccgccagcagcacaggcactcagggtggcgggcagaggacatcctcatgccccttctgccctctcctgaatcactgagtctttgtgctcagaagtagaaaaagccttcacatctgcccggggccggaaggatgctgggagctccggcctctctcgtttttctccctcatcccatcctcactccctccctgattccagcatctctgcctctgaccacacaaggtctggacaattcgccctctgccaacattctcccacctctgtttacctagatggctcctggcacagcagttggcgtgaccccccactgtgggcttttctgttttgggggtgctgctggccgttcattcagcctgttttcttatttagccatctgtctacaaagaactggctctgcccacggaggctgctgctttgtgtgacgtctccgcccactgctgagatgccacgaggcctctgcacgccagcatctgccaccctcatggctaagagtgggggaacaggactcaagcttggggcctggcctctgcacactggcaacattccgactacaaccgcccagttgtgggggacaaggctgcacagtgggaatgttccctgtggttcccaggctgctaaagagagcatggctgtgttgcaaggtccaggctctgttaaaagctgctgtctgtcaaaaccccacaatggggcctggggatggggcaaagcaaagagaactggtgtttatcagccacctcctttgtgctgggtgcacaacatgcatttactcattcgagttactccacctctctaggcctcagttttatcttctctctctctctcttttttttttttttttttttaagacggagtctcactctgttgcccaggctggagtgcagtggtgcaatcttggctcactgcaacctccatctcccaggttcaagcgattctcctgactcagcctcctgagtagctgggattacaggtgtgtgccaccacgcctggctaatttttgtattttaatagagactgggtttcaccatgttggccaggctggtcccaaaatcctgacttcaagtgatctgcctgccgtgggctcccaaagtcctgggattacagtcgtgagccaccactcacagcagttttatcttctctaaagtggggataatagtgacgcctgcctcacaggggtgtggagagagctcagtgagaccaggtggcttctgagaaggtagtgagtgtaagcccatattgttaagaatccttagaacatccccagagggtgggaattatcttcaattcccagggtcaaagaggagaaatcccatctcacagtgagatccaggtttgcctgatgatgcgttttcagaacccccttggacatgggctggagaaatgaatgcattcagagtccggtggctgctgtctggggcgggggcttagcctggtttggaaccacgttttagagtcagtgaggcagccagtaaggaatggcacacagaccacatggtaaagagacgcagcgtctccctcttgtcctgaagctcccccttctcctccaaggggacaagctggatgcggactacattgagaggtgcctgggccacctcacgcccatgcaggagagctgcctgatccagcttcggcactggttacaggagacccacaaaggcaaggtgggtgcagggggtaccctggagcagtggatgaatgggcaatgactggtactcagcctccgtgcatgggaaggaaaggcgagatgataatgctgacacattatctcttgcttatttatttatttattcatttatttctgtgagacaaagtctcactctgtcccccaggcagtggtgtgatcctcactgcaaccttcgcctcctgggttcaagcaattctcctgccctagcctcctgagtagctggggttacaggcgcacaccaccacgcctggctaatttctgtactttttgtagagatggggtctcaccatgttgccccggctggttctgtaattttatctgctgggtcaggggataccgttctgtgggctttttacttctttgtctctcagattcccaaagatgagcacatccttcggttcctgcgggctcatgacttccacctggacaaggcccgggaaatgctgcgccagtccttgagctggcgcaagcagcaccaggtggatctcctccttcagacctggcaaccccctgccctgctggaggagttctatgcagggggctggcattaccaggacataggtgcgtgcctccacccacatcatgtatagggcatactttggtcactgccaaatgcactttatttattattttgagatggggtctcactctgtcacccaggctggagtgcagtggtgccatctcggctcaccataatctccgcttcccgggttcaagcaattctcctgcctcagcctccccagcagctgggattacaggcacccgccaccacagctggctaattttttgtatttttagtagagatgaggttttgccattttgaccaggctggtcccaaattcctaatctcaagtgatctacctgccttagactcccaaagtgttgggattacaggcatgagccaccgcacccggcccaaatgccctttaaatgccatgcttcatgctaacatcttactatttttccttttgactcttccaggcatctagaaatgctttgaagtgacaacctagctaggaagaaccagagctggaaggctttggggcttgaggaggagacatttctccactgggctgagtgagcccacaattactcacaataattgtgatcgtaaaggtaacaggtgcatacattttgtatgcatttccaagggcagttgtagcaaattggcacaatcttggtggcttaaaacagtagaaatgtgttctttcacagttctcgaggccagaagtctggagtcaaggcgtcaccagggccgtgctccctctgaaagttctaggggagaatccttgcctgctttttccagcttctggtggacccaggtgttccttggctggtggcagcttcactccagtctctgcctctctcttcacatggccttcccctctgtgtttctgtgtcctcgcctcttctcataaggaccccaggagattggatttagggctcaccccaaatccagtgtgattttatcttgagatccttaactaattaactaattacacctgcacagactctagttcttttttttttttttttttgagacagagtctggctctgtcacccaggctggagtgcaatggtgtgatctcagctcactgcaactccgccccccgccaggttcaagcgattctcctgcgtcagcctcctgagtagctgggactacaggcgtgcaccaccatgcttggctaatttttgtacttttagtagagatggggtttcaccatgttggccaggctgttcttggaactcctgacctcaagtgatccgcccgccttggcctcctgaagtgctgggattacaggagtgagccactgcacccaggcatgggtcacattttaatgtccccatggatatgagttttgggacacgattccacccattacaaatatcttttctggatttttaagttaaattgccactgaagcctgtgcctacgacactttccaatgtcctttatctaaacgttcatctagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaataaacgttcatctatatcaagtagggtaaacgcttgactctcctaaagaaccggctggcatggtttctcttaacgatcaatcttcctaatttatggaatccaaatttatgaactccccttattgctgaaatttacttgtaacccccaaatcagtattcacagaactttttcagtcatgctgagacatattcagagtggcgaagtattggagtcgcccatcacgcatgctgtctgctgaagttgaatgacgcggctcctgcctttttgtttcagttctcataccctaaacgagtgtcctttttgtggcctatttaatgccacattgttgcatttttgggcttttctttggtgactttgctgtttaaaatgcctcttcgtgtagtgcagaattgcgcctagctttcctaaggatgagcaagtggccacgtgctccatgcagaaaacacccaaagtgctccactagcttcaggcaggcaccagctacagggctgctggccgtgagttcaatgctgacagatcagcaatatgcattcaagtgtccttaaacagaaacacaagccgggcgcagtggctcacacctgtaatcagagctctctgggaagccaaagctggaggatcgcttaagcccaggagttcgagaccagcctgggcaacatagtgagctcgcccccctccaccacatctccacaaaaaatacaaaaaaattatctgggcatggtgctgcatgcctgtggtcccagctacttgggaggctgaggtgggaggattgtttaagctggggaggttcaggctgcagtgagtcgagatcatgccactgcactccagcctgggtgacagagtgaaaccctgcctcaaagaacaaagaggccaggcatggtgggctcacgtctgtaatcccagcattttggaaggccgaggcggcagatcacttgaggccaggggttcgagaccagcctggccaacattgtgaaaccctgtctctactaaaaataccaaaaattagccaagcgtggtggtgcatgccggtagtcccagctacctgggaggccgaggtgtgagaatcgcttgaacctgggaggcagaggttgcagtgagctgagattgctccactgaactccagcctgggtgatacagtgagactctgtctcaaaaaccaacaaatcaaccaactaacaaaccaacagacaaaaaacaccacataaaacaaggttatatattgattggttgacaaaaagtattatggggccagctgcggtggctcatgcctgtgatcccaacactttgggaggctgaggtgggtgtacacctgaggtcaggagtttgagaccagcctggccaagatggtgaaaccccatttctactaaaaatacgaaaattagccgggtgcggtggtgggcgcctgtaatcccagctactcgggaggctgaggcaggaaaattgcttgaacctgggaggccgaggttacagtgagccgagatcgcaccactgcactccagcctgggtgacagagcaagactctgtctcaaataaatacataaataaaaatgttttgtagagaagaggtctcattatgttgcccaggctggtctcaaaactcctgtgttcaagcaatcctcctgcctctgccccccaaaatgctggggtaataggtgtgagccactgtgctggcccttatcctcattgtaacacttctgtttttctgcctttcacaataaggggcgtcagcccctcttggaagcaggcagggtgttagtaagtgaaggctggatcgggccttggtgggttgcagcctgaggaggtgaagctctcacctgcagctgtgacctgcccctcggaagcagtcctctaaataacgggctcttctttctgcttggccccatccacaaagatggccgccccctctacatcctccgcctgggccagatggacaccaaaggcttgatgaaggccgtgggggaggaggcgctgctgcggcatgtgagtcaggggcctcgttcctggacgccgtgcctggggccgggcctgggaaggactgtgtggggtaaagcagcgaggcggacgttgagcagcactgtctctcccttccaggttctctccgtcaacgaggaaggacagaagcggtgtgaggggagcacaaggcagctgggccgtcccatcaggcaaacacctgggctgggcacaaatcccccctaaacagcaaagacggagggtggagaggggtccactgtgcatatgtgctgggctgggcagcgtgccaggggcttcattctcccccagtttctacagtggtcttctgggccttgaggcagggcccgtaagcatccccgttttctatgcatggggaaactgagattcagaatggtggcccccatcgaagcttgtgagccggtcaggacagagctggatttgaacctggggtcctgtctggcttctagctcgaagactttatcctcccactccactcaacagtctccttgactttgctttttttttttttttttttcttttttgaaacggagtctcgctctgtcgcccaggctggagtgcagcggtgcaatctcagttcactgcaagctctgccttccgggttcaagcgattctcctgcctcagcctccagagtagctgggactacaggcacccgccaccacgcctgactaatttttttgtatttttagtagagacagggtttcactgtgttagccagaatggtctcggtctcctgacctcgtgatccgcctgcctcggcctcccaaagtgctgggattacaggcgtgagccaccactcacagcctgactttgctttttgagatcagctctccaccacgagttctcccttggctctgtcatggcacatccaggaacccagtgtcctctgcaggaacccactgtcctctgactcccccgcatttctgttcctgaactgtttcccggagccagtacttacggtggcatcgcccccaaaggcagcaaacctttctgagcagcagcttcctcttctgtaaagtggcttttttttttcctttgagacaggctctcactctgtcacccaagctggagtgcagtggtgcaatcacagctcactgcggccttgacctgctgggctcaagcagtcctcccacctcagcctcccaagcagcggggactataaatgtgcaccaccttgcccagctaatttttttttttgcagagatgaggtctcaccctgttgctcaggctggtctaaaactcctgggctgaagtgatcctcccaccttggccttccaaagggttgggattacaggcgtcagcctctgttcccagcctgtaaagtggcttttacaaatggattctcaaaaataataagggtttaaaaataatgcaaacacggatcttgcacttgctatgtagcaggtgcccttctaagcaccttgattcatttcctcctcctaaacagccctgtgagacacgggcaggcaggagctgctgcttcagcttttcagccccaaatatcccgatctttgtgaaaattaaagttcctttgctgtttgcagattttttttttttttttttgacagagtctcgttctgtcgcccaggctggagtacagtggtgcaatcttggctcactccaacctccacctcctgggttcaagtgattctcgtgcctcagcctcccaggtagctgggattacaggtgcctgccaccacgcctggctaatttttgtatttttagtagagatggggtttcaccatgttggccaggctggtctctagagattttctaaggacacgtatgttggggtggaagtgggaatcaatccattagtgtcctggccggaagcataattcaccccagatggctcaaatgagggagtgtcatgaagggatgctttggagaggtgtgtgcaggtttaagcgaacaaatctgggaggtggaggctcccgggcaccagccgctgcagtcaaacagttattttcctaatgaatgaatactaatgaaatggaggcacagagaggttcaggacttgaccaagatcacacagcaagtggcagaactgggatttgaaccttggccatctgactgtggagtgcatgctctcagcacctctgctctatttagtagttagcatcttttcaacaattaactcatttatgcctgaggttgcaatgttttgaatttttgcaatcagaccttggtgatgaccttgagcagtaggatagaaataactcccacacgcttagcattgcaataatggaatgctaggcctaaatggccacttgtgataaccagctataattgagggcatgtggtgtgcccgtccttgcagagagctttgtatataccatctcacttgatcctaacagcagttgcttcagatgaggactgttactacctttgccactgtcctatgagtaagtgggtctgtgccctgacctaaggctctcaggggtgcaggtgagacttgaatttgggcgctcagccctgaagtccacagtctgatcctcttcatcgcatgggctccctactgtggcaggagcccccatctgctcccagccctatctctcggagcctccctgttcatcccctgtggggagggtgttggtggccttgggaggcagcagagccaggtggagctggggctatttctgccacagctcctggacctgcctgctagacctggagggactcaacatgcggcacctgtggcggccgggggtgaaggccctgctgcggatgattgaggtggttgaggacaattacccagagaccctgggtcggctgctcatcgtgcgagccccccgagtcttccccgtgctctggacactggtaagagctggagcctgggccaggactctccctgggggtgggtgggatgggaggggttccgtctgcaagcagctctgctctcttttcctgtttcatttcatttagtaactttttggagatgaaactcacatagcataaagctcacactttttaagtatagactccagtggtctttcctgtattcactgagttaagcaattgtcaccactagccaatcccagaacatttctgtcgccccaaaaagaacccccatgcccattatcgtgggtctcaaattcctgggctcaagcggtcctcttgccttggcttcccaaagtgtttgtgttataggtgtgagccactgcgcctgacctgaaatatactctatattgtaacccggtgggtacacgcgtgcatgcacccatgtgcgcgcacacatacacccacgcccacacacacactcctctgaaacaagggtgcagccagccacttgcatagtgtgggcaaaagcctggaggctggacccagcttgatgctttggaggaactgaagaaacagtccagggtggctgagcaaaaaagagcaaaagggacgacagcacctgaggaggctggaagatgtacaggggcaatagggacccatggagggttcagtagcaggggagggtgggggacagacttaggggccaggaagttctctagcttttgtgggtgcttcaaggctctgttcaggtgaggctagggggcaggagctgcttctgaagctttttatcctgaattgtcctaatctccgggaaaattaagtccacctgctgtttggggtggttttgggagtgcgagcacatcagccggggtcctggctggaagtggacctcacccagatggttcaaatgaggggtgtcctgaaggggctccttgcagaggtgtgggcaggggaaggagagaccccaagcaccagtgactgcagtaagcctggccacccccaagaggagggaatgtccttgcagaatcctggggaaagctgggacaggggtgggggcagggagctactgggggtcagcctcagcctcctggggcccagcacagcacagagcgcagtggggctggggacaggagagggccctgcacggggggattgcagtttcctcacctatctcttggcttgtggcattccctgtagaactggcctgttatctgccatgccaagggctccttccttctttctctctctcccacttccttccttctttatcaacatgtggcttagagctcagtgttaaaatggattccatctggaataaacaaactgtggaatactgttccatccatgtaatggaatagcattcgtccataagaaggaaggaagcactgatcctccaacacggagggacctcgaaaacctgatgctcagtgaaaggggccagacacggaagtccatgtactgtgtgatctcctttatatgaaatgtgcagaatagggctgggcgaggtggctcacgcctgtaatcccagtactttgagaggccgaggtgggtggatcacctgaggtcaggagttcaagaccagcctggccaacatggtgaaaatacaaaagtacaaaattaaaatacaaaaattagccaggcatggtggtgggagcctgtaatcccagctacttgggaggctgaggcaggagaatcacttgaacctgggaggtgcagcttgcagtgagccaagattgcgccattgcactcaagcctgggagacagagcgagactctgtctccgaaacaaaaacaaaaaagaaacgcccagaataggcaaatccacagagacagagtgtagatgggtggttgccctgggttgggggaggggagatgggaagtgacggtggggtgggaatggggtttccttctggggtgatgaacatgtctaggtagaggtgctggctgcacaagctagtgagtgcactgaaagccactgaactgtgcactttataatgattaattctatgttgtataaattatatctcaataaaaaaatacatccatggtcaggcgtggtggctcacacctgtaatcccagcactttgggaggccgaggcaggtggatcacgaggtcaggagatcgagaccatcctggctaacatggtgaaaccccgtctgtactaaaaatacaaaaaaaaattagccgggcatggtggtgggtgcctgtagtcccagctactcgggaggctgaggcaggaggatggcgtgaacccgggaggtggagcttgcagtgagccaagatcatgccactgcactccagcctgggcgactgagcaagactccgtctcaaaaaaaaaaaaaaaaaaaccatccatcttgccttatgtcctggtttcagatcagccccttcatcaatgagaacaccaggcggaagttcctcatctacagtggcagcaactaccagggacccggaggccttgtggactatctggatagagaagtgatccctgacttccttgggggagagagtgtggtgaggcttccatgtccacagacagacctgggcttgaggagggggcatgcctagctgggaggctgggattcccggagtggggctgggaggtggaggggggctgggtgcggcatgtgcactctgcctagggcaggtcttgctggctctcagcagccacagggcttgctttagaagctgcttcaaagagaggtgatgctgttctgaggttgggccttactctgggtccttcaaacatagtgagtgagatagaagtttctggaagcctaaagattaggccagtcaaaggcttacgcattctatattcccatcaaagacattgccaagcagcagtgagttaacctgctcattcactgcaggggaggtgactcgaatgtatctgcagctctggaccctggagctgggactagcctccaacccacagccacacagcctgaaacgatcaggaacccccttcaagggaggcagtgtccaggccccttttattgcctcccctggggtgaaatgacaggctggggtgatcctaggtcacaactctgtcatctcatatggcccccagtggcccgggccctctttgtttctaacagaaataccagacagtgagcttgcgtcatttctggattttaaaaaagtcttttcctaggaatttttccaggcttgcctgttctctccgtttgtgatgtgcggcacacacgacttatttttagcaaacggttctgcagatctgagagtggcttatggaaagacactgaacagtgtcctgctaatcccagtgtttctacaagtgaaacggggtgggggtaatcattgtttggtggtggcagggggagttctgccaaggcctggccatctagggtgcctttggtttggggaaatctctcgatgagcacggtgcagtgactgttccacccccgcctgtgacggggagaggcagctgctatggggtgcggtgtggagaggccccccagcctggctgtcagtccggcaccggggtaaagggacatgagcatggggctgtgacgaacgtgggtttgtgccctggctcactcactttctgctgtgtgatcgtgggcgagtggcctgacttgcccgagcctccattccttcctctgtgaaacgggaagaataatagtctctactgcattggtggacctggggattaaatggggtcatggaagcccacagcccattcagtaaggggttgcaattatgagtggctttgggggtcacacatcacccttctgtgggtcaggccagccaggcctcaactggccctgacctgctgccctttatctctgacctgcagtgtaatgtccccgaaggagggctggtccccaagtccctctacatgacagaagaggagcaggagcacacggaccagctgtggcagtggagtgagacctaccattcagccagcgtgctccgcggagccccccacgaggtgccagggcctggccggggagggcccgctgagctggagtgtctgtcgtcttaggtcaggtgaccccaaaacacagcttgagatgaggattcttttttcttttctttctttctttctttctttttttttttttttttgggatggagtctcgctctgttgcccaggctggagtgcagtggtgcaatcttggctcactgcaacctccacctcccaggttcaagcaattctcatgcctcagcctcccgagtagctgggattatagacatatgccactgcgtccagctaatttttgtatttttagtagagacgggttttcgtcatgttggtcaggctggtcttgaaatcctgaggtcaggtgatccgcccgcctaggcctcccaaagttctgggattataggcgggagccacggcgcctggcctcttttttttttttttttttgagaccgagtctcactctgtcaccaaggctggagtgcagtggcgcaatgttggctcactgcaacttctgcctcccaggttcaagtgattcttctgcctcagcctcccgagtagctgggattacaggtgccagccagcatgcctggctattttttttttgtttgtatttttagtagagatggggtttcaccatgttggccagactggtctcgaactcctgacctcaagtgatccacccacctcggcctcccaaagtgttgggattataggcatgagccaccaagcctggccgagataaggattcttatgccagtgatctgttgcaggcgaggtctcaggagaaaactgaggagaggagggcactcctgtaaggaatgagcgtgtgcctgggaaaggagaccccagggggcacccacagcccctcctgccactgtgttccccaccccagctctactctctcggccgtgactctcagacctcgcctgtctccacacaggtggccgtggagatcctggaaggagagtcggtcatcacctgggactttgacatcctgcgaggggacgtggtgttcagcctgtaccacaccaagcaggcgcccaggctgggcgcccgggaaccggggaccagggccagcgggcagctgatcgacaaaggctgggtcctgggcagggattacagccgtgtggaggctccccttgtctgccgggagggggagagcatccaggtttgcattttctggaccactcattcgctcaccaagcagcactgagtgtccactgcgtgccaggcttctggggatacagcggaggacatactgggctgctggtccccagcctcagggaccctgcaggacagggcagaggaaagacacacagggtctcatgtaatgaagtgctcacctgcccaatggcagccggtgcaaaatcgagaaagcacggggtgctctgctgagaggtggctggtgtcttggggaggagcacagggtctggaacctgagtttccccatctgggaaatgggacttctaacaggatccaactgtatttgtttcttggggctgcagtaatgagttaccacaaactacatggcctaaaacaacaaaaatttattgtctcacagttcaggagttcacaagtccaaaaccaaggtgttggcagggccacgctccctctgaaggctgtagggaggggttcattctatgcctctgtcctagccttaggtaactcctggcaatcctgggtgtcattggtgggtagatgcatcaccccaatctctgcctctgtctttaaaggggtttcttctctgtctgtctctcttctgagtctcaaatctccctcccctctctcctgtaaggacactagccatcacagttaggccccatcttaaatcctgtttttttttgagacagggtctcactctatccatgatcaggaaacttttgcgggactgggaatgtagtgatatgatcacagctcactacagcctctacctcctaggctcaagcgatcctcccatctcagccttctgagtagctgggactacaggttcccgccaccatgtccaactaacttttgtattttttgtagagatggggtcttgctatgttgcccaggatgatcttgaatgcctgagctcaagcgatcctcctgcttcagcctcccaaagtgctgggattagaggcgtgagccaccatggctggcctcaccctaaatccttaaccacaaagactctatttccagataaggtcacgttctgaggttctggctggacatgaattttgggggtacactgttcaacccactgcattaactcaagcagggggaaggatgagcatattggaatttgaagttcaggttgcctgcatacattcaagtggcttcagtatggacgaagaccttgagttgtggctggatctgggagggggtgagaggggatgatgttccaggtggaaggaacagaaagaacaaaattgaagccgcagggagaaggcaggtggacacgagggtagcttgagtgctggggaggggttggaagttagtttggatagaaggggaggtgctaaggtcctgaggtcagtagtcagatttctgatgtgcactgtggtttcagaactgatgcaaaagaaactgtaggtcttgggccgggtgcggtggctcatgcctataatcccagcactctgggaggccgaggcaggtgaatcatctgaagtcaggagttcgagaccagcctggccaacatggtgaaactccgtctctactaaaaatacaaaaaaaaaaaaaaaaaaaaaaaaaaaaagcgaggtgtggtggcgggtgcctgtaatcccagctactcgggaggctaaggcaggagaatcgcttgaacctaggaggcagaggttgcagtgagctgagatcatgccattatactctagtctgagtgaaagagtgaaactccgtctcagaaaaaaaaaacaaaactgtagtcttggaacagaacttgaacgtgtaactggaatatgagctgcccctgttgatccccacattctccaggaggctggcattgcaggtggaatgtcactctctgactcccgaaatgacacatgcacacacgcagcaccagctccacgagcactggcagttgctgtcgatctcaccgaagttcccggtggggagagggtggagggccgtcctgcatgtccctcacagccactgctgggtcccactgaacttctcaacccagagcaacccaaagtggctcttcttgtaaaaacaaacacttccctttctcactctccctgatccctccacaaattctctctaagcacctgtgagctcccggcccaaatccctttcctaatccccttggtttgcaaatcccactcagcagagcaaaagccccacaaaatccaggtgtttaagcacctctgttgtcctgaagttgcacccccacccccaggcgtcagctcctccccagattaagagggaggctctggtcccagggatatggggataatagcaaggatggcttccagaggccctgacaggaggagttgctggtggactggagaaagggacagagggagaagagccccaatttccaggcctggtgatgagaagcccatgaaggctcagcctccttgacctgtcctctggagggcgcagggcctcagggcagggctgatgtgtttcagggctcccatgtgacccggtggcccggcgtctacctgctccagtggcaaatgcacagcccccccagcagcgtggcctgcagcctcccgggtgtggacgatgtcctgacggctctgcacagccccgggcccaagtgcaaacttctctactactgtgaggtgctcgcctctgaggacttcaggtaggagggctccggagcggggtcctgggcaggaaggaccctggggctgattgacaatgcagatgcctggcctcctgtctcccagctgggtcagcttctcccggggtgggaccccagcatgggtatggttggagttctcaggtgacacagccccgcactagggtgtgaggagagcccagctctgcgcgtctaactctgcttccgaagcagggattttccttcaaatgaaaccttgggcagaagctcaactttttggagcagttggaggggaggagaaggggagtcttaaacccttccatgtgggcttcccctcactcctagaattccatgggaatattttagaatattctaaaagggtgctttttagacaaccctccccaagttgttgctttcagagagacagggaactgtaatggttaagacctccagcacttcctggttgctgtgtgacctcgggcaaatcacttttcctctttgagcctcaggtgcttcatcccttaaatgggaaccactggagccccagtcttgtgggtttgtcatgaggatgagatggctgggggaagctgcctgtcacctgggcatgcggtgtgcatgccacagcagaaatgaaggagaaggtctggaggcggagcaggcagtttcttcaaggttttgcattctgtaaaagcacttatgattttgcaccctgcttcatgatggatctgcactggttttcatctaaaaatgatgctttaaattctttcccgtgggggtaaaattaaggctcaaggaaggtgctgagtctagacctcaaattccaggtggagctccaaggatcccaggagcatgggcacccagagtgaagaacactggggcagagtctttatccaaggaggggtcccatagtttgtcagggggctggcgattcactctttgtgaagctgcatgttttggccatcggtcctcagtgtgaggcgacaggctgaggcccagggggacacagaggaatagacacaggcattggaaggttgtctctgggagggctgattctgaggccgggcatgtggaggccagaggggtgggctgggccagacgctgcacaccaacctgtcaagggtggtcaccatgagaggaccttactgccctgtcctcttgtagcctcatgagaaaatcagttcaaaggctgtttcctggtcgccctcagggggcaggtggtggctcggatcgtggggggaccacacagatagggtctgccatcatgaagcagagaccaaaggctcacacccaagtataactatgggcagcgatggatgccatggccaaggccactgtgttagtccgtttccacactgtgagaaagaactacctgaggccgggtgtggtggctcacgcctgtaatcccagcactttgggaagccgaggtgggtggatcatctgtggtcaagagtttgagaccagcctagccaacatggcgaaaccccgtctttactaaaaatacaaaaattagccgggcatgcctataatcccagctactcaggaggctgaagcaggagaatgccttgaacccaggaggtggagattgcagtgagctgagatcgcgccactgcacttcagccttggcgacagagcgagactgtctcaaaaagaaaaaggaaaaaaaaaaaacctacctgagactgggtaatttataaagaaaggaggtttaattgactcacggttctgcatgactggggaagcctcaggaaacttactatcatggcggaaggcaaagggtcaggagagagagagagcagaggaagccacacacttttacaccatcagacctcatgagaactcattcactatcgcaagaagaccatgggggaaactgcccccatgatccaatcacctcccaccagatccctccctcaacacttggggattacaatttgagatgagatttacttgggccatagagccaaaccgtatcagccacccagccaggaggtgctcagggacgtaacctagagccttgccagagcacaggacgggcctggcctagggttgggagagagggtgggggaagtaatatggaacgtgacactggactgagatctaagtagtgtggtggtcacacaagtcaccagggggtctttttatttatttatttttggagacagagtctcgctctgttacccaggctggagtgcagtggtgcaatcctagcttactgtagccttgaactcccgggctcaagcaatcctccaacctcagcttcccaagtagctgggactataggcatgggctagcttgcctggctttttttttttttttttttttttttggagacagggtttcactctgtcacccaggctggagtacagtggcacgatatctactcactgcaacctccgcctcctgggttcaagcaatcctcatgcctcagcctcctgagtagctgggattacaggtgcgtaccaccacccctggctaatttttatatttttagtggagacaggtttcgccatgttagccaggctggtgtcgaactcctggcctcaagcaatccacccacttcggcctcccaaagggctgggattacaggcatgagccactgtgcctggccacttttaaaattttttgtagagatggggtctcactattttgcccaggctggtctcaaactcctggcctcaagcgatccccctgcctcagcctttcaaagtgttgggatgacaggcgtaagccatggcacctggcgaggttctgcatctctaacaagctccgggcactgctggtgctgccagttcccagaccatgctttgagtagcaaggccctaaagctgcactgtcctatctggtcgctgctagtcacctgcagcaatttaacttagcaaggagaatgaaataaaaggaacaattcagtgcctcagtcgcatgggccacatttcaagtgatgagcagcccatgtggccagtggctggtgtgttggactgtgcaggtgtacagcacgttcatcgcaggaagttcttggagggtgggcatggtgcctcacgcctgtaatccaagtgctttgggaggccgagtcacgaggatctcctgatcccaggagtttgagaccagcctgggcagcatagtgagagccccgtctctatacaagaaaagaaagttctcgaggatggcgctgccctgaggtttggagtaggagttaaccagacagctgggggaggagagaatgggcttctgcctcaggctcagcgcacacgaaggccactgcaagagctaggaggaggaccatggaatttgagtgcaaagagtaaggagggagtgagactggagacagggccggggactccctgggctgtggcggccttagggccatgcaagggcctcaggccaggggagcccctgatgggtctgtggcaggctgggctccatctggggagatgggagtgtggggaattcggtagtgcttttctcttcatggcgtcacttgcttttccctttgcatcggcctggggccctggggcctgatttgcagcatcaacagcttttccactgctgtgtgtcagcccaagggccttgtcactgtgagagggtaacgtgtgccacgcccttcctccccaggggctccatgtccagcctggaatcctgcaccagcggcttctcccagctcagcgccgccacctcgtcctcctcctccggccagtctcatagcagctccctggtctccagatagccgggcccagtgtttcagggccgcccgctcgcctccagtgtccagaaatgtccagaatgagaagccagctaactgcagggcctgggaccatgtgggctggagccccaggcctagatgctgcccaagttggggtgtctggagcggatggcaaggatccagaactggcctgtgggtggtgtcagggctcttgaaattgcaaggacagaaccatctccttccggcttcgtgtaaggaagaccaagccaaggccaaggtgtctaccataccacacctttgggacatccgggcttagcgacgtcagccaggcccatctcctctctgtccacctcttgctctgctttcgccatgcaggggaccatcactatcaggtgcccttctcctccctgcagcttgcctgcataagagagcctcttcctcccaaaggctccagcccacttcccagagctgagtcttagcctggaagggggagcgattgccaggtcaattcctgaaccaatcacagttgccaggcacactggagaatgctgattggccagcagggtcatgcccaatctggaccaatcaccgtgatccagggttgcagtgaggtgcagtgattggccagcctggatcacatgcacatctctggaaccaaccacctgctctcaaaagcactagtgggtgcctcgaggagtactggggtcccccctaagaagaaggaggaaggatgctggggaggcagaaatgaagggtgtttaccttggcatctgattgcataacgttctgttatgcagtatcaagatgtgcttggtgagcagttaagtgagttacaggcgctgctctttgtggggaacagcacatcctgaagtgaaaatccatgttccctgcacttggccagcatggcctaagcctgaccatccctgattggagagggtgggagagccctgggtttctgctaagttccaggcagtgatggggtgactgaggctgtctgtataccccactggagatgcctttctctcctagggaactgtttaattatgactgtttttggttgtaagccacagagacccatgcccaggtgcttcaacacaaaagcatgatcattcatgggtgcatagaactggccagtccaggagggcttgcttcaggtaaggctagatccagggtctcaacatggagtctcgattccccccgcgagtggaggctgctgtgtttgccctggggcagatatgactctggaactaggttcaatattgacatgagttcccctagttactacacaggagcgtcttgggtctccttggggcctgaggacatttctcctttcctttcctggactccccaaaaggcagccagtcaggggtcaccaacttgaagcctgatctggcctgcttttagtgttgcttttttgcctttagaatggtttaaaaattgaggcatttcgcatcgaaatcaggatttctggcttcccttaggcatttgggagcaccagcagaatggggtcactattgttgcatgaagacaacacctctgcacccctggatgtggccacgccagtccctaccccattgacttgcgcccagcccacattacacatcctcatgacctgcgtggcaggagtctcactgacatggctctgtcagcagtggctggtacccttgtctcctggccttgcttagagttggggctcatctctgctgcagtaactgagccaaggggtggttttgtggccacaagaatcatctttatgcaggctcagcaatgcagggccaggaaacttatatctacgccagcctcaaccccaaacccaaggaagagagaaagtgtcatcttttcagatacatccttcttcctgctgggagagagccttgcccaccttcctgttggctctctgtccgcttctcaggtatctgaacaaaatagattgctttgcactctgcgtcaaggtgtgtgtgcacatgtgtgcataagagaccgactgattggaaggagacgttctcaaaactaattgctcccatatcaccaggcatttattgctgagagcaacttgcaatattttcaactatctttaagtgaatttctagcttttctcttaaaaactaggtgttatcctacaagtatgctgggataagctgccctggcagtctttatacatttattgtctagccccagagaaggacacagaagccttttacggaaggaagctggaactgcctgttccagaggcgggtggggggaggggagtctgctatcagctgtccacccttaacagtgggggtgaggaacctcaggccctttcagttctgctcttgagagtgctctctccctagggaaaaccagcccaaactggcttaagcaacaaagcaaattccctgggtcctgtactagggatggctgaaggtgggtgctgcttcagatatggctggatccaggagcttaatgtcctcaggcctctcaactgcacccaggcctcttgactctgcatctctttgcatgctgacctcattctttcttccacctggcgggaaagatggctgccagcagccccaagcctataatttcaggattcacactctaagagatgcttttccatctcaaatctcatggaaggctctgattggcccagctcgagtcacatgcttattcctgtgggccacactggcaaggaactagggtcccgtgattgacattccctgcagaagccgcagcaggattggggagggccattcccccaatggacaagagaagctggaccacagaaccagcaggtatccatggtggcatctgctacggccggctctcctcccatgtggaggtctcggggacccacgtggaagcattatcaaggtcattcttcttgccttcgggaggactggaattaaaaataatccaaggaagggattgccaagcttttggcttttgaatttcccctgagccacaaaggctggaagtgccttggcttgggcttcttgcatcattagttcattaatccattgtgaccaggacagaagcaacccacaagcagcattactgttggtgtttgggcacctgggccttgaatttaggccaggactcaaaccccagccttcctttcactagctgtgtaaccttgaccaggtgacttaacctctctgtgcctcagtttcctcatctgtaaagtgaggatagcagtgcctacctcaataggttgtagtgggacgaaatgagggagtagctgtaaagctttcagcacagctcccagaacacagaaagcgctccattaatgtcagtggtcattctgattacttaatgcttcgcatccaaagactcgttttcttcctgaggtcgcctatccctgtttttcgttattgcacccagagaaaagtaggtgtcaagaattattgccctctgagttgggtgtgcagtctttctcttttagaaactgcttgtgtgggcggggcgtggtggctcatgcctataatcccaacactttgggaggctgaggccggctgatcgcttgagtgcaggagttcaagaccagcctgggcaacatagtgagaccctgtctctacaaaaaattaaaaaatgagccaggcgtggtggtgcgtgcctatagtctcagctgctcgggaggctgaggcagaaggattgcttggaggtcaaggctggagtgagccatgatctcacccctgtacttcatcctgggtgacaaagcaagaccctgtctcaaaaaaagaagaaagaagctgcttgtgttttctgggtaagtccacccatctgagggagtgtattctgagtggtatttcccttggcagttagaaaatgttttttcccagaggttgaagtatggagagtttgagactctttttttctaccctgcactctctggaattccccctccctgctgtaaaatttattgtccaatgagaatagtataattgttttcaacaaagtctctttgagccagtgaaacacgatgggtttttttgtttgcctgatcacttgctccaaccagcagcattaaatgttttccatttggataaacttgcatcgtcagcttcctaaaaccctggaggtttcccgtgggctcgttcaagaactttccagctgttgtttaaaagactttagagctagcttgttcagcctgtggcctgcaggctgcacgcggccccggactgctttgaatgtgctccaacacgagttcgtaaactttcttaaaatactgaggttttttgtgtgtgtgttttctttgttttttcagctcatcagctatcattagtgtattttatgtgtggcccaagacaattcttcttgttccaatgtggtccagggaagccaaaagattggacacccttgctttagagcatttgcaaccggagtgatatcacccccaaggggctgcatatctgtttaatgcaggtataattgtgtatcatatatattgtatacatatgtaatggattggatagcatgtccccaaattcatgtccacctagaaccttagaatgtgacctcatttggaaataaggtttttgcaggtgtaattagttaaggttctcaagattggttattgggccgtgtgagggaggatcacaatttttatatataaagcagaaataggccaggcgcagtggctcacgcctgtaatcccagcactttgggaggccgaggcgggtggatcacaaggtcaggagattgagaccatctggctaacatggtgaaaccccgtctctactaaaaaatacaaaaaattagccgggcatggtggcgggcgcctgtagtcctagctactcgggaggctgaggcaggagaatgccgtgaacccgggaggcggagcttgcagtgagccaagattatgtcactgcactccagcctgggtgacagagtgagactccgtctcaaaacaacaacaacagcaacaacaacaacaggaatgttctggaggctggaagtccggaatcaccatggaggtagggccctgctccttctgaaggctgtaggggaggacccttccttgcctcttccagtgtctagtggcacctcgtggcttgtggttgcatcactccagtctctgcctccatcatcatatggccttcctctctctctgtgtctcctcttcttgtagggatgccagtcattggatttaggacccatcctaagtccagtataacgtcttgagatccttaactaattccacctgcaaagatcttacttccaagcgaggtcacattttaaggttccggatggacatgaattttggggcatgctactcaacttattatgtatgcatacaatagctaaccagatacacagttatatctgcattaaacagatatgaaaatccctggtgcccatctctcctgggctgccctgccctccccctggggttttaccaaagtgccagacctggtgtcctggagagctgcatcccaaaacagccacagtcctgacgtcagaaggttgtgatgaaccctgtccagggtgccacctgtccttcccgtgagctctcttggggcacggagagtggagctggctgccacacagatcctgggactctgaaaagccttcgtcgttttggagctggtggctggggttgtcatttgtgagagcagagcaggtgtggtgttttgtgtgatggcacgagggccatctgtccacccagcttctgctccccagccctgcccagcacagctcgtcaggggagaggaggcggcttgcacttgcgtgtgttcatgggcggtgactcttccgtggatttctctggaactgtgggtggcgggtttcaaaggaacagccagctgactcgtgggtgcggcgggtatcgagaaagaacagccctgtgggggaagatggagctccggagggtgggcgggagctgggatcaggcctgagctgtggggccctgctgatgcctgtctcagccacagcgctttccttggaggcctcctggggcctggacccagagcgagcaaaacatgcccagggctccctgtggcccagaggctgcctctgggatcagttcttggggcacagacccctgggacctctgcggagccaggttggacgcaagcagctgcagtgggagctggggtagggcctgggaggaagggagcccagggcctccagggatgtcagaggctgtggctaccaacttctccctctcacttccctgcctcccttagtgcccagcccccaacaaggcattttggaggaatgcggatccccaaaagtcacatttttttttgagacagggtctcactctgtcacccaggctggagtgcggtggcatgatcatggttcactgtagcctcaacctgccgggctcaagcgaccctcccacctcagccccaagtagctggaaccacaggtgtgcgccaccatgcctaattcttgtatttttttgtagcggcggggccatgttgcccaagctggcaaaaagcacaatttgaaacctctaagccaggatttttttttttttccggacacagactgcttggagaatcccatgagaactcaggacacacacacgaatttcatttgttttggggccccaaagagtccttgaaagcccacccattgacgccaggatgggaacctttctggggtctttccgaatactaaagttctgtgcagagcaccccagaagctgagacgtgtcaccatggcgatggcccagcatgtggaactctcagggttcccagttgagctgcagagacttcagtgtgcagtccaagaccaccgtgcctgtgcctgggggtcttgagtcactactgtgggtgggggaggggacccttatgctgctgggatcggagcacatgaatccccagccggcttgcctgcagtttgatgactttagctcttgtatatttgtgtccccaccagcaccataggttggtactggaatctcagacacttctgcctcctgctccatgtcctatctaaggtctgccgtccaaaatctaaatgcctgagtcccaaaatgtgcctctcctgtaacaatacaagtgtcacacgtttgggttgccggagaccccaaaacccaatacaaattgcctcaagcaaaaaatgggaatttatgggttcatgtaattcggaagtccaagaatgatctggctggcttcaggtatagctggatccaggcattcaaatcatgtccccccacccccaccccaacaccctcagtctagtcgttttccacactggctcacccgctccatctcttggttctgatcaggtcttctccacactggagaagagttggtttccgttcctcctccttgtggcccaccttggcccaccttgtggccctccttgtgtctaaccttggaagttagacagtcccagcagagagagtttcttcttccagctgcagcagaagttccacgatgggctctgacgggctgacccggggcaggtgcctaactctggaccaatctctcaggcccacctgcaacttggggtgagaagacagtgccacccaaaccacctggatggagaatgggggagaggtactaccctgatagcaacacgctagaggctcacagccagggctcctgggttttggggtctccggcaacccaaaacgtgtgacacttgtactgttacaggagaggcacattttggggctcaggcatttagattttggacggcagaccttagataggacgtggagcaggaggcagaagtggccacctccccgggcactctcattaccatggaaggcttcaggtcacaagatgttgcaactttcccacagctccctgtggttgccagggcacattcggtctctgggtagggcagactggcactgccagggagtcaacccccaggagcggccctcaaccaatgatgaatgggtgttggctgataaataccccagcttcctcgcccttgtgtggtgcaaccaagacctgttctaccaactgtcccagaggcccccagcaggattgagcccctgttgcctacagtatagacttgctcactcctgcactctgcacaggctgccttccctccctgtcctctaccagtgcttcctggggccgcctccccaataaagtacttgctctcacctccttgtcttagtttctgcatctggggaatcctagcctaagacagggctgttgctagaagagagactggatgtcgggcaggcaaagaaaatcaataacacaatgacaaattaaaaagaaattacaggctgggtgcggcagctcatacctgtaatcccagcactttgggaggcccaggcgggtggatcactttaggccaagggttcgagaccagcctggccaacatagtgaaaccccgcctctactaaaaatacaaaaattagccaggcatggtggtgcatgcctgaaatcccagctacttgggaggttgaggcatgagaaacgcttgaacccgggaggcagaggttgcagtgagccgaggttgcaccattgcactccagcctggggaacaaaatgagactgtctcaaaaaaaaaaaaaaaaaaaattccaggggccacaggactcacaccgcttggcatgtttgagtcacctgacctgggacccctctaactttgctgtgacaggccctcttcaggtactgctgcctctgggcctggattccagtgcacaggactgtcacttttccaacttagccgccagcacaacagagatgtcccctcagaggtcatggttctcaggccaagggtcatttcaggatggtcatcatggccatcatcgtggccgtggcgtcagactgagagtgatccctgtagattccaggatctgcagccaggcttgggaactgctcttaggaatacacctgaatgactctaaggcgcctgactttgcagctcctttttaagaggcagagcccgtttcccttctccctgaatctgagctggcctggtgacttgtgcaggcgcccaccagggctgccagatctttaaagagaaaccagcaagctggaatttttgtcaatctctggactttttgagatggagtcttgctctgttgcccaggctggagtgcagcggtgcgatctcagttcactgcaacctccaccttccgggttcaagcgattctcctgcctcagcctcctgagtaactggattacaggctcccaccaccatgcctgttttgtatttttagtagagacggggttttgccatgttggccaggctagtctcgaactcctgacctcaggtgatccgcccacctcagcctcccaaagtgctgggattacaggcgtgagccactgcacccccgcccttatttattttaaaatctcttgacttttaaacatgggtaactaatttaaattctataaaaatactgtgaggaaaaactaagccctggtcattcaaattatggtcaggggccaggcgcagtggctcgaacctgtaatctcagcactttgggaggccatggcaggaggttgacttgaggccaggagcttgagaccagcctgggcaactcagtgacaccccttctctgcaaaaaaaattttaaaaattagctgggcatggtggcatgtgcctatagtcccagctacttgagagactgaggtgggagaatcacttgagcccaggaggtcaaaattgcagtgagccgagatcgtgccattgcactccagccagggcaacagagcgagaccctgtttctaagaaagacaagaagtgtggtctggggacctgaagcatcagcatcgtcagagagcttgttggaaacgcagaattgctggcctcaccccaggcccaaatctgcattttaacaagatctcctcgtgacctgtggcatattaaagtttgataagcactggattaaacaagcagggaacaggacttggctccaggatgccgttgtgacttctgtttcaggataagccacacctgctaagccctagcagtgacctaagtccatgattcagaatccacacaccacctggtggctccttttattatatcaatttattcaagtgattaaaaaacttcttggcagcaggatgacaaaacaggtctgtaaacatgatctcatccccccatcccttcttccaaggagcttcctatgacaggaaatcgaattctagttggcaaatccagtgatgaggtctgtagaaaaggggtcccgtgtcacagccaggaaggcagactcgtccctttaacccactccagccaggggtgctggccaggatgtgctgttctgtcatgacgtggtcactgagtctggttcgttggcagccccttccccaggaggagggagactctttggcagtgcggcagccctcccgggggcacgggcttctcggcagcagacacaggcaggccagaagcaggcagctgagcctctccagcgagcatggtattgctagggttgcaggtgccctggcaggtggccaggtgaggggctgaggcacaagtgctatcaggaacttggctgccccacaggggctgaggacacccagatggtccacgccagtggccttgaaatttcccctgcagaagccagaccgtggggaaacaagctttcgcgacgtgccaccccgggcagcttgaggcttcagtccttgaaggggttgtgggcgccccctggctgctccttctctgcggccagaggctccccgttcatctcctgcagcgggtggtatgcatagtccccatgcaggcgccggttcctctctgctctggacaggagcaaggacaggtttgctgcagtgctgatcagcaggaggaaggccagcgccagggtgagggctagccaggcggtcctgcagacaggagagaagccccaagtgggggactgctgggtgggctcagggcttgggtagcactggaggggcttccctctacccggcatagatagcactaaatcaggtgcctccagggaccacacagggaatgttatgagcaaaatggactaggtggggatggggcaacatttaagacatgtgcagggaacagcagaggcagtcatgacgtacaatgcaggtccgtgctgccccatctcctgattttttttttttttttttgagacagagtctcgccctgtcatccaggctggagtgcagtggcatgatctcagctcactgcaatctccgcctcctggcttcaaacgattcccctgccttggactcccgagtagctgggactacaggctcgaatcaccacgcctggctaattttcgtattttcagtagagaccaggtttcaccatgttggccaggctggtcttgaactcctgacctcaagtgatccacctgcctcggcctcccaaagtgctaggattacaggcgtgagccaccacgcctggcctgatattttaagagaagccattaaaaaggtttttaaggctgggcgtggtgctcatgcctgcaatcccagcactttgtgaggcttaggcgggcgtatcacttgaggtcaggagttcaagaccagcctggccaacatggcgaaatcctgtctctactaaaaatatgaaaattagccgggcacctgtaatcccagctactcaggagactgaggcaggagaattgcctgaacccaggaggcggaggttgtggtgagctgagatcgcaccactgcactccagcctaggcaacagagtgagaccccgtctcaaaaaaaaaagtttaaaaaaatgtgaatgttactgatttttagatgctgctgatatattttaactttttaaaaattatgtaagccaaataaaacacagctggatgctgggcatgggggctgggaggccaaggtgggaggatcacttgagcccaggactgtgcacctcgtctgtgcaaaatagtgagatcctatctctaaaaaacagtaagaaataaaattagccgggcatgggggcacgtgcctgtcgtcctagctacttgggaggctgaggcgggaggatcgcagtgagctgactgtactacagcacttctgcctgggtgacagaatgaggaaacctcctgcccccaccctgggatctcatctagcccagtttgcattctgagctccagtgggggatgctgacaacagaggctgggcactcgaaggccctgggctctgctccagggtccccaaagcagacagtggggagagctggtcccgcttcctctaaggcagggagctggcaggggacaagggcagagatggacctcacaggggaagggtgcgggagagaagggggattcctcccgccctggccccagctcccacagaagcacctacctggtgaaaaaggagagttctcccgccctcagggtggcttcaggtggctggagacactgctttactgtaacataccagagacaggctgaaggggccggagcaggagcgtctgcccatacccctccccttggagggataggtacctctggagacgctgcagttgccagtcttggggtcacagggacaatggtgctcacacttacaaggcctctggcagcccggcccatgccagccaaggggacactctatggaaaggagatgggaggagggaggagggaggagaaaggttggggcctccagtgtcagagcctttctcgacaggacaggatacctgcccctgcccatgtgtacagagccgggctaaaggtgaagcaccccctgccctccctggactagcccctgaacgtgaccttatttggaagcagaatctctacagaggcactgcagttaggatctcaagataagaccgtgctggatttgaggtgggccctggagccagagcccggggacccttgttttagccgagccctttgtggaacgggccgcagcagccacaggggagtcacacagtgatgtgcaggtgaggccggggcagaagacaagaggcaagcatttcccagaccagaaggtggagacagaagcagcagaggagcagtgggggctgccgggggccaccgtctccccatccgctagtggcgtggcagctcctaccttcactgcagttggacccggtccatccggcatcacagcggcagccggctgccgagacaagaccggggaggccaggtgagggcctagggcaaggcagggctgggcagagccccctccccagaacccccactcactctccgtgcacagtccgtgctggctgcagttagaggggccacagtccagctcatcacagccgggaccccgccagaagtgcccggtgcattggcagtgcccgtccacgcaggtcccgtggccgtggcagtcaggcggctggcagcggggttcgtgcacacacaccacggtggacacttggcggggacagcgccacatgttgtcctggctgtagagggatgtgatgtgtgaggagaggacacccccagacggcccctcaactccctccaggctgcccccaaccacccctctctccattctcacctgtctacctacctacctacaagatggcgtctatctatttttgagatgaggtattgcgatccttccacccgagcctcctgagcagctgtaaccgtaaggtgtgcaccatcacgcctgcctaatttttttttattttttcataaagacagggtctatgttgcccacactggtcttaaactcctgggcccaagcgaacctcccacctcggcctcccaaagcactgggattccaggcgtgagcccctgtgcccagccctctccagtcttttataggttcctccgctccctacaatccctcccagccctgggcctttcacatgtggtgccctctgcccggaaggctctcccacccccacccagctaccacctccttcagatctcagttcttattctgtcatcctcagggaggtctttgctgaccaactgaccctgctcctaggcctgggtagtactggcatcctgggggagggactgcagcaatttctgctctcttgaacccccggggcctggcacatagcaggcactcaatattggctgaatgagacaggctggggcagacctggacttcagccctcacgaaggcggctctcacgtgcttaccagtgatctgacgggtaactggccaaggtcccgttgagcacaaaggtggcagagccacccccatccaggttgatggcgttgaccacgtcctgtttcagcaggaactccgccatttcccacaggttgatgctgcggcacaaagcggcgctgctcaggctcagcgcccaccatcatttctcatttaactccttttccttccacagtgcagagcatcacgcccacagtgcaggcacatttctaagtggcccccgcccccaagcatgtctcatcctagcccccggaagctgtgaacacgtgagatcacacccatgcctgtgctgttacatggcataggaatccttaagggaggggaaacggcccggaggatctgggtgcagccactggaatcacaggagtgttcaacacagagagccttctctggctggtgacagaataggaagtgagatttgaaatacgagggggatgagagggtggccggacaactgggggagaggacacacatgggaaggaacctgggcagcttgaaggagctgaggccccagatggcggccagcagggaaaccaagacctcagtcacaactgaggaggcgacggggattcttccaacaacctaaacaagaggattctttccagataagagaagagccctgcctaaccagcatcttggttttgtccatgggacaccctgaacatagaacattccaagttgaccagcctggccaacatgatgaaaccctgtgtctactaaaaatacaaaaattagccaggtgcggtgactcacgcctgttaattccagcactttggaaggccgaggtagatggatcacctgaggtcaggagttcgagaccagcctggccaacatgatgaaaccccatctctactaaaaatacaaaaattagctgggtgtggtggcgggtgcccgtaatcccagttacctgggaggctaaggtgggaggatcacctgaacctgagaggtagaggttgcagtgagctgagattgcaccactgcactctggcctgggcgacggagtaagaccctgtctcaaagaaacaaacaaacaaaagaacattccctgctgagtgttgctaaatttgtgctggttatgcaaccagagcaaaccaaaacactctctttacaggggctagaaatgaggctcagggaggccgagggacttgtctacggcataggtgggtagacaagtcatcgatggctaagctgggattggaaccaagatcttctccctgctcactttgtgaccatttccttgtatcctatctagggttcaggaaaggtgaggcctaaagctgaagatgatgagttcttggaatcggcaaagatctcagaaccctcatcctgtgggaaggtgagggggccctgggaggggggacagataggtgtcaacatcccagaaagcaggtagagtcagagggtggctgtcattgggtcaacgttcctcctagcaggactgagccccggccggggggcctcagctcccaggactcacccacgctgctccgtttggccgtctgcatgaaagagcaccagctgccctttccggtcgtggccaatggccgtcctggctgatatcacattcacaaatttgctaaaggaacctgaaggaaaagcagcctggctgatcaccgccccttgggaggcctcctgcttcttgcctaactccacttcccactggtctgagctacctggtacctccctgggaagcacagcagcctccttgctcgtctccctgcctcccctctgcacatcccagtctccccagggcagccggggggtctcttcttacaggtaaaccaagctatgccagcctccaggtgaagaccctctaatggtttcccctgttcttagaacaaaatccaaagagccagcatgccctccccagcctcttcctcctcctgcctcagctcctgggtgtcccctcaccaccctgcagccactttgcacttcctgttccctctggctgggaactgtgcttttctctagcttgctcctttgtcagatcacctccttagtgaggccttccttgaccgcccactctttttttttttttgagacaaagagtctcgctgtgttgcccgggctggagtgcagtggcatgatctcagctcactgcaacctccacctcccaggttcaagcaattctcatgcttcagcctcccaagtagctgggactacaggcacacaccaccatgcctggctaatttttgtattttttttttttgtagagataggtctcactatgttgcccaggcaggtcttgaactcctgggctcaaccgatcctcccgcctcggcctcccaaagtgctgggattataggtgttagccaccacacctagcttactgcccactctaaaatggtcatggtatcctgtccccatcccagtattctgcatcccagtggttctcaaccttgagtgtcggtcagagtcaccatggaggcccgttaaaacatagactcttgggccttgcctctgattctgcaggtctgagggtgtggggctttgaaacaagctcctgggccacgccgatgttgcaggtccatgaagatttttttctcttcacttttctcttcctgtacccacagctccggtccccatctctcccctttcccctaactttatttttgtttctgagcacttatcaattcttttcagcatattctataactattttttgtcctatatattcaatataagcctatcttcctccccatgaatccccagtacccagaatagtgctgggcacaaagtagctgctcaatacttgttgaaagacttaagaacagctccgcccagcccactggtcctggttctcgagagggttgttgccaacagcctccccatccaacctgtctcctgtgtctcgtcacactctgtggcttggctctcgttgatgtagatgcttccattacgaatcagccacacgaccccactcagcagctgcacaaatgggttctcagtgtccagcacctcctcctcagacaggtacctggatccggggaaggtgggaagctcactcaccagcaggggcaactgcagatagtcaggctctttctccctagccatcccaacctggctgctagattccccctcatgccccaggaacctcctggggcctgagtgtagctgggacaacttaacagccctaggaatctccctgttgtcagagctgaagctggacagggttctgacaatacaatccccacaagcctttgcaaacagtctgtttcatttaacagaaatgaccatcccccaacagagctcaaatccatctatggccctcaatccccaggccatacccagcccaactaccacttgatccctgttacggcccttcattggcttccttgtttctccactgctctctcccacctggtcccactcaggatcagaacaagctttatcatcaacaaatactttttttttgagactcaaataatttttaagataattttaaataattcaaatcatcaatcttgccagggcgtggtggctcacacctgtcatcccagcactttgggaggctgaggtgggtggatcacttgaggtcaggagttcgagaccggccaggccaatatggtgaacccactcccccgttccccaccccatcccgtctctactaaaaatacaaaaatcagccgggcgtggtggcacacgtccgtagtcccagctactccagaggctgaggcaggagaatcgcttgaacccgggaggcagaggttgcagtgagccggtatcatgccactgccctccatcctgggcaacagagcaagactctgtctcaaaaaaaaaaaaatcatcagtcttgatgagttgatgtttctgacaccccactcctttttcagtccctcatacacacaagcccccctgagcctctgagcctttgtgcgtggggttcctttggactgaaacgctcttcctccagttctgaccttggctcacttagtgattcatcttcaagttcccactcaaaggtcacctcggagaggcgtgttccagatcaccctccctaaaatcaacactatttacaacgggttcaccccgttggttgctttgctgcacacacagcaatcagaatgtatgttagctatttacccggcttttgttgatttttctagtaatgggggagggctgttaaggcaaagactgtgttgttcacggctatctcaccggggcgcggcacattgcctgatacaagcaagtgctcaatgatactggatgatgaataaactctgcaaggaagcgattcctatccccattctgcagaggaggaaacaggggctcagcttggttaagtgacttgaacacggaggcacggctacaacccaaatctcaggccctctgccctcgacagcacggggctccctgcctcctcacccggtgaccagggtcccgtcgcggcggatcccgaactgcgcgttctgcagccccccggagctgctcacccgccgctcgtcgctcaccacgttccccaggcactcgcccgagttcatgcggaagaagccgccgttctgggcgacacggcagtcggccgcccgcgccgtctcctccacggtggcgcgtcgtctcgccgcgcagccgccgggtccaccgggctccagcaccgagaaggtgcgcaggggctcaacggcccgcgtcaggtggccggccaccgcgcggtccctgaagtgcgacacgaaggtgcgcacggccagaccgccggcgccgggagtcgcgggaggcggaggccaactctcgtgctcgcggttgccggcgcgcacccgtgtgcagtcccgggggaggcgcgcgcgcgcgcgtggatagggcagtagcaagtcgtcgtcgcgggaggccctgcggggacgggcggccgtgagctcagggggctgtcctcgtgagctcggaggacaggggggaccccccgaaccaggctggcccagggagctgcactcaccccgagtcgaggccgccggacgcttcccagaggaagccgaatagtgcaagccggaggagaagccagcgacccgtggaggtcgccatattggaccggggcctcgggtcatgtgggctcgcctcacgtgactcaagtcccagggtggccgctttcagctcggactgaattacctgcgctcttttcggctggcgggctggcgggcggtgctggtgatgttaactttttatctccaggtaatctcaaacctacaggaagttgcaaggagagcataaagaactctcgtagaactgttattcatgtttagcagtggtttaggcttgcctgatttactcaatcatttgtactttgttttttttttttcctgaaccaatggcaaccaaattgcagatgtcatgatcctttaccccatacctcgccatgaatctcctaagaacaagggcattttcttaaccacagggcaaatatcattaggacaactcccattgacatttctgtgatgtcatccacagctaaccttcaattgtccctctaatgtctttttttttcttttcctttttgtccgcccctgaccctgtaacccaggagttgcttttagttgtcatgtctctttgatctcttcatctggaaggctcctcagccttttgtcttttactaccttgacatttttgaagacagcccagctacatgatttgtgtgactcaatgcaaaatgaaaacgtggggacacttactaaaaaacccagaaaactattaagaatttcaagatggtcagagcaaatggttgcagcaagccagggaccttctgagtgagcccatgaagctggccctgagtatagaagccagtttattttgtagcatgtacttcaagcttcctttgagaggattcttctcttcaggcctcctgtcccagtgcagtgtccagggttgggtggtgtcttggtgccagtgcagtgcgtgggccattccaggagccacggcaagtctaattggcttgatactgttgcggtcttgccagtgcaccttaatatagcagtttctccttgtctgaactagtcccggggttctttgtcctacctccaagaaaactaaggagcgtggacacaagggtggggttggagcgaacgtttaataagggaaagaagaaagctctccaaagtggagacgggagtccgagtggattgtcgggttacagctgaatgcaaaaagctttttttttttttttttttaagacagagttttgctcttgtcacccaggctggagtgcaatggtgcgatcttggctcactgcaacctcaacaacctctgcctcctgggttcaaatgattctcctgcctcagcctcccgagtagctgggattacaggcacacgtcactgcgccctgctaatttttgtattttgggtagagacgaaattttaccatgttggccaggctggtttcaaactcctgacctcaggtgatccgcctccttccgcctcccaaagtgctgggattacaggcgtgagccactgtgcctggccgcaaaaaacttttataggacactgctctcctcctggtaactgagtaacttcttaccagtaaaactgcctgtgcagctccccttatgttatgcagctgtgggtatgtctctaggcaagtgcaaatcgctgcttctcttgtttgtgtaactgtgggtttgttttagataaggccccctcctccctgtgccggtttccatggagcccactgtgtatatgcctgaaaaggagaggaaactttttcccgggagcctgctaattatgcaaagaacaaagggcttctgcgctggaccctgtctgcttatctccgtgcaggtccagcctgagttttttcccaggttgctttatttttgccagtttctatgacttttcaggcaggccacttctgaggtcagaattttccccaacggatttttcttttccttctccctcactaccacaggtatggggggacacagataggggccaggccagccccttttcatccacagtcagcacttctggtgcttgatctcaggcccctctttgagccactgctcctttgagccagtccacggtgagggttagtgaactcagttagagagtgtccccccaaactcatgtccttaccagaacctcagaatgtgaacttgtttggaaattgggtctttgcagatgtaattagttaagatgaggtcattctggagtagggtgggccctgaatccaatctgactggtgttcttgtaaaagacacaaatacacacagaggaaagaagctcatatgaacacaggcagagattggactgatgcagtcataagtcaaagaatgcaaagaaggctagcagccaccaagagctaggagagaggcgtgggagagactcttgagctttgacagagaacatggccatgctgatgccttgcttttggaaactaatacaattcagggacctcaaaggggtcccgggaacagctctgacgctcctagttcactttaaccatgtacaaaatgactgctcctcctagaggcttaaatgaccaatatattgatgtgaagggagtatatctttctgagctttgcattgggctgctaaaaataaccagcagaggagcccaggcctgacgcctactccctgcctccggaagcgctctttttttctgcctcagttaggagttgcaggaacaggcagtctttggcaagttctgactttggttttctccctactttgaggtttgctactcctttgccaagtttttctaagcacataacgggtgccacagaaattctgcatttgaacagagcagcccatatccacagttctagccaaagctgctaagaagccaagggttttcttttttgctcttcagcctggaatacttttgtcccctcttagcatcctcatttgagttctaccatcatttgtgtgttcaacaggctgagcacctcgtatgtgctccgttgcagctgatccctgccttcatggagcttagcttttcaaggggaaacagacatgaaacagttatgtgatgaatgcaagaagcaaagggcaggactgcgagagaaggatgttgcaggtgtggcagggaagcctctccaagcccctttagactgtgattgaaggaaagaaaagatgcggctgtgtgcagatctgggccagagcctgaagtgggaaacagcttgggaggtgcagcaggaagagccacctggtgggagaggagggccgtgggggaggggttggaggtggtgagcagggttgaagtgggagggccaaggcaaggccagatcgtacatgcagggatccagggaaatgagtatggatttcagccaaagtgaaatagtaagccattggaaggtttttttttaaactttattaagataaaatttacatactgtaaaattctcctaagtgtacaatgcaatgatttgtagtaaatgcacagcgatattccagcatcaccattatccagttttaggattttttttatcacccaaaaaagttttgttatgtaattctattattatttagagacaggatcccattctgttgcccagactggagtacagtggtgcaatcatcgctcactgcagcctcgacttcttgggctcaagcagtcctcccacctcagcctcctgagtagctgggactacaggtgtgtactaccacaccaggctagtttatttatttatttttagatggagtctcactctgttgcctaagctcgagtgtagattgaaatggcctgatcttggctcactgcaacctcagcctcccaggttcaagcgattctcctgcctcagcctcctgagtagctgggattaccggggtgtgccaacacgcccggctaatttttgtatttttaatagacacagggtttcaccatattggccaggctggtcttgaactcctgacctcaagtgatccacccccgttggcctcccaaagtgttaggattataggcgtgagccactgtgcccggcccgaaagtcatttttgtaaaactcttaggaaatggaaacgtcaaaggatcaatttcttctgtccgtgctgtgtatagtatctgttgtgtaaagggctgggagggcattaacagcatcccagaaactggcgttgaggttctgaggggcaggagattctgtcataggctgcgtgtctggtaggtggcccccacgtccagttgggtacattaggggtgcccctcatcccatgtggacttgcagggtggtgtgggggctgccagctgggcagaccagactcaagcacgctcacagcccaaggtcccttccaccagctaagacctggacaaaacatctccaggtgcctcttttttctttttcttcattttttctatttaattcagcaaatattttttaaacatttctatgttccaggctgtatagtaggagccaggcacctgaagaggagcaagacatcgtctgtgccctaaagtcattcacaatctgaaaatagagttgacaagcacacaaacgaagccagagtgagctgccacagagcagtgtagggaatgagatgggcaagtaggtgtgaggaggggaggaggcttcacagaacaagggacaaccttggggaatctttttttttttttgagacggagtctcgctctgccgcccaggttggagtgcagtggcgccatctcagctcactgcaagctccgcctcccaggttcatgccattctcctgcctcagtctgccaagtagctgggactacaggtgtgtgccactacgcccggctaatttttgtattttagtagagaaggggtttcaccatgttggttggccaggatggtctcaatctcttgacctcgtgatctgcctgcctcggcctcccaaagtgctgggattacaggtgtgagccactgcccccagccaatcacggggaatcttaaaggacaaatccaatttaaccagattgggggtgggggcagattcgcaattgcaaaaatgtggaaccagcccaaatgccaatcaatgagtggataaacatcatatatatatgatggaatactactcagccataaaaagaaatgaatgaatggcattcgcagccacctggatgggattggagactattattctaagtgaagtgactcaggaatgggagaccagacatcacacgttctcactcataagtgggagccaaactgtgaggatgcaaaggcataagaatgatacaatggggccaggcgcggtggctcccacttgtaatcctagcattttgggaagctgaggtgggtggatcacctgaagtcaggagtttgagattggcctggtcaacatggtgaaaccccgtgtctattaaaaatacaaaaattaggccaggtgcagtggcacatacctgtaatcccagcacttcgggaggctcagttgggtggattgactgagctcaggagttcgagaccagtctgggaagcacggtgaaaccccatctctgctaaagcacaaaaaattagccaggcgtggcggtgtgcacctgtagtcacagctactcaggaggctgaggcaggagaattgcttgaagccgggaggcggaggttgcagtgagcccagatcgcaccactgcacttcagcctgggggacagagcaagactctgtttcaaataaacaaacaaacaaaaaaacccccaaaattagccgggtgtggtggcgcgtgcctgtaattccagctactcaggaggctgaggcacaagaattgcttgaacccagcaggcggaggttgcggtgagccgagatcgcaccaccactgcactccagcctcaaaaaaaaaaaaaaagttacagtggaatttgggaactcgggtggggaagaatgggaaggaggtgagggataaaagactataaattggtttcagtgtatactgctcaggtcctgggtgtaccaaaatctctcaaatcaccactcacgtaaccaaataccacctattccccaaaaatctatggaaataaaaaatgagaaagaaagagaataggtgaagacccagaaaaagcaaggatactggtgggacattgcccaagtcagtcttcctggctctggtgggtgagggggcagaagcttagccactgagagatgggagtggggaagcagtcatgaaagggtggcttgaactcgccccagctctcaccaatcccttccccgccctctcttgctctctcagacctcattccaagcaacagttctgcagatactgttctcacaactccttcacactaaagctacatgatggagaaagtcttaactcattccgtttcctgtgtatatttacatcttaagaggaaacactttcaaccaggcatggtggctcatggctgtaatcccagcagaggcaggaggattgcttgagcccaggagttccaggccagcctgggcaacacaccaagacccccgtctctttaaaaaaaaaaaaaaaaaaaaaagggccaggcatgctggttcatgcctataatctcggctctttgggacgccaaggcgggtggatcacctgaggtcaggagttcgagaccagcctggccaacatggggaaacactgtctctactaaaaatacaaaaattagccgggtgtggtggcacgtgcctgtaatcctagctactcaagaggctgaggcaggagaaccgcttgaacccaggaggtggcggttgtagtgatctgagattatgctactgcactccagcgtgggtgacagagtcagatcctgtctcaaaaaaaaaaaggaaaaactttaagaacatgatgacttaatggaattacttgtttacagtaggattttataccttgagccgggagccggaaggaatgcacttttgaccaaggattgtggcaggggcacatagagccaccgtgggctgggtgcttccaccaatgagggcctctctctcggggtgtgtatttggggggcagggaaagaaggccttgatgaagccctgaggtggggtttgtgccgggggaacctgcttttccatccctctctcatttaactccaagtcccaagcctcctttcctccctgtcttcctcccacccgctccaaacaatctgcctgtgactggtttttctgctctctgtgctacttgaacaggaggctgtcaggagctgttctgctccaacgaggagaaccattgactcatttgtgggtgctccttgtcttgacctcgagttttgtttcaagccctttggagggttccctctttttttcttttgagacaagttctcgcactgtcacccaggctgggatgcaatggcatgatcatagctcactgcagcctcaatctcccaagtctcaagtgatcctcctgcctcagcctcccaagtagctgggaccacaggcacgggtcaccatgcccagctgatttttgtgtttttttgtggagatggatttttctcatgttgcccaggcaggtctccgaatcctgagctcaggcaatccgcccacctcggtctcccaaagtgctgggattctaggcatgagccactgcgcctggtcatatgagagggcatttgagcagagactggggcaaagtggagtgtgagccacgtggatgtcaggggaaaagtattcagaaagataggagagccttgcaagggacgtgaactccatgtgggctggatgtgtgtgctgagtggataaattccagggagtttttgggctacagttgggctgtggcatgccactgagaaagttctttttgtgtttgtttgtttttgcttttttgagatggagtcttgctctgtcacccaggctggagtgcagtggcatgatcttccctcacggcagtctctgcctcccaggtgcaagcgattctcctgcttcagtttccctagtagctgggattacaggcgagagccaccacgcatggctaatttttgtattttcagtagagatggggtttcaccatgttagccaggctggtcttgaacttctgacctcaagagatccgcccaccttgagaacgttttttttaattttcggtttcacatcgatcctttaaatagaggatcaggctgtgaaccaggtcatcaggacgggtcatctgcttccccacgggtgtggttgggctgcagggaccttgttgctgagactaggaacagctccttgaggcaggtgctgcattagtttctggggctgctgtagcaaggtgccatcaactgggaggcttaaaccacagaaatgtatggtctcaccgttcaggagtgctgggattataggcatgagccaaggattgcctttccttgaaagtgactcatacgctccgctttcctccacagtcatttcaccctctccctggtttggtaactgaagccttctgaaatgaaccagtgtcaggctccagtgaggactccatccccaattcaggaagcacagaggtggagcataatccccccaatttgtttatgtgcggctgacttctctcaagatggtgtgcctgtttgggaaaacttttgtttgcaagacaatgtgaaagaaatccttaaagctcacagactgctgggtggatatgacattctggcccttggttcccccaagaaaacagcaacttgcagatagcaagtcaaacttgtcagcagaatccagggatgttcctcgaggcctgacaagttaagagcaatcatgggaaggcattcagaggaccgcagcagaggatcaggtcaagggaaacctacctcctaaaggaaagatcgagaagaaccatgcgccccaccacccacctgggctgctcagctgggcacagaagcagccaaggatattttcattcggatgctcacatatgactgagttgccacatgaggatgatccgtggcgattttccaccttgaggcaaagcaggacaatgcgtgtaaagaggtttgcagccccgggaccgggttttcagctggtttttctaccccaaagtccaatgcgtgcaggctgtcatcagcaccacagacagcaccagaacccatcataatgtcccagaaggttttattgctaaattagtgtcagagctccagggaacacattcagatatagtcacactgagtcagagctcgagggaagagctgtaagctgggaaccagagaaccgatgacaaggcagcggcctcttctggcagcttccggaggagcccccacttaatgggacgtcatcacttgaggcagcaggtaacgtttacttggcacttagtatgttacgggcaccatttccagtattctagaaacacaatactcacagcagtggaggtaacattgaggtaggggctgggttttgttttttttttgactcccactctgttacccaggctggagtgcagtggtgcaatcatacctcactgcagccttgaactcctgggctcaagtgatcctccctcctcaagtgagcctcccgagtagctgggactacaggtgttcactactgcacccagtgagggttggtggggaggtgtctcgttatgttgcccaggctggtctcgaacttctgaatccaagcgatcctcccacctcagcctcccaaagtgctgggattataggggcgggccactgtgcccttccaaggtaggggttattattatcgcaattttactgatgagaaaactgagtcccagagaagttggtgactgctcaaggacacagacagctaggacttgaattcaggcagcctggccacagaaccacaccatcaaccgctatgctatactgtgttttgtaaaatgacatgatggccatgtgatgcaatgtaatgatacagcagagttttgtgctcaggatgtaaaaatgagtatgtgctgcctttcagggttatctgttgagttctggctcatgacctgaactattttttccaagacccttccttctcccactgggaaagatactatatttggtacctgaacaaatagcctttaagatatcagtttatgggtctttttagaatttgtggctgggtgcagtggctcatgcctgtaatcccagcactttgggaggacaaggcaagaggatcacttgaggccgggagttcgagaccagccaagtccatgtagtgagatcccatctctacaaaaaatttaaaagttagcttggcatggtggcatacacctgttgtcccagctactcaggaggtgagatgggaagattgcttgagcccaggagtttgaggctgcagtgagcctaggtgacagagcaggacctcatctattaattaaaaaaaaaaaaaaaggaaaaaagaaaaaagaatttgtgttgagtgggattggagagttgaaacagaccaagaggttgtccaaggttgtcctcaaagctgagaaacaagactcaaccctgggtcagttgcagttgaactttattcatccgttcacacctgggtccctcccggcccccacctaccctggccttgcctactcagggcttccaagattgggtgtcggggtggctttgcttatcctccagatgccttcttcccaggatgtgatccgtgccctccaggatctaagggatgaggactaaaggggtctgttcctcctccaggcagctggcatggaaccgtccgtctcagcggctgcttggtggtggcggtgtggatgggtgtggctctctgtttgctggggggtattctgccaggatgtataggaagccacccagggctgccactgctgtggctgtgttgtgggaggagcagccatctaggggagagagcccccatgagtgctgggtggcaagaaccttggccctttattcaacacagtctcattgaaagtgcttttcagccagacgcggtggctcacacctataatcccacactttgggagcctgaggtgggcggatctcttgagatcaggagttcgagaccagcatgagcaacatgatgaaaccctgtctctactaaaaaaatataaaaattagccaggtatggtggcacgctcctgtagtcccagctactcgggaggatgaggcaagagaattgcttgaacccaggaggcaaaggttgcagtgagccgagattgcgccactgtactccagcctgagcaacagagcgagaatctgtctcaaaaaaaaaaaaagtgcttttcagatgtcattccaggcaacttgcaagacgctgagtgggtgcttcggtgctcccttaggccccttttgctgggccgggtgctcttccgccagctgctaagggctcccttctctgggaggtatgtccctcccaaataacttaccaatacagggatacaaaagcctggccaccttggcccagggggatgactctggtgcaatttatgctccaaggcattcccctcccacccctgcggggggatctggcctgaggccgcatcctgtccagctcctgcctggcttagcctgcttccctgacttacgtacctcaataaacccacgcaccggagtcctgtcccaggtcctgtgtaagaccttctgagatggggaaactgaggcttgggtagccgagctgagcccctggccctggtgactccacagctcatttcctgaccccagtggccttcctcttagttgcctctggtctgcctggtcccgtgtgacctcatggctcatggagtcagagtctcaggcctgagcacttgcctgagataataacccttaggtgtagttagttctttgagctcaaagtgggctgcacgcctctagtctcacaatctgtctgcttgtggaagggagccaggaattctttcctccctacccagagactttgggaaggggaggggaccccagccaggtccgttgaagggagggagaatgcagatttcaaggtgccgaatgactaaccctggcagctcatgcctctcagtggcctactgtatgccaaatacaatggggagggctttgcacgatgatcagttgttagcccccaacagtttggtgcccattttacagatgaggaaaatgaggctcagtgaggttgtgtgactttcgcagcaagttagaggcagaagcgggactcgaacccacacaacctgacctcaaaccctgtgctcctaatctctacaccagctgcctcctgctccgtgggcttgtgtcataagtgcaagaatcagcacacccctcctgggcagttttctaggctgctggtcaacctggaggtgttccaggaaaggccttgggctctggaatttctgtggcttccgctccagtccctaggacagtcctcgtgttgggctctggggacgggcagctgaccaggtagtacacagcaggcccctaccaccctagccataggcagccccagcccctctgtgtcataaaggcctagctagggtaggacctctggaagtctcctgggaacttctctcccttctcctgcgtgacttttggtggcagctacgaaactgactcactggatttctgctttcactctctcctgtccacctgtaggtggatgatgaggccacagtggggttgatggagagatgtttagttactggaatcatatacccacatatgttggacatccactctgtgagctggctattccatatcccttcctgtttttgcctgcacttatttattttttattttattttattttattttattataattatttttgagacacagtctcactctgtcacccaggctggagtgcagtggcacaatctcagctcactgcaacctctgtctcctgggttcaagcagatctcctgtctcagccttccaggtagcgggattacaggcatgcaccaccacgcctggctaatttttgcatttttagtagagatggggtttcaccatgttggccaggctggtctcaaacttctgacctcaggtgttccacccgccttagcctcccaaagtgctaggattacaggcatgagccactgtggctgtcctatttattttttattaatgaaaaattgaaatcaaagtcctctctttcttcttggttcctcccttcctgtgtccccctccttccctttcttctacgttatttcttgactttcttctacgttatttcttgcctttcttcccatcccaatatacttatatcctgttctcactttctttacattggccaactgaccatacagtttattgtcgcaaccaggacactttggaggaaagagggcactattcataatggctccaagacaacaggtgtaaactggggcagctctgggagcactgggctgtgtggccaccaaaactgttctggtcacttgcccattcattggctttcgggtcccttctctgcctttccttattccaaactccagcacacagacccctccaaactacatttcccaggatgtcttgcctactggtttcgaccaacaggaggtgcaggtggaatgaggggagaagccagaatatttctcccttcctctctctgtctcccccttgttcagcccctgcaggccctattaacactgcctcctcctgccattctccagctctagggagggtagtggcttcctgcaacagtaaaatctctgggtttttccaccttttctgttttcagctcttacaacacctctgagatgagtttcctctagtaaattccctctgttgaagttcctgacgcaggttctattttcctgaccagaccttgacttagaagggttactgttgctatttttaacaactgaaacttctcttttatgctcctttaacaaaagacagtatctcttggactccccactttctttctttcttttttttttttttgagacagggtcttgctctgtcacctgggctggagtgcagtggtgcgatctcagctcactgaagcctccacctcctgggttcaagtaaatctcatgcctcagactcccgagtaactgggactacaggcgtgtgccaccatgcccagctaagttttgtatttttagtagagacagggttttgttatgttgcccaggctatctccccactttctaagaggaggccatcagggacccccagcctcccttccacctctcaacatgaaggccctctgattagtgcccctttggtgatgccaagtgcttttcttccatagcagagaataaacacaggcctctgttttgctaggatatcttagtttcatgtcaagaaactcccttgggtattttcattacctggaaattgtttttctcgcctcttcactctcctcgaaaaatgctgctgatattgaatagctttagataattcttcatcttcagcatctgggagaagagcaaaagttgaacttctcaagagagatttttattttttacatttttatttctttttactgcttttattgtagagacagggtctcattctattggccaggctgggtgcagtaacgcaatcatagctcaccacaacctcgaactcccaagctcacagaatccttcctgcctcagcctaccaagtagctcggactacaggcatggactaccatgtccagctatttaaaaaaaatttttttttggtagagatggggtcttgctatgttgcccaggctggacttgaactcctgagctcaagtgaccctccagccttggcctcccaaagtactggattatatgtgtgagcccctgcagctggtctcaagctgaatttttaaatgttactcactaaacctcctgcccccataacatttcaaggaagttaggtcttctcttgaaacttgaggctattccggaagtttcctcctgcacctgtctgcagatccttttgcatggcctaaacttgtcatctactgatggttttccaaactgtggctccccaaacacccaccatcagaaccactggaggtgcctgttaaaaatggaagtccctccaagataagcaaaaaactgagggatttcattaccactagactggccttacaagaagtgctcaagggaatcctacatctgaaaagaaaaagacaataataactatcatgaaaacatgaaaaagtataaaagttactggtagaggagaaatagaaagaagaaagagaaaagaagcaaaactatcactagagaaaagcccaaacagcagtgataacaataagaaaggaagaaaaaaaaatcaaaggatatagaagataaccagaaaacaattaatgaaatgacaggagtaagtcctcacaagccaataataaccttgaatgcaaattgattcagtcccccacttaaaagatatatagagtggctgaatgaatgaaaaaaaacgacccaactatatgctgcctacaagaatctcacttcactggtaaagacacatatggaatgaaagtgaaagagtgagaaaagatcttccacataaatggaaaccagaaggaagaaggagtagctatacttagataaaacagactttaagtcaaaaactgtaaaaagagacaaagaaggtcattatataatgataaggaatttagcaagaggacataacaattcaaaaaatatatgtattaaacactggagaaccctaaagcaaatgttattagatataaagggagagatagactccaatacaataatagctgaagacatcaacaccttgctctcagcattggacagatcatctagacagaaactcaacaaagaaacactgaatttaaactgcacttaagaccaaatgaatctaacagacatttacagaacatttcatctaactgctgcagaatatatattcttctcatcagcacatggaacagtctccaaaatagaccatatgttaggccaaaaaacaagtctcagcaaatttaaaagaatttaaatcatagcaagtatcttcttgaccacaatggaataaaactagaaatcaataacaagaggaactttcaaaattgtacaaatacagggaaattaaacaacatgttcctgaatgaccaatgagcaaatgaagaaattaagatgaacatttaaaaatttcttaacacaagtgaaaatagaaacacaatatgccaaaacctatgggatatagcaaaaccagtattaagagggaaatttacatcaataaatacctacatcaaaaaagcagaaagatttcaaataacgaactaatgatacatcccaaggaactagaaaagcaagaccaaatcaagccccaaattagtagaaggaaagaaattgtaaagatcagagcagaaataaataagagactaaagaaacaataggaaagatcaatgaaacaaaaagttggtttttaaaaaagatcaacagataaattattaactagactaagaaaaaaagagaaaagactcaagtaaatgaaatcagaaagaaaaaggaacttttacagctgataccactgaaatacaaaggatcattagagactattataaacaacaaattagaaaacctagtggagtgtgctgggtgtggtggctcatgcctgtaatcccagcactttgggaggccaaggtgggcagatcacttgaggtcaggagttcgagaccagcctggtcaatatgatgaaactcagtctttactaaaaatacaaaaattagccaggcatggtggcgggcgcctgtaattccagctacttgggaggctgaggcaggagaatcacttgaacccgggaggtggaggttgcagtgagctgagattgcgccactgcactccagcttgggtgacagagcaagactctgtctccaaaaaaaaaaagaaaacctagtggaaatggataaattgctggacacatacgacatactgaaattgaaccaagaagaaatagaaaacctgaacagaccaattatgagtaatgagattgaatgtgtaataaaaagtctccccaaaacaaaaagcccaggacctgacagcttcactgctgaattttaccaaatatttaaagaacaaataccaattcttttcagtctcgtccagaaaattgaagaggaggaaaattttcccaactcattctacaagttcagcattaccccaatactaaaaccagccaaggacaaagcaacaacaaaaaaactataggccgatttccctgatgaacctagatgcaaaaatccttaacaaaatactagcaaaccaaacccagcaacacattaaaaaccattcatggctttcctactttgaccacttccagtaagtaatgaatgttttgcattttaaaaaaaatcattcatcatgaacaaggggactttattggagggatgcaaggatggttcaacatatgcaaatcaataaatatgatacattacaccaatagaatgaaagacaaaaatcatataatcatcttaatagatgcaggaaaatgcatgtgatgaaatttaacatcccttcatgataaatctctcaatacgttaggtatagaaggaatgtgcctcaatataataaaggtcatatatgacagacccacagccaacattacactgagtgaggaaaagttgaaagcttttcctgtaagaactggaacaacacaagagtgcctaatttcaccatttttatttgacataatactagaagtcttagccagagcaattaagcaagagaaacaaaaaagggcatccaaatgaaaaaggaggaagtcaaattgtacctgtttgcagatgacatgatctgatagacaggaaaccctaaaagctccaccaaaaaaactcttagaactgataaatgaattcaacaaagttgcagaatacagaataaacatacaaaaaatcagtagcatttcatacacctacaatgaactagcagaaaaagaaatcaagaatgtaatcctatttataagagctaaaaccaaaatacccaggaataaatttaaccaaggaggtgaaagatctctacaaggaaaactgtaaaagacactgatgaaagaaattgaagagaacacacaaaaaatgaaaagacatcccatgtttatggattggaagaattaatattgtgaaaaatatccatgctaccgaagtgatctacagattgaatcaaaataccaatgacattcttcacagaaatagaaaaaaaaatcctaaaatttgtatagacccaccaaagaccccaaatagtgaagcaatcctaaggaaaaagaacaaagctggaagcatcacattactggacttcaaaatatgcttcaaggctataggaaacaaaatatggccaggtgcggtggctgacgcctataatcccaggactttgggaggtcgaggtaggcagatcacttgaggccaggggctcaagaccagcttggccaacatgtagaaaccctgtctctactgaaaatacaaatattagccgggcatgatggtggtgggtggctgtaatcccagctactcgggaggctgaggcaggagaatcgcttgaacccgagaggtggaggttgcagtgagcaagactgtgctacggcacaccatcctgggtgacagaacgagactgtctcaaaaaaaaaaaaaaaaaaaaagaaggaaaaagaaaagaaaaaaggcaaatgagctgcatagacatctctcaaaagaaggcatacaaatggccaacaggtctatgaaaaacgctcactatccctaatcatcagagaaacgcaaatcaaaccacaatgagatagcatctcacacctgttaaaatggctactatcaaaaagacaaaaaatggccaagcgcagtggctcacgcctctaatctcagcactttaggaggccgtggctggtggatcactttgagctcaggaattctggatcagcttgggcaacatggcgaaactctgtctctacaaaaaatacaaaaattagccgggtgttggtggctcccacctgtagtctcagctactcaggaagctgaggctggagaatctcttgaacccaggaggcagaggttgcagtgagccgagatcgcaccactgcactccagcctgggtgacagagtgagaccctgtctaaaaagaaagaaagaaaaaaaaaaaagacaacagataacaaatgctggcaaagatgaagagaaaggggaactcttacacacagttgatgggaatgtaaattagtacagacattatggaaagcagtatggagatttgtcaaaaagctaaaaataggactatcatatgatccagcaatcccactactggatatttatccaaaggaaaggaaattggtatgttgaagagacatctgcacccccatgtttattgcagcgctattcacagtagccaagatacagcaacctgagtttctatcagcagatgaatggacagagaaaatgtggtacacagacccaatgaagtactatttcaccataaaaataaccaaattctttcattcatagcaacatcgatgaacttggaggacattatactaattgaagtaagccaggcatggaaagataaatgttgcatgtccttcctcgtatgtggaagctaaaaaagttgatctcatagaagtgcagtgttgaggcagggtgcctgtaatcccagcactttgggaggccgaggtgggtggatcacttgaggtcaggagttcgtgaccagcatggccaacatggtgaaaccccctctctactaaaaatacaaaaattagctgggcgtggtggcatgcacctgtagtcccagctactcgggaggctgaggcaggagaatcgcttgtacctgggaggcggaggttgcattgagccaagatagtgccactgcactcctgcctgggtgacagagcgagactccatctctaaaaaaaaagaagtggagtgttgaatagtggttactagaggtggggagggggatgggggagaggagataaccagaggttggttaggggatgcactagtacagccaggaggaggaataagtggtaccgttccatagcactatagggtgattgcaaataacaacaatttgtggttttttttttttttttaaagacagtgtctcgctttgtcacccaggctgaagtgcagtggtgcagtcatggctcactgcagcctcggcctcctgctgggctcaagtgattctcccacctcattctcccaagtagccgggaccataggtgtgcgccaccacacccggctaatgtttttgatatttttggtatagatggagttttgccatgttggccaggccggtttctaattcctgagctcaagccatctgcctgccttggcctcccaaagtggtgggattataaggcgtagcctattgtgtattttcaaatagctagaagagcgaatttggaatgttcccaacacaaagaaatgacagatgtttgaggtgatgcgtctgctcattacatattgtatacatgtatggaaatatcacactgtaccctataaatatgtacaattattacatgtctattgagaataataataaagccaaaaatgcaagttccacagccccatccccaacccgccgaagctatacatctggaggcctaagaatcttcatcgtataaactcttttaaaaacgcaccatcttatttcaaaagcttttgcttcgtggagcatcccaagcttctaatgaggacactagcatttcctgggagctgccgtgtacctggcacaggctatgcggcttcaaatgtattacgttgactctccttgcagctcaggaaggtggggattactatgctcatttattttcagacagggaaattgaggctgagaggggtgaagcgacttattgcaaagggaccagctgtccattgtcacatggctgggaagtggctgagtcctctgcctctccaccctctgctacgtcacctcctcccatgtagttgttcccagtcacccacctggagagcctttcctggacttctcttcttcctcaccctgtcgtctcctttatagctcttatcagaatgtgcaattatttcacttcttggtttgtttaggtgatttatgtttcttttcctcaggcctctagttttccctagagcctagatggtgtctggtacattagtgggtgctcaatacgtacttgctgaatgaatgctgatgtggtttggctgtgtccccacccaagtctcatcttgaattgtagctcccataatttccatgtgctgtgggagggacctggtgggaggtaattgaatcatgggggccgtttcccccataccgttctcacggtaatgaataagtctcacagatctgatggttttataaggggtttccctttgtgcttgcttctcattctctcttgtctgccactatgtgagacgtccctttcgccttccactatgattgtgaggcctccccagcagtgtgcaactgtgagtccattaaacctctttttctttataaatcacccagtcttgggtttgtctttatcatcagcataaaaacagtacaatacaaatgggcttgttaatgcagctgtaggggccaacaccttccaataagacggcctcctgtcttgccacattttggcttccaaggctccgagcccgtttctccttgtgtgtacacgtctgtgtgtgtgcacctgtaggttacaaatcccttggcaaccttaacaccaatgcattgttcccacacctggcctagaaactcagagccacccccacccccactgccccccttcttagccagggcagcagcgcagctcaccaggctccccgaagcatccttcctgctgtttctgccagctgagaatggcctccagccaccggagcttgtagaagtcggagaagccgcccattccacagaacatgactggaagtaaagacgggggccctctgcaggcctgccccccaggcccacctcctcccactccccagggctgccacggtgccacctgccttcatctgcctgggttaggcttaggaggtgggcgttcaatgcagaggagggaaggaggcagcttgagcctttgcctgaccaactaggggctcccatgcttgtgtcccgcctcccactgagggccttggtcagggctgctccaaagtcaggatcagtggaggagtttggacaccccagccagctagcagcctcccaagcgctccctgtctgcctcatccataaggctttgtgggtctgtctgccagtcacctggtccatctgtgtagagctccgtcactggggcagcctttgggggcaggaaactgtcacacagtggcaggtaaaatacaggatgcccagttacatttgagttttcgataaacaatgaatataatttttgagtgtaagtatatcccatgaaatagttgggataaacttatactaaaaatggattcattgcttatctgaagttcaaatttaactgagcactctgtatttttacttgcttaatctggcaactccgtgtgtgtgtgtgtgtgtgtgtgtgtgtgtgtgtgtgtgtgtgtgtgtgtgtgtgtgtgtgttggtggggggacaccctgttcctttgccccgggggcagaatgctggccatactgttttccatgaagatgtcccgggtagggtaggcgtatccgatggcctcagctctgcggttcaagtccatcatgttggcgcagaagaggttgatatagtcctggctctgttggagtggtccctgtgtgcaccccctctggggagacaaacacccaaagacaagggagtcagtggtacagatgacagacacacgccctgctatgggaaagtcttgcagttctgagacggtcttgcaaggggctgtgtttagggctgtgtttagggcaggtctttttctccttttcgcaggatttcttccccatgcacacccccagcctgctgggttcgagatccagctctgccacttaggagcaaaccacttggtttgctaaagtaacctttctgagcctcaagagtttttatcaggaaagggcgaggcctctagaaacggcaccagaggggctctcgtagggggatgacacagctgggaagtgcccaatgtgatgcctgggccactaggaggtgctctgtgaccgatcgcgggggcaatgcaatgtacaacgagcctgaacccgcgggcagcttcagtgctactcaaagtgtgggccaagaaccgggctggtgactccccacactgggagagaagaacaagagttgacagcaggctttagacacttctgtagcagtggtcagagttactttccacctgctgaatctaatgatcaaaataattcccttgtaatatggtttttattgtatttataaaaatattgggctgtcacagcttgcagagaaataataatttttaaattctgttgaacaaaaacagagagtgtctcctcagctaaggatttctggacactgaatcacattgttttttgaatgaagataatgaaccctacctttctgtatgaagaaatatatatggccaggcacagtggctcatgcctctaaccccagcactttgggaggccgaggcgggtggatcacgaggtccggaattcaagaccagcctggccaacatggtgaaaccccatctctactaaaaatacaaaaattagctgggcatagtgggacgtgcctgtaatcccagctacttgggaggctgaggcagagaattgcttaaatccgggaggcagaggttgcagtgagctgagatcgtgccactgcactccagcctgggcaacagagtgagactccatctcaaaaaaaaaaaaagaaggaaaagaaatatacatatatatatgtatatatatatgtgtatatatatatatagtggtatatatatacatagtggtgtatatatatagtggtatatatagtgattatatatatcgtgatatatatatagtggtatatatatagtggtatatatatagtggcatatatatatagtgtgtatggtagtatatatataaagaaaagaaatatatatactggtgtgtgtgtatatatatatatatgccaccatatatatatttttctttttctatttttttatatgtatatatatagagagcggcatatatatatatagtggcatatataatgtagtagcatgatctcagctcactacagcctctgcctctctggttcaagcgattctcctgcctcagcctcccgagtagctggaattacaggtgcatgccactatgcccgactaatttttgtatttttagtagagacgggattttaccatgttggccaggctggtctcgaactcctgatctcaagtgatccacccacctcagcctcccaaagtgctgggattacaggtgtgagccaccgtgcccggcctcattcatttgtttttgtttacagagttctttctgatgattctcttttattctctctttctctctctcgttgtgtttttctgatgccctacagtccagttcagcaggcaaagctatctgtttcactggcctaacagaatcccaaatgccagatcccaaatcggctcaattacacagcaggagtatgataggggccctacttctccctcctgaggtcccaagtagaaatccaaagctctgcttattttcctggtgtgtagcagacagaactacactgccatgagccctttttcatttatttcttttttctttttttttgaggcagagtcttagtccattgcctgggctggagtgcagtggcgcaatcttactcactgcaacctccgcctcccgggttccagtgattctcctgcctcagcctcctcttgtagctgggattacaggtgcacgccaccacgtccagctaattttttttttgtatttttagtagagaatgggtttcaccatgttggcccagctggttttgaactcctggcctcaagtgatctgcctgccttggcctcccaaagtgcttggattacaggcatgagccaccacgtccggctgccccttttcctttttccttccccttcccctggcacggcgggggctccctgggcactcaccattctggcccagaggaagaagagcagttggtgggacaggcagtagcctgagcagccgggcttggtcatgaggctcctgcagaggtctgagaggccgcagggctcgctgctgtccgtcctgggggaaagtggttccaagctgttaaggatggagcgctgactctgccctgcgtcttcccagccccctagttgtagttgttggaactcccagtagattccagacacccagctgggcatgggggttgacagagacaatacagcagtcctgcattttgatttgctaaatctggctgccctagcccaggaaagatgacgctagagctattctggggttgaggaagccaccaaggctgaaacttcctattgctccatgggccaaatcacatcttttccagccccgaacagtgggtacttgaacccagaccacttggaatctgggcccaacatgcttattcctcctgcaccagccaggcgcggtggcttacacctataattctagcactttgggaggctgaggcaggcaagtcacctgaggtcaggagttcgagaccagcctggccaacatggtgaaaccctgtctctacaaaaaatacaaaaattagctgggtgtggtggcacgtgcctgtaatcccagctactcgggaggctgaggcaggagaatcacttgagaatcacttgaatccgggaggcagaggttgcagtgagttgagatcgcatcactgcactccagcctgggagacagagcgagactccatctcaaaataaataaataaaaataaaataaaataaagtaaaaataaaaaatacacacacaaatacaaaaattagccgggcatggtggcgcacatctgtaatcccagctactcaggaggctgaggcatgagaatcacttgaacctggtaggaggagcttgcagtgagccgagaaagaacacaccactgcactccagcctgggggacagtgagcctctgtctcaaaaaaataaaaataaataaaaatttttaaaaagcagaggtccttggctggggcccagcccctccgtgaatccagctgtgtcctggcctaagcactgctctgaaggatgctgacaggatgcggcctgggcaccggctgcccactttgcccatgggccctgcacctagggctgccctggggccttgttccaagcccaccaaacaccaggataaaatgaggagcccagctaggctcagtcctgtcttcctggagctgcatcctcactggggatggggacaggctcataatacaaatgtaaattgcatctgtggctataagaggtgccaggagaggccctcacaggaggtctgctatgtgctggggtcagagataggatggggttggaggtaggatgctggcgccagccctggaggatgggcagacttcctgaggcccagggggtggagtgggtggggtggggggagcaaagtctttgaagtgggaggaagccttggagagtctgaaaagaggcctctaggggcctggagacttggaactgcggagaggaattggggatttgtcctggggcctggaggtggtgtgttcagccatggctgctggaaggcctgctgtggcatgggaggccagcgggcggctggagcaagggggaccctgctggagtaggagagggcagtacccggcagctacagggagctgcacctgtgtctgcacaaacccctggcttcagccctagggcttggagaaggaggagcgggacaggaccagctgagaactagtgcgtttgggtttccagcaaatagggcaagtgcagggcccacccggttcccagcagctgcaccaggcacacgtcacttctctcctctgagaatgagtcctggggcccgaacgtggggtacaccaaggaggcatcagtgtggatccaggcatgtgggagcttccaaaacccgggctggagggtcagctggaactctggcagagaggacagatagatggggtggggtgtgggggtgacccaggagcagtgggccaccctggtgtccccacctcctcctgcagccctgcccactggcaggtgcagctcagggctctaagccctgtcccctggtcccagattgggtttgaaacactcaagaaagctccttttgcttataaaaccattttttcccctaatcaataggaacagtgatgggacgggatttgactaaacccactgcatcccatggaaaccccagataaataaaaggtttagtttcccaggtgcagggctcacgcctgtcatcccagcacttggggaggctaaggaaggaagatcgcttgaggcccaacgttcaagaccagcctaggcaacatagcaagactctgtctccacaaaaataaaaaaagtagccaggtgtggtggtgtgcacctgtagtcccagctgaggcaggaaggttgcttgagtctagaagttggagaatgcagtgagctatgatcagccttttttttttttttttttttttttaagaggcagggccaagagcggtggctcacgcctataatcccagcactttcggaagccaaggcgggcgaatcacttgaggtcaggagttcaagaccagtctggctaacacagtgaaatcccatctctactaaaaatacaaaaaattagctgggtgtggtggcaggtgcctgtagtcccagctactcaggaggctgaggcaggagaatagcatgaacccgggagacagagcttgcagtgagccgagattgcaccactgcactccagcctgggtgacagagcaagactccatctcaagaaaaaaaaaaaaaaaaaaaagccgggcgtggtggcgcatgcctgtagtcccagctacttgagagaggctaaagcaggaaaatcacttgaacccaggttgcagaggttgcagtgagctgagatcgcaccactgcactccagcctgggcgacagggtgagactctgtctcaaaaaaaaaaaaaaaaaaaaaaaaaaagagagacagagtgagacactgtctcaaaaaaaaaaaaaaaaaaaacccccccaaaaaaaaaaacaagtggggaggtggaattagtggggaggtgatattggtagaccttttggtttggtgagaacgtggagctcttaactaaacagatgcccagtcatagatatctttaagatgacataggtggggacagtgttagggaccaggcctgggagagggtgggggaccttaaaattggaaaggtcagcatgggctatggtccctgcggctggactgccgtgtgagcatgaagcgtggcctggctacctccccgctcacccccatgcatctgatgggagtggggagcagaggggacagggttggagcagcatgatggactggttatttgtgccccgcccttgccatccaggaacaactcagccaaacttattagatgggaccttttgcagggtcactcggggctggtgaggagagagagactctcagtggtcataaggcatgagaaagataaaccccactgttttgaaaaatagtgtgtggacaacttcgggaatttctactgacatttaatgaagtggattaaaataatttggtgacatgggacactactgtttgctgtgcaaagggttgaattgccttttggatactctcccctctgggacagcccagcctctccgctctagtctaggaccaggacctccagcttgtgcgtgcgctgaatgcttgagagaagacaccctgcttcctctgcacacctctgtgtgggtaggagagcccgtcagagtctgaagtcaaggatgaccgcacgtccccagggctcgtctgtggcttgctcagcagacaggtccaagttggttacggactgtcccagcccagccttgccccaggagagcccacgctgggttatttcagtcaatatccccataggcgctattcctgagggaatgggacaccctgcgtgtgctcacctcttaggtacttgggatcactcagcttgaggtagtggagggatctctggatggcagcctccagcttctcccccagcatccccacgcgcaggctcagcggctgcagcaggggctcctgggcccacttctcccggacactttttagctgctctggaagggaacagagttaattcattcaactatttggaatcgggacctttttttgccttggaacaagaaaaaaaaatgccccaaagtctaatgcttcctgggagcctctctgccttctccagcactcagaggggaaggatttactgagctgactggaaatgaggccaggatgggggtgatctgggcaatgagaatgggtgtcagagtagtagaaggtggtggctgagagcttggtttctggaggcgggcctgggttcaaatctttgatacttgaggttcaaatcctcaaatccttgactcatatactttcttgttggatggccagagaaaggttgcagggtagagaaccactgtgtacagttgagcaggttgtacactgcacaagggcaacacacatttggatcatgggtttgtatatgcagtaagacaatttcccagcagatggctgtcaagtgacttcaggaaggaagtgcctttttctaattcccacagaggtaccctgtgggctagcagtggctttgttgaggtgggagacaatggtgaagatccagaggtggccagaaattggggagacatgagtgagaacatccgagtgagagcattcacgcagggctgagagggcgagggatgaagtggggcagctgcagtcaggtaggaaccttgttagggaggatgggctaggttaagaaggatgctgaggtagtcctccagggcgaccggctctggcacgccccctctgctcagccccctccatgggcaaacccgcagggaagaagtaaaggcttgggagtgctgacagggaggggctccctgtgtgtcagagtgtctcctcctgtgattgcaccgggtctacaaagtccaataggacaggggtccccaacctccagtccattactggtctatggcctgttaggaatggggccgcacagcaggaggtgagtggtgggtgagcgagctaagctgcatctgtaatttacagccactccccatcattcgctgtcactaccgcctgagctccgcctgctgtcagatcagtggctgcattcgattctcacaggagtgtgaaccctgttgtgaattgcacatacgagggatctaggctgcacacaccttatgaggatctaatgcccgatgatctgagaccgtctcctatcacccccagacgggattatctacttgcaggaaaacagtctcagggcttcaactgattctacattgtggcgagttgtataattatatattataacataataacaataaacagaaagtgggctgggcacggtggctcacgcctgtaatcccagcactttgcgaggccgaggcaggtggattacttaagtccaggagttcaagaccagcatggccaacatggtaaaacctcatctctaccaaaaatacaaaaattagccgggcgtggtggtgggtacctgtagtcccagctatttgggaggctgagcaggagaatcgcttgaacctggaggtggaggttgcagtgagctgaggtggcaccactgcactgcagcctgggcgacagagcgagactccgtctcaaaataataataatataataataataataaataaaaaataaagtgcacaataaatttaatgcacgtgaattgtcctgaaaccctcccctccacctcagtccatggaaaaattgctttccacaaaaccagtccctggtgtcaaaaaggttggggaccactgcaatgggacgtagaccctgcccactgggagctcattgtttagagagacacaggtgaggaagccgttgctgctagtcaaggatgctcaatgctttgatagatggaaacagtaatggctgacaagtactgagccccactggtaagatgacatatacacacaatctcatgagacacatgtgcatgatcgtgtgatactcccatccaccagctgcagctgaaggatgaggaaaccaaaactccacgagagcagttaactcagtgccatgcagccagttgggggagatccaggatttgaacctgggcagtccagttctgaagctctgttctaggcactggcactgcctttgctcccttctgggcacagttcacgggtgtggttgtattaagcactgaattcctagggaatctgttatggagcaagattattgagaggagaaggggcagtggatgtgggatgtggcgtgggtggagaagccgggctcactgcagctgccaaggagtggggaccctggtctgaggctgttaggtggggccgctttcccagtgaatgctgcccagtcatgattaagagaaccccctcccttctttgctaaaagaggataataataatgggtgtaacctcagggatgacggggagagggcactgaagtaccccatgcaatgcacctgggttgtgcccacattgagcagatacttagtgaactacagcttttgctatcacatgcgccccaggaagcacccagccctgtgggagccacctgtgtgcttgtgtgtgtgtgtgatatgcttgtgtgcatgcgtgcatgcgtgcttgtgtgtgtgatgtgcatgtgtgtgtgcgtgcgtgcatgtgtgcttgtgtgtgtgtgcatgatgtgcgcatgtgtgtgtttaccttggcctgtctccagcccccttcttggggatcttatagctctcaaagctaaacaaacacttgactgtttttgcagaaccttcaggagactttggctgcaagtggaggaagtggggtgggaacccgatcttgagggtcctcagttttgtccacagccacctcattcaaggggaggggtcttcccacaaatatctgttaacggggcactctccctgctccccttgttcgtggcgttgtgaggaggggctgtcaaatggatcatttcattctgagaaaaagataattcccaaatcccttcccatgttgcctttaaatctttcctacttctaaaaaattgcgtaacagttagctgggccacagccgccaggaagatccagcccctggcctcctctctccttatagccgaggcaggctatactggggccaggagtctgccaggtcccaggcgtacagagcagggcaggggacaaagctgagagctagcttcccagtgtccagccagaggaattggggctcactcaccttccagcactcggacccccaccatgccatccaggttgatttcaggcagcctctgttctaggaagacggtggctctctccagcgcagacaggatcaggtctgcaatggtggctttactttcagcagtgtccagcccaggcagtgaggaggaccacagcggtggcagtgctgtcagtaagagcaggagcagcagccccaggctggccatggccggcctctgctcactgctggtcacacgctcagcaccctgagctctggccaagcccagactgcctctgcacgccctcctcccacctccttcccacctccccctggcagacatgaagacaagtggcccggcagggctgccaagaagcctggggtggcctgggcaaaggactctgggaagggtggctgcagggggatgacggttaggcagcggaggttaggccagtcctgggcgtagagcctgctgtccacgggatgctggggagagggctgcccgccctgtccttctcagccctgattctccaggctcacaggctagatctttgatctagcaattgcaattcaacccagaaatccaaaagctctgaaagcaaaacgaatttttttttctttgttttttgaaatagggtctcattctcttgcctaggctggagtgcagtggtttgatcacagctcactgtagccttgacctcctgggctcaatagatcctcttgcctcagcctcctgaatagctgggacaatcggcatgtgccaccatgttgcctaatttttgtagctttttttaatagagacagggtctcactatgttgatcaggctggtcttgaaccgctggcctcaagcgagccaccttctttgggctcccaaagtgctgggattacaggctggagccaccacacccaggctttgttttaaataaatttgaaacaaactcatttgagggcacgtctgccttgaactgaggcaaacttccttaaaggggcaccgtccaattgaaatagaattggagctacaaagatgagccatgtgtgcatttcgaaatttcctagtagccacatctaagaaagcagcaataagcaggtgaagttaattttaacgatctagtttatttgacccagttatttaaaatattataattacatctgtaatcaatatagaaatgatttgtttttatttttgtcatactaagtctttgaaattgatgagtagtttatgttcacaacacaattgttttattttgttattttatttttaagagacagggtctcattctgttgcccaggctggagtgcagtgatgtggtcatagttcactgcagtctcgagctcctaggctcaagggaccctcgcgctttagcctcccaaggagctggcactccagatgtaagccaccatgccaggctaagcacatttcaattcagactatccatatttcaggggcttgatagtcacatgtagctggtatactgggcagtgtcttagttttgtgctactacaacagaatacctgagactgagtaatttataaagaaaagaaattcatttggctcatagttctggaggctgggaagtccaggttcaaggggttgcatctggtgggggtcttcttgctatatcatcccacggtggagggcagaagggcacgagagctggagagagagaagagaaagaagctaaactcattcctttatcaggtacacgcttttgcaataacagcatgaatccattcatgagggcagaggcctcatgaaagattccatctctcaacactgttgcattgagaattaaggttccaacatacgaactttagggcacacattcaaaccacagcagagagtgaggacctagcgtccttattggtttcattcagtgtgaatgcgcatctgtttccttgcagaaatgttaatgttggtttcctgggtgctgtcccaaaccttgctggggctgttgtatgtatgtgcaccacattatctttctaaaatcccaacaattttgaattcagaaacatacttggtcccaagggcttcagcaaacagattacagatctgtaataataatcaaaagaacaccactaaagtgtgtatgtgatgctccctatgtgcagatgctaggttagggcttctccaccttttaatttcgtcattgttcttttttctacccccggagtgtttttagacgttttaatcctgaaaaatctttagtaagaggcttattgagatattattcacataccataaaattcaccttttaaatgtgtacagtttcacagtggtttttagtatattcacaaagttgtgcagccatcactatctatctccagaatgtttttgccaccctgaaaagaaatcccatacccatttgcagaaactccctattccctcctccccagcccctaccaaccatgaatcaactttctgtgtctatggtttgacctacggtggatatttcatataaatggaatcatacaatgcgtggctttttgtgtctggcttctctcactcagcgtgatgttttcaaggttcatctgtgttgtagcacatgtcagtactttattcttttttatggatgaataatatcatctcccggggaagcccctcctgctctgatgatttaagaggatgaggactatggagatgacaaaccaaaagtagacacctaggccgggcatggtggctcatacctgtaatcccagcactttgagaggctgaggcggggagatcacttgaggtcaggagttcaagaccaacatggccaacgtggtgaaaccctgtctttactaaaaatacaaaaattagccaggcgtggtggcacgcaactctaatcccagctacttgggaggctgaggcaagagaatcacttgaacctgggaggcagaggttgcagtgagccgagatggggccactgcactgcagcctgggtaacagagtgagactctgtctcaaaatataaaatgaaatgaaatgaaatgaaatataaaataaaataaaataaaataaaataaaataaaataaaataaaatgaaaacaagacacctggagcagggcgtggtggctcacacctgtaatcccagcactttgggaggctgaggtgggcggatcacttgaggttatgagtttgagaccatcctggccaacatggtgaaaccccgactccactaaacatacaaaacttagccaggcgtgatggtgcagggctgtaatcccagctactagggaggctgaggcaggagaatcacttgaacctgggaggtggaggttgcagtgagccgagacggcacccctgcactccagcctggacgacagagtgagactccatctcaaaacaaacaaacaaacaagcaaacaaggagacacctgggaaacctcgggtgggaggctgtgggagctgtggacagaccgcattctgttcatcactcatccactgatgagcctctggattgtttccatgatttgattcttgtggacagtactgatgtttgtttacaagtttttgttcgaaaacctgtttttcattctcctgggtgtatacgtgggaatgccattgctgtgtcacgtgataattctatgttgaacctaatgagggaccatacgactgttttccacagtggctgggccatttacgtgcccactggcagaagatgagggttccttatgtactgccccatgaaattttattttacttgtttatttttttgagacagggtctcgctttgtcacttaggctggagtgcagtggtatgatcatggttcactgcagcctcgacctccctgggctcaggtgatcttcccacctcagtctcccgagtagctgggactataggcacacgccaccaccattttttgggtattctttgtagagatggggtttcactatggtgcccaggctggtcttgaactcctgggctcaagtgatccttccgcctcagcgtcccaaagtgctgggattacaggcatgagccactgctttcagccttcataaaattttaatactgcagatatactgcatgcttgtgtattgtatcattatctgtgctttatacataaaaagggtaaggatgttttgctccccaagagccatttttgcccccttgggagcaccactgggaacagaggttctaggggaagcttgtcattgtcattacttctgttaatccttgatcacccctcaagtgggtgctcagtcaacttgaacaaaatctgaggctccaagggagattgagtgacttatccatatatcctcttgattgttggaaagactggatctcatgtggaatggatgccaagtgagaaagccggacaggtgggctggcccagctatgaaaccgcccccctgctggggatggctccgtcccctctctccaggagacaccacggcaactccctccccgacggaggttcacctaccagagggaggcatctacttttggtttgtcatcaccatagtctttatcctcttagctcatcagagcaggacaggctctcaaagacttgaagttcccctcccttaattcacagacgaagaaagcaaattgatggggagtgactcgcccgaggtggagcaggaaagccaggagtcctgaggctgaggtcccagatccctacctgtcccattacagagcgtcgacagagttgggcaggcgatgtgtcacaggcctccaccccagcacacgcaacctggaggcaggggcctcgctgggaactggaggataaatgccgctgccagcatgtttgtatgcccatccctgctgtctgcagatacttactcgtccttcctttccttctgaaagctcgggtttcaaggtctggcttaaggcgtgagctgtcccttctgaatccatagaaagggagtgatggggcaattgtgaaaagcagatgcaaagtgtgccaagccctgagctgagcccagggacactggggagccacatccatgtgggctaccctgtcccgtgggtgctgcctgtggtcctcatcaggggaggagtcttgtttgtttgttgaatacggtctgggtggtggctctccaggttctgcggcagctcccaagtggaggcaatggggtagcatcaccagtgagctcttggtgtttctctgcaagggaccgctttcaaagaaaaaaggtcatgatacggtttggctgtgtccccacccaaatctcatcttgaattcccatgtgttgtgtggaagggacccagtgggaggtaactgaatcatggggtcaggtgtttcccgtgccgttctcgtgatagtgaataagcctcacgagacctgattgttttataaaaaggagttttcctgcagaagctctctttttgcctgctgccatctatgtaagaggtgacttgctcctccttgccttctgccatgatggtgaggccttcccagccatgtggacctgtaagtccatgaaacctctttcttatgtaaagtgctcagtctcgggtatgtctttatcagcagcatgaaaacggactaatacaggccatcgcagagacacacattaaactctcactatggctactttgggaggtgaaattggagggtcactgtggaaatttcctttctagccattgatacttaagcaaaatcatgatggtgtttacttccttgtttgtccttccccctctctaccttttaaatgttttattaagtgtgatgtacaccctggaaaatgggcaggtaatctgctgcttgaggtaccgccccaaatgcagcacacccacattaccagcaccagatccagaagcagaacccaccagcccctaacttctaacagcgaggactggtttttatttacatagacggaactctacaattcgtactcgtcagcatctggctcctttatcaatgttaggatgaaatttatccaaattcttgtgtcactatattttgaaattatctttgaatcctgaagagagttcttagatcccaatacagtaacagctttactttagtcggggaaatacactggtgtgtagggaatctggtgtatgtgcgtgtgtcctactactactaattcttggccccgaggggctcctgggggttccccgggcccctgttagggaaccgcgtccacttctcgccctctcggcccacttcggaggctcggtctgcggctgcgcacagcgcgaggaagcgcggtcacgtgactgctgcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcagtgagtggccaagggtctgggagggacgatgctctctcagccgttgatcctcggttctaaccgccccggggagtcgaggcggaagtgctcctttagtcgccgcctttgggcagctctccgagattagacgagcggttctgccccagcctttcctgggtgggtctctaggtatagccggcgttaatcttgccacgtgtcagaagtgtgttaagtgaatccattgcgtggtctcacgtaattctcctagtaagtggaacccaggtgcgtggaactccagggctagtgctggtagctacgtccctgtgcagctacccttgtcaggctatgtctgagctgacaggatatttcattcctcatccctcaacgcagagctctgcagacagatgttttcatttgttcttcatgtccagcttttccccacagtgtgcagggcagcggtgtctgctccctcattattctccacgttggtatcttgagagggtagctcaaccccatctcaggaagaagtgggaacagcactagttgcctttaatccctgtttagaatctgctatcctagggtgatggggtagagtgggacttcctagggatggctctgtggtgggaaaattccactatccagacaatctagattagtttaattgagcacctactgtttgccaggcatcatgttaagtgaaggtaggtaagattcaggccctatctctgtgtgcctcctagagcaatctgaacaagaattggccgcattctctgttctggctagtgaggagcagagagaggttttgaaatatcttactttccaaaacactgtccgtgattcagcctgagttgggagattatctgactttagattgctgcttctggtacattaaagggatcattctcatttttcagactccaaaccccatgatgagctcttgcagaacaacagaattcagattgtggggttgacagaacttcagagtcttgcaggtaggatgccgtcaactccagaatcctctgaatccatgggctgggggcagggggtgttcgtttgaaaagccgtgcagattgccagacgctcctttggtagtcacaggtgttttctgacttgcagttgggccccgagttttccagtacggagtcaaagttgtacttcaggctatgtacttgctgtggaagttgatgtggagggagccaggtgcctatatctttctccaggtgtgtatcagcctctgcctccctctgtgagagccatgttagcagtttactttccagcacaaattggtactatattgcatattcatatgtgtgtgtgttgtgtgtatgggcgtttaaagacatgagtaggagcctatggtatgtgtctatttatggcacctatccatgctctctgtgtcattacagatagtcttacattgtactgactgtgtatcaagtgttttccatgtattaactcatttagtcctcacagttaccctaagaaatattgcatgtaggtaatacaagaacctgtttcttaaggttgttctcatttagatgagaaaacctagactgagaaaggctctgtaagtagcccatcgccatacagctaggaagtggtggaatcaggatttgaacgtaggtcgtcagtgtggttctatagtatacacacgcacgcatacgcgcgcacacacaaacacacatatatttttttgagacagagtttcgctcttgccgcccaggctggagtgcagtggcgtgatctcggctcactgcaacctctgcctgccgggttcaagtgattctcctgcctcagcctcctgagtagctgggattacaggtgcccgccaccacgcccagctaatttttgtatttttagtagaaatggggttacgccatgttggccaggctgttctcgaactcctgacctcaggtaatccgcccccctcggcgtcccaaagtgctgggattacaggcgtgcgccaccgcgcctggcctatcgttatacttttaatcccttcccttgatcactttttctttaaaaaatttttctttcttttctagctgaaggaagaatacttttttttttaaatcaatttttaatatatagaagcaccttcctcttttatttatttatttttatttttcctgagatggagtctctgttgctcaggctggagtgcagtggtgcgatcttggctcactgcaccttctacctcccgtgttcaagtgattttcctgcctcagcctcctgagtagctgggattacaggcatgtgccaccatgcctggctaatttttgtaattttttttagtagagatggggtttcgctatgctggccaggatggtcttgaactcctgacctcaggtgatccacctgcctcggcctcccagattgctgggattacaggcatgaaccatcgtgacccacaccttcctcttttaataggcagccttgaattccaatatgtgatgtactatactgcatgtatttagtctcatgttaatggatactcagattcttcctgattttgtttttacttttacaaatagtgtggctccaagcacagcgagcatatgccttttgtataagtccagtttctttcttagggtaacttcccagcagtggaattgtgtagtcaaagttgatgcattttaaaaatgtgtatgttactggatagctttagagtaaggttgggtcagtttggcccccgctgagtgggggtacctcttctcccccatgcttaccatcaccagctgttgttagacctttttagaatttgcattccaacaggtgaaaaatgccatctctttgttctgttttttgcctccttgattattgatgatcttggacttttcaggttggttctgtttgtttgtttggtttttgtttgtttgttttagaggcagagtctagctctgtcgcccaggctggagtgcagtggcacaatcatagcttaactgcagcctcatcctcctgggctcaagtgatcctacctcctcagcctcctgagtagctggggctgcaggtgtgtcccaccacacctggctaatttttaaattttttgtagagatgaggtctcactgtgtttcctaggccggccttgaactcctgggctcaaatgatcctcctgccttggcctcccaaagtgttgggattacaggcatcagccaccgcacctggcccattctgtttcttttatgactttttacatctattttggtggtggagagggtctttcttctgcttattatcaagagctctgtaaagataacagactcatcaccatgtgtgttgtgactatttttactgggtttattgcctagcatggtctgggtttcctccccttcaagtctctatctttcctagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtgagagtctaggaagagggtaaaataccgtcccctaaaccactcaaggatgagtgagaagaagggccatagtgggcctccggaagtcggttccttgtgggctctgcaggaggtggggtgaggctggtgaatcaggccgaatgctggttccaaatgatagaaacaggcctcagcaaaggaccacattttttggcccatgaaatggaagtgtctgtggaaatggttggtttcgagctcagcagtgtcactgggacccagctcacgtctgtctccacactcccttctggtggtggttcccggaactctcctagctcttgtcctcacgtaggctcattggggagggcagccctttctgattggctcatgtaggttacctgccttcctctgatctgcctgttgaggccagggggcaagtgctccagcagaagagctgggtctcaggagcatccatatctcatggacagagggtgggtgagggcagatccccaaattaaaacccagggctgctgttggtagctggagaagtgggccacagttgctgcagctgatgtgacagggagggaagaagggccagtggtagcagtgggacgtggagctgggaaggtcatctgctgtcctctgagcccaactataacatctctgttatactctgcacggccagccttcaggtgcacatccagcctccgtgtgcatgtccagctgctgcgtgtacttccggccttgggccattggctggctgtggccttcgccctgatagtttgttcactggcagtggtgacagcagcagcaaacagcttagttgagcaaatggagcagaatggtcaatggtgagcacctgctgcatgccagtcctccatccaagccctttttgtattttaccctgttcaatctctatgcacctcaggagggtgtaccttttacaagtcaggaaactgaggctgagaacgattatgcctcttgccacacagctaagtgtgaggaccaaaatatcccaggcaagcccatttccgagctttctctgcatcttgagaggaacaggcgatgataccctggcggtgataaataacccagaatcgcgcatgccgtgttccggctctaccctgcgatcagggctcagtctccgttaggagagaatgtgtacaatgctcactgaatccctttgccccacgttgagagcaagccgtgaccttacagcctttgcagtggtagcacagggtggctgagatcgctagtgaggccttcattgtatttcttccttttttttttttttttttttttgagacagtctcactctatgtcccagactggagtgcaatggcgccatctcggctcactgcagcctccgccttctgggttcaagcaattctcctgcctcagcctcctgagtagctgggattataggcacccaccaccacgcctggctaatttttgtgtttttagtagagacagggtttcaccacgttggccaggctggtctcgaactcctgacctcaaacgatccacctcccaaagtgctgggattacaggcatgagccaccgcgcctggcctgtatttcttccttttacagcaagagagaggatgttcactttggcagtgatacacagtgtccttctatttatttttttaaatttgtatttatttatttatttatttgagacggagtcttgctttgttgcccaggctggagtgcagtt

SEQ ID NO: 63 - DNA, 43 bp, Homo sapiens
aagatgctgatgtaacatccaggatttgatgttttactctcca

SEQ ID NO: 64 - DNA, 2516 bp, Homo sapiens
gtcagactcagaaggctcaaagacactccaagagtgagccgtgtgccaggctgcggacttgcggggaggtgtcacaggacaggggtgggggagtgagcatttcatggaacttcccctttagcccagcagcagtagggggcgtggaggaccccagggaggagcctaggtcggggtcttgggctaggccctgcgttctgcagtgggagaagggggagacctctctcagtctcctgaagtcctagggggctgtggggggttcttgaggctctgaaatgtctggtgatgtctgagtgtggctgtggttcaaggatttacagggtcgaggattttagtgtgtggggggggattgttcagggacataatgttttgtagatttggggccaagggcatcttgtcttggggtctcagcccccatgtaccctcagccctccaggccctggccacccccagagggataagaagggaggttcagtgtcactccggaggcctggctggcacaggtgaactcaggcaacacgttccctggcccaggcctcagtttccccatgtatacaaggacaggactgaccttggatcccccaaacccctgcctgatgggggcctggggagctgagacatctgaaactacacagggaggtgggacttagttcctctttgggggaggcagggatcatccaacccacccttcagtaaacaagactggaaaccgaggccagagagagacatgcccagggggacacagggacaacaaggctgagctgaagccagggccctgggctctgcatccccaaccccatttcagcctcgcccagctctgccccggcttgacctgtcaaaccccaccacgcgccctaccccatggctccaccagacaccccctgtgtcccaagcatgcattgatcttccctcagcctggaacgcctctcctcctgatcactgctgttcacttctcagggcagccttccagcctccagaaaaaaatccccttcgaggcgggcggatcatgaggtcaggagtttgagaccagcccgaccaacacggtgaaaccccctctctattaaaaatacaaaaattagctggcaaggtggtacatgcctgtaatcccagttactgaggagtctgaggcaggagaatcacttgaacccaggaggcggaggttgcggtgagccgagatggcgccactgcactgcagcctgggggacagagcaagaccccatctaaaaaaaaaaaaaaaaaaaggccgggcgtggtggttcacgcctgtaatcccagcactttgggaggccgaggcgggtggatcacgaggtcaggagatcgagaccatcctggctaacgtgaaatcccgtctctactaaaaaatacaaaaaattagcctgggcgtggtggcgggcgcctgtagtcccagctactcgggaggctgaggcaggagaatggcgtgaacctgggaggcggagcttgcagtgagccgagaacgtgccactgcactccagcctgggctacagagcaagactccgtctcaaaaaaaaaaaaaagaaaaaaaagaaaaagaaaaaagaaaagatcccctgtgtctgcccactgcattgcctccccagacccaaccagtggggacagctgcgtccagctctgggggctcccagacagccaggccgaagggctctcagcccctggcagtgctggcccgggacaaggccctcgggtcttcagctcaaggcccaacaggaaacagcacgggtcctcccttgcctttgtctacggggccttgaatactcggaccttcccaccctctcctatcattccctgcaccagcccttgcagaatcttccgcctcctctccattttacagaggaggaaaccgagggttgagcggcgaatgatttgccctgcctgcccagcacggaaaaaaatcactcttctggccccagtcgcctccctttctgtgctgtgagtctgtgtccagagcaggaagggctgctccgagctgcagggacgggctctgtgtgttaaaccttcaaatggcttccagggactcatggagcatccaggacacctggagatggcgactcctgggacccctggcccttccctcctctggccttcggtccgtgagggtgaattaagtgtgccacccaccaggggcagagacacatggagacagagattgagagacagagaacagagggggagacagaaagagagagggacatgaagagcaacggagttacaggaggatctgacgctccgttggggagacagggagaaatgtggggagatgcagcgtcccaggtgctccccagtggccctgcccctcctcccctctcccctccccaccaggcaggaccctcagggagctccagcctggacccgaaccctgtcccaccctgacgcacctgcaccaggccaggctggacctgtggggtgggtgcaggcctggccccagcccggccactgccctggaaacccctcccccgccaagatgctgatgtaacatccaggatttgatgttttactctcca

SEQ ID NO: 65 - DNA, 4511 bp, Homo sapiens
aagatgctgatgtaacatccaggatttgatgttttactctccaattctgcaaatccagacgcaggaggttttaagaggccgttgcaccctgcaataaagtgcgggacacaggaatcttggtcctcggggcacccccttccctcgggggggtttcgccccccgcactcacggcccctgagcccgcgcggaggcccgacgccccgcggccgacgccggtccccgccccgggccgccattggctgttgccatggcaccagcccgtcttcccgcgccctcattggctgtctcacccgcatccctcatcccgcatcctcccccgctcgcggtggtctcgcccagcgctaggagcggcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcgggtgtgtgtcctcggggaggagggcaggggcgcgacctccgcctcgcgtcgaggtttccatccctggctctcagcattgcccgtcagcacagactctggaccctccatttccccagagtgggagctggaggggaaactgagtcccggtgagctgggcgtcagcgtttctgcagccggtcctgcgcacacacccactcacgggcttcaccatccggacctccctgaggtgatcggaggaagggatgggcaggccagtggtgtgtcttcgggggtgttgctgcacctctctgggtgtcagtttccctctctggaaagagggggtttggattaaaggaaggagaaaggcccctttgggcctggcttcccatacctgtgcctccctcccctgaaatgcagcccgctcaataagaccagcccccagtcatggtgccttcagggagtgatcgctcaggaaggcccccaggaggctacacgatgcaacctgggggtgaaagtaggcagaagagcttcgtggaagaagctgcactgtgtgggatggcaggacttagaaaaggtgctctaggcagggcaactgcacgtgcaaaggcctgagagaagagagcctccagcctctaagtgagtcgcggtgtacatggaggagtcggagcgtatcctgagggcactggggagccatggaaggtgtttgagcatgggagaaatgggatctcacttgtgacgtttaaagctccctctggctgtgcatgggggactgtgggaggccaggaagaggctgatcagaatgtcctcacagaggggtgtcaggagctgggggaggcatgatcccgctgggcagagcttggagggactagcttagtctgatgaggatgcagaaatgaccaccgaatgtggggagagggaaggtgtctgaggcttggcttcggtcagctgagaagaaccacgtgggggaggcctgggtttggggagcaggaggcagacatgtgttgctttgcacgtcatctggtccttccacctggctgggcatgggatggtgacctcagctggaacatggggctcgagccagaccccagggtctccctgcgtgtagcccccaaccccaagcctgatccccactggagacctgaacagccttggacatcatcggatcagggtgggaggtgccagcctctgccacctgacttccagtccctgtgcccctcccaccctgcccttgggcactcctgccctgcaggttcctcagaggggcaacccaaagccagagaggggcgggtcttgtcgggcctccagcctggacttcccagcccctctggggcagcatctgggtgccagacctcggttcctagggcctcgtttctccctctgggaacagccaaatggtggtccctgagactcaggacagaccaagaaggagccggatgacatggcaagccacacactgcgtcccctgagcaggacgggacagcccgactccatcctcccacctgcgactgagcccccacccctactcctgtcccagccgtgcccctggtgacatttgggtgggaggggaggggatgagggggcacctgggggtcagagaacaaatgacgggtgaatacatgtgtgtggccaggtggaggagggaggggaggagcaggtgggctggacagggccggtgtgaggaaggggctcaggctggcagggggaggtggcagagggatgggctgccattggtgcgtctgagacaaaggcggagggaggaggcgagcgctgatgggaaaggaacaaagagggaaggggggcgtgaaggggggctccggcgggagggccgagccgagggaggaggcgccggccagctggacagagggaggaggccaggccagagccagaagacggccagaggcacaaagaagccagcgcgctggcagagtcaagggatggggcaggggctgccggggccagcagggaccagctgaaggctgcgcagggggtgcgggccacacaggtagccaccctgagctcagccaccgatggagggtcgtggggctgctgcggtgatggcggtgggcttgggtccatctgtcctgccgtttctgcacagcttaggtgtcacccactggccttcgtggtgttttcattgtccatcggcagggacagctggtggtctgtccgccccgcgtgtctggctgtcagcctctgggcaggcttgcttttatgggggagggtcctgtctgtctgtctgtcgccctctctggctgtgagcctgggggtgctgggctggccagtcggcttgctgggttaggctgtcccagctgtctgtgtgtttgtccggctgtcaggatgtgtcctgggggctgggaaggagaggccgacccatcgtctgtcggtcgactggtcagttggacgttcagctgtctgtacgtctgtctgctggcccctctgtctccccttggggccacctctcactccacctgcccctctgcgccccggattgcctggccaccaccacgtgggcctgtacttgtccacaccagtgactcctgcctgagaccccccccaacccaggatcaggcaggacggctggggcttaggtcaggggccgtctgtccggaaggcatcaccgcgccctccccagaccatcagctgaaccctctgaccctgtgatcccagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggtgggggcctacatggaggaggtgggctagggtcccggggtggtgccccccggcagcccagtgcagtggctgatggcttcccgccctctttcccgcccctgcaggaggtcctgaagcacctacagggaaaactggagcaggaggcccgagtgctggtgtcctcggggcagacggaggtgctggagcagctgaagggtgagcggtggggccacccgcagagggagtgggggaggctggggggaaaggcaggcagggccgctgacctccgccctgtccccgcccatccagccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgagtgggcgtgggaacccagcctcgggcagctggagcatgactcggtccccagcgggctctgccctctaattcgcccacccgcatatgtctctgcccacacctcacacgccccacccacttgcatatggcactgcccaccgaacaaccccgcccacctcggagcttcgtccccacgtggcctccctccccctccccagcccggctgacctctgctggagttcagagaggatgggggacgttcctggctgagggaaaggctccttggagacgtccccaggggtccgagacacgcaggcgtcgccagggaccgggctgtgtccggtgccagggctcagccaggcctggagccaggcgggctcaaagccgtctttgtagagagctgtggcccaagaagcgtgggctcagggccagcagagggaggcagggtctgggcaccctgtgcagctgggaggggtcatgtggggtcagatggggccattgaagagcagcgtggggttgtctgtgctctgctgtgggacctcactcagctcccctaaaccctcccagcctaagactcctgccctgtaaaatcggaatggccgtgtctcccatgaggttaagggaaacctctgttgcacctggagcactttgagcctgaagctaccttgtaagctggagggaggttagcaagtatgggagaagtgttagaggcagga

SEQ ID NO: 66 - DNA, 6153 bp, Homo sapiens
atgaattttagcataaattcatttaaagagggacaacaaataaaatcttttgtgaagactaaaaatttcttttgtacaatacaaaagatgaaacaaaatgttggttctttgaaaaaataaataaaattgatagaccattggcatgattaaccaagaaaagaagagagaaaatccaaataaccccactaagaaacaaaacaggagatattacaactgacaccactgaaatacagaagatcactcaaggctactatgaacacctttacatacataaactagaagacctagaagagatggataaattcctggaaaaaatacaaccctcctagcttaaatcaggaagaattagataccctgaacagactaataacaagcagcaagattgaaatggtaatttaaaaattgccaacaaaaaaagtccaggaccagatggattcacagcagaattctaccaaacattcaaagaattggtactaatccttttgaaacaataccacaagatagagaaagaaagaaccctccttaatttattttatgaagccagcatcaccctaataccaaaaccaggaaaagacataacccaaaaagaaaactacagaccaatagccttgatgaacacagatgctaaaatccttaataaaatatttgctaactaaatccaacaacatatcaaaaagataatctgccatgataacgtgggtttcataccaaagatgcagggatagtttagcatatgcaagtcaataaatgtaatacaccatataaacagaacgcaagtcaataaatgtgatacaccacataaacagaattaaaaacaaaaatcacaactaagagcagaactgaaggaaatagagacacaaaaaacccttcaaaaaatcaatgaatccaggacctggttttttgaaaagatcaacaaaagtgatagaccactagcaagactgatgaagaaaagagagaagaatcaaatagaggaaataaaaaatgataaaggggatatcaccaccaatcccacagaaatacaaactaccatcagagaataatataaacacctctatgcaaataaactagaaaatctagaagaaatggataaattcctcgacacatatacccgcccaagattaaaccaggaagaatttgaatctctgaatagaccaataacaggctctgaaattgaggcagtaattaatagcttaccaaccaaaaaaagtccaggaccagacggattcacagccgaattctaccagaggtacaaggaggagctggtaccattccttctgaaactattccaatcaatagaaaaagagggaatcctccctaactcattttatgaggcaagcatcatcctgataccaaagcctggcagagacacaacaaaaaaagagaattttagaccaatatccctgatgaacatcgaagcaaaaatcctcaataaaatactggcaaactgaatccagcagcacatcaaaaagcttatccaacatgatcaagtgggcttcatcgctgggatgcaaggctggttcaacatatgcaaatcaatgaacgtaatccagcatagaaacagaaccaattacaaaaaccacatgattatctcaatagatgcagaaaaggcctttgacaaaattcaacaacccttcatgctaaaaactctcaataaattaggtattgatgggacgtatctcaaaataataagagctatttatgacaaacccacagccaatatcctgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgctgatgacatgattgtatatttagaaaaccccatcatctcagcccaaaatctccttaagctgataggcaacttcagcaaagtctcaggttacaaaatcaatgtgcaaaaatcacaagcattcttatacaccagcaacagacaaacagagagccaaatcatgagtaaactcccaatcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgctatccccatcaagctaccaatgattttcttcacagaattggaaaaaactactttaaagttcatatggagccaaaaaagagcctgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccgcatatctacaaacatctgatctttgacaaatctgagaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctggaagaaaacctaggcaataccattcaggacataggcatgggcaaggtcttcatgtctaaaacacaaaaagcaatgacaacaaaagccaaaattgacaaatgggatctaattaactaaagagcttctgcacagcaaaagaaactaccatcagagtgaacaggcaacctacagaatgggagaaaatttttgcaatctactgatctgacaaagagctaatatccagaatctacaatgaactcaaacaaatttacaagaaaaaaaataaacaaccccatcaacaagtgggcgaaggatatgaacagacacttctcaaaagaagatattaaacagccaaaagacacatgaaaaaatgctcaccatcactggccatcagagaaatgcaaatcaaaaccacaatgagatatcatctcacaccagttagaatgtcgatcattaaaaagtcaggaaacaacaggtgctggagaggatatggataaataggaacacttttacacattggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaacaaacccaaatgtccaacaatgatagactggattaagaaaatgtggcgcatatacaccatggaatactatgcagccataaaaaatgatgagttcatgtcctttgtagagacatggatgaagctggaaaccatcattctcagcaaactatcacaaggacaaaaaaccaaacactgcatgttctcactcataggtgggaattgaacaatgagaacacatggacacaggaaggggaacatcacacaccagggcctgttgtggggtggggtgaggggggagagatagcattaggagatatacctaatgttaagtgatgagttaatgggtgcagcacaccaacatggcacatgtatacatatgtaacaaacctgcaccttgtgcaaatgtaccctagaacttaaagtataataaaaataaataaataaataaaaatcacataatcatttcaatagatgcagaaaaagcattcaacaaaatccagcattactttattattaaaactctcagcaatgtcggcaaacaagggacatatcttaatgtaataaaagccatgtatgacaaacccacagccaacacaatactgaatgggaaaaagttgaaaacattccttctgagaactggaacaagagaaggatgcccactcccaccactcctcttcaacatagtactggaaatccttatcagagcaatcaagagaaagaaataaagggcatccaaattggtaaagaggaagtcaaactgccactgtttgctaacaagatgattgtttaccttgaaaaccctaaggattcctccagaaagctcctagaactgatataagaattcataagtttctgggtacaagattaatgtgcacaaatcagtagctcttctatacaccaacaatgactaagtgaagaataaaatcgagaactcaacaccttttacaatagctgcaaaaaaagaaaaaatacttaagaatatacctaaccaagaagttgaaagacctctacaaggaaaactaccaaacactgctgaaagaaataataggtgacatgaacaaatggaaacaaatcccatgctcatggatgggtagaactgatattgtgaaaatgaccatattgccaaaaacaatctacaaatcaatgcacttcccatcaaaataccaccatcattcttcagagaattagaaaaaacaattctaaaattgatgtggaaccaaaaaagtgcccacatagccaaagcaagattaagcaaaaagaagaaatctgaggcatcacactacctgatttcaaactatactataaggccatagtcaccaaaacagcatgggattggtataaaaataggcacatagacccatggaacagaatagagaacacagaaataaacccaagtacttacagccaactgaacttcaacaaagcaaacgaaaacataaagtagggaaaggaaccctcttcaacaaatggtgttgggataattggcaagccacatgtaggagaattaaactggatcctcatctctcaccttatacacaaatcaactcaaaatggattaaagacataaacctaagacttgaaactataaaaattctagatgataacatcaggaaaacccttctagtcattggcttaaacaaggatttcatgaccaagaacccaaaagcaaatgcagtaaaaacaaagataaatagctcggacctaattaaactaaagagcatttgcacagcaaaaggaacagtcagcagagtaaacagacaacccacagagtgggagaaaatcttcacaatctatgcatctgacaaaggactaatatccagaatctacaacaaactcaaatacaacagtaagaaaaaaaaccatcccatcaaaaagtggtctaaggacatgaatagacaattcccaaaagaagatatacaaatgtccaacaaacatatgaaaagatgctcaacatcactaatgataaaggaaatgcaaatcaaaacttcaatgcgataccacctcactcctgcaagagtagccataatcaaaaaatcaataaaacagtagatggtggtgtggctgcagggaacacttttatactgctggtgggagtgtaaactagtatagctgctatggaaaacagtgtggatattcctttaagaactaaatgtagaactaccatttgatccagaaatactgctactgggtatctactcagaagaaaataagttattattcgaaaaagatatttgcacacgcatgtttgtagcagcatgattcacaattgcaaaatcatggaaccaatccaaatgcccatcaatcaatgagtggataaagtagctgtgatgatggaatactgcacagtagtatatgatggaatactacacagccattaaaaggaatgagttaacagcatttgtagtgacctggatgagattgaagactattattctaagtgaggtaactcaggatggaaaaccaaacatcatatgttctcaccgatatgtcggaactaagctatgaggacacaaaggcataagaatgacacaatggactttggggatgtgggggaagagtgggaggggggtgagggatagaagactataaatatggtgcagtgtatactgcctgggtcatgggtgccccaaaatctcacaaatcaccactaaagaacttaatcatataaccaaataccacctgtacccaaataatttacggaaaataaaataaaagtcaatgtaccccaggatatgggggaacagaaaaaaatgta

SEQ ID NO: 67 - DNA, 8910 bp, Homo sapiens
atgaattttagcataaattcatttaaagagggacaacaaataaaatcttttgtgaagactaaaaatttcttttgtacaatacaaaagatgaaacaaaatgttggttctttgaaaaaataaataaaattgatagaccattggcatgattaaccaagaaaagaagagagaaaatccaaataaccccactaagaaacaaaacaggagatattacaactgacaccactgaaatacagaagatcactcaaggctactatgaacacctttacatacataaactagaagacctagaagagatggataaattcctggaaaaaatacaaccctcctagcttaaatcaggaagaattagataccctgaacagactaataacaagcagcaagattgaaatggtaatttaaaaattgccaacaaaaaaagtccaggaccagatggattcacagcagaattctaccaaacattcaaagaattggtactaatccttttgaaacaataccacaagatagagaaagaaagaaccctccttaatttattttatgaagccagcatcaccctaataccaaaaccaggaaaagacataacccaaaaagaaaactacagaccaatagccttgatgaacacagatgctaaaatccttaataaaatatttgctaactaaatccaacaacatatcaaaaagataatctgccatgataacgtgggtttcataccaaagatgcagggatagtttagcatatgcaagtcaataaatgtaatacaccatataaacagaacgcaagtcaataaatgtgatacaccacataaacagaattaaaaacaaaaatcacaactaagagcagaactgaaggaaatagagacacaaaaaacccttcaaaaaatcaatgaatccaggacctggttttttgaaaagatcaacaaaagtgatagaccactagcaagactgatgaagaaaagagagaagaatcaaatagaggaaataaaaaatgataaaggggatatcaccaccaatcccacagaaatacaaactaccatcagagaataatataaacacctctatgcaaataaactagaaaatctagaagaaatggataaattcctcgacacatatacccgcccaagattaaaccaggaagaatttgaatctctgaatagaccaataacaggctctgaaattgaggcagtaattaatagcttaccaaccaaaaaaagtccaggaccagacggattcacagccgaattctaccagaggtacaaggaggagctggtaccattccttctgaaactattccaatcaatagaaaaagagggaatcctccctaactcattttatgaggcaagcatcatcctgataccaaagcctggcagagacacaacaaaaaaagagaattttagaccaatatccctgatgaacatcgaagcaaaaatcctcaataaaatactggcaaactgaatccagcagcacatcaaaaagcttatccaacatgatcaagtgggcttcatcgctgggatgcaaggctggttcaacatatgcaaatcaatgaacgtaatccagcatagaaacagaaccaattacaaaaaccacatgattatctcaatagatgcagaaaaggcctttgacaaaattcaacaacccttcatgctaaaaactctcaataaattaggtattgatgggacgtatctcaaaataataagagctatttatgacaaacccacagccaatatcctgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgctgatgacatgattgtatatttagaaaaccccatcatctcagcccaaaatctccttaagctgataggcaacttcagcaaagtctcaggttacaaaatcaatgtgcaaaaatcacaagcattcttatacaccagcaacagacaaacagagagccaaatcatgagtaaactcccaatcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgctatccccatcaagctaccaatgattttcttcacagaattggaaaaaactactttaaagttcatatggagccaaaaaagagcctgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccgcatatctacaaacatctgatctttgacaaatctgagaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctggaagaaaacctaggcaataccattcaggacataggcatgggcaaggtcttcatgtctaaaacacaaaaagcaatgacaacaaaagccaaaattgacaaatgggatctaattaactaaagagcttctgcacagcaaaagaaactaccatcagagtgaacaggcaacctacagaatgggagaaaatttttgcaatctactgatctgacaaagagctaatatccagaatctacaatgaactcaaacaaatttacaagaaaaaaaataaacaaccccatcaacaagtgggcgaaggatatgaacagacacttctcaaaagaagatattaaacagccaaaagacacatgaaaaaatgctcaccatcactggccatcagagaaatgcaaatcaaaaccacaatgagatatcatctcacaccagttagaatgtcgatcattaaaaagtcaggaaacaacaggtgctggagaggatatggataaataggaacacttttacacattggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaacaaacccaaatgtccaacaatgatagactggattaagaaaatgtggcgcatatacaccatggaatactatgcagccataaaaaatgatgagttcatgtcctttgtagagacatggatgaagctggaaaccatcattctcagcaaactatcacaaggacaaaaaaccaaacactgcatgttctcactcataggtgggaattgaacaatgagaacacatggacacaggaaggggaacatcacacaccagggcctgttgtggggtggggtgaggggggagagatagcattaggagatatacctaatgttaagtgatgagttaatgggtgcagcacaccaacatggcacatgtatacatatgtaacaaacctgcaccttgtgcaaatgtaccctagaacttaaagtataataaaaataaataaataaataaaaatcacataatcatttcaatagatgcagaaaaagcattcaacaaaatccagcattactttattattaaaactctcagcaatgtcggcaaacaagggacatatcttaatgtaataaaagccatgtatgacaaacccacagccaacacaatactgaatgggaaaaagttgaaaacattccttctgagaactggaacaagagaaggatgcccactcccaccactcctcttcaacatagtactggaaatccttatcagagcaatcaagagaaagaaataaagggcatccaaattggtaaagaggaagtcaaactgccactgtttgctaacaagatgattgtttaccttgaaaaccctaaggattcctccagaaagctcctagaactgatataagaattcataagtttctgggtacaagattaatgtgcacaaatcagtagctcttctatacaccaacaatgactaagtgaagaataaaatcgagaactcaacaccttttacaatagctgcaaaaaaagaaaaaatacttaagaatatacctaaccaagaagttgaaagacctctacaaggaaaactaccaaacactgctgaaagaaataataggtgacatgaacaaatggaaacaaatcccatgctcatggatgggtagaactgatattgtgaaaatgaccatattgccaaaaacaatctacaaatcaatgcacttcccatcaaaataccaccatcattcttcagagaattagaaaaaacaattctaaaattgatgtggaaccaaaaaagtgcccacatagccaaagcaagattaagcaaaaagaagaaatctgaggcatcacactacctgatttcaaactatactataaggccatagtcaccaaaacagcatgggattggtataaaaataggcacatagacccatggaacagaatagagaacacagaaataaacccaagtacttacagccaactgaacttcaacaaagcaaacgaaaacataaagtagggaaaggaaccctcttcaacaaatggtgttgggataattggcaagccacatgtaggagaattaaactggatcctcatctctcaccttatacacaaatcaactcaaaatggattaaagacataaacctaagacttgaaactataaaaattctagatgataacatcaggaaaacccttctagtcattggcttaaacaaggatttcatgaccaagaacccaaaagcaaatgcagtaaaaacaaagataaatagctcggacctaattaaactaaagagcatttgcacagcaaaaggaacagtcagcagagtaaacagacaacccacagagtgggagaaaatcttcacaatctatgcatctgacaaaggactaatatccagaatctacaacaaactcaaatacaacagtaagaaaaaaaaccatcccatcaaaaagtggtctaaggacatgaatagacaattcccaaaagaagatatacaaatgtccaacaaacatatgaaaagatgctcaacatcactaatgataaaggaaatgcaaatcaaaacttcaatgcgataccacctcactcctgcaagagtagccataatcaaaaaatcaataaaacagtagatggtggtgtggctgcagggaacacttttatactgctggtgggagtgtaaactagtatagctgctatggaaaacagtgtggatattcctttaagaactaaatgtagaactaccatttgatccagaaatactgctactgggtatctactcagaagaaaataagttattattcgaaaaagatatttgcacacgcatgtttgtagcagcatgattcacaattgcaaaatcatggaaccaatccaaatgcccatcaatcaatgagtggataaagtagctgtgatgatggaatactgcacagtagtatatgatggaatactacacagccattaaaaggaatgagttaacagcatttgtagtgacctggatgagattgaagactattattctaagtgaggtaactcaggatggaaaaccaaacatcatatgttctcaccgatatgtcggaactaagctatgaggacacaaaggcataagaatgacacaatggactttggggatgtgggggaagagtgggaggggggtgagggatagaagactataaatatggtgcagtgtatactgcctgggtcatgggtgccccaaaatctcacaaatcaccactaaagaacttaatcatataaccaaataccacctgtacccaaataatttacggaaaataaaataaaagtcaatgtaccccaggatatgggggaacagaaaaaaatgtactcaataactatatctgaaataaataaatgacctaacctcaaaaataaataaaatgataggaaaaaataaaataatcgtaaaaatttgttttgtttttcccagactcttatctacatctaaatagaagatattattttgcaactcaatgtttagatctttctaacagattcgtcttagatttcataaaaacataagccctctcgaacataaaataattgttgttttaacatttgattaaatatgtacttacaatgcaaacgaaaattgtataaacagaatttggaacaaacacaactattgtgaagaacacaatttaactggcattaattgacgtacatgaggatattaaagtgtaggacactagctacaggtatttaatgggacataggcatgggtcatgctttgtagagtcaggttatttggcagatttgtaaaatggaatctggttaggaaatttttgctgaaaacttaagtgatcagaacttagcaagggctgcgtgcactggctcatgcctgtaatcccagcatgtttggaggctgaggcaggtggatcagctgaggctgggacttcaagaccagcctggacaacatggcgaagtgtcatctctactaaaaatacaaaaattagctgggcatggaggcacatgcctataatcccagctacttgggaggctgaggcaggagaatcgcttgaacctgggaggtggaggttgcagtgagccaagattgtgccattgcattccagcctgggcaaaagagtgaaactccgtctcaaaaaaaaaattatatatatatatatataacttagcaaggatattgcaagaaagcttcatggattctaaactaatatctttccattttaagtgatggcagtcaaactcaatgaagcaagagaaaaaataacaataaacaaaataatttattggtttatacaactaggaagttcaggcatttatctttcactaatgcctgtatccacaagttaaactaatctcactaggattgtattttccaatcctttgttcttttttcactttgcattagcttccttctccaggaagtttccccatgttatggcaaaagtagctacattgtctttacagccaacaagcgacattatctttatagccctgtgaaaaagtcccttttcctgattgttctaggaaaaatctgttatgacttactggctggagttgggttacatgcacacaatgaacaatttacttgggccaggggatggaatttgttgttcagttattgcttggtaacagacctgcccctaggaattggtaaagtcctttttggaaccctggactaccaagaggatgggtgtgtcacttgcaatttttaccaaaaaaatcatgtttcatccatctgggagtcagacatttcataatctttaaaatattcctgcagctctcagaattagttaataggactgtctccatttgagcttggatatgctttgtcttttttgtgtgattctatttcttctttcatgttgatatataatgtacatatttatggggtacatgtgatattttgacacatgcatacaatgtgtcatgatcaaatcagtgtatttaaaatatccataatctcaaacatttgttatttctttgtgttagaaacatttcaaatcttctcttccagctattttgaaatatacagtatattgttgttaactatagtcaccttactgtgatttggaacactagaatttgttccttttatgtaactataattttgtacccattaaccagtctctcttcaccctctcccctgacccttcctagcctctcatattgataattctactctgtacctccatgagatccacctttttagctcccacaaatgggtgagaacatgcaatatatgtctttatgtgcctgtcttatttcatttaatataccgacctctaattttatccatgttgctgcatatgacagcatttagttattttttatacctcaatcgtattctattatgtatgcatgccacattttctttatccattcatttcttgatggacatttacatagattccataacttggctattgtgaatagtgctaccttaagcactagggtgtaggtatccctttgaaatgctgattttcgttcttttgggtaagtagtcagtaataggattgctggatcatgtgatagttctaatttcagttttgaggaacctccatacatttttaaataatggctttatttatattcctaccaacaatgtataagacttcccctttttctgcattctcatcagcatttgttaattgtctttttgtaatagccattaaaactaggataatataatcggtttcttcttattaccaaatcatctctgcttctccatgccactgtatccccagttatacctgtcatttcttgcatttcttggtacctaatattttagctgtcttttattcgggtcaacatttaaattacagattttcctccaaatttctcagaggcagtaatgtttctagtgctattgctttgtgtatttctatttataactgccttcatatgatttcgggaaatataattccctgtgggaattttctagaattcctaaattgactcctgctcaagacttacgataagaaaagtttttgtagacttccataaacaaaactcatatctgtatatctgtagctgtgtgtctgtatctatatctttatcacttatacctatgaataactatatctacatataaatctgtatttatgtctatatataatc

SEQ ID NO: 68 - DNA, 3481 bp, Homo sapiens
ggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactctttt
